United States Patent 11,401,555 (GENETIC POLYMORPHISMS ASSOCIATED WITH STROKE, METHODS OF DETECTION AND USES THEREOF) - sequence listing, part 3

SEQ ID NO: 310 - DNA, 100038 bp, Homo sapiens
ccccttcaatcttcagaagcaagcactgctcttattttttcttcaccacagatttgttttgcctgttctagaactttatagaaatgaagtcatgtcgtatgtagtcagttctgtctggctccttccgttcagtgtgttttgtgctatattcatgtcatttgtgacgtgctgaggattcatttctttttgttagtgagtagtattccattttaagaagatataatttgtttttacattctcctcttaatgggctgtttctgggttttggctatgattcataaaactggtgtgaacaaatatttttgtggacataaattttcctttatcttgagtaaatatcggattgaaatggttgggtctggggtaggtgtattttcggttttataagagacttccaggcccttttccagatggttgcaccactttacatccaccagcaatgcttgtgcgttccagttgctccacagcagcaccactaaagtctttttaaaatgttagcgattcccgagtgcagcatgtataaccttccaaaaaattcaacatcatcttccgctgtgtttccatccatctgaagcctgttagaatttatccaaatccaaatcagtaaacccagagtcagttctccaaaaattgtgtggaaaatctaaaatttatctttactactgctggctgccccctcttggcacttctgtgctcttaggcaccaggaatttggtaacctggtttctcatctcttccattgttttgttttgttggagagagagtctcactctgtcacccaggctggagtgcagtggtgccatcatagctcactgcagcctcaacctcctgggctcaggtgatccgtccacctcagcttctcaagtagctgggacttcaggtgcacgccaccgcactcaactaattaattttttttttttttttgtatttttttctacagatgaggtttcatcatgttccccaggctggtctcatactcctgagttcaagcaatccacctgccttggccacccaaagtgctgggattacaggtgtgagctactgcgtctagccctcttccatcgttttcaaggagggatcaggggtcagctgttcgcaacttggtacgaatgagtttgtcattggatcacctcccttgggaggaagtcttgccctggggatgtaggaacaagaactaacatgctcagtgcctcctaacagccccactttacctagtgtgtcaattccccacagacaagtaaactgaggcccaggaagcatcgttgcctgaggttgccgagttgataagcaaaggtctcagtccctgtggactcagagcctgggcttctcccctgggaccctgcagctccaccggcagttattccaattcttcctcaggtgttggaggcttgtatggaaactccttgcttctgtctctcgctcagcccttagaaaacctccaagagatggccactcctgcctgtggtgcagagaacgcccaggcagaagacccttggaggctcagacagagaactcactgcactttcagtcatcctgggctggctccccggcccctctcacgttctttatggatttgacccaaagtcttccagatggatggagctgtgggcactgagtctgggaatgtctcagcccaccttggctcccttctccagcaggagtggaggtgtgtgatgtcaaacaggcccagcctctctctcagacccggttctgggcccacacagccccttcttcctgaaagcagaggtggcagtaagaggatggctttggcctttgaatgttctcaagcgatccaagttcagagtatactgttgctgtcctctgtccctgaagcttctctcctactccttggacaaactcacttctcccctcagggacttctctcatgtagcagagtgtacacctgctgccccagcaaggccttcacaatgatccaagcctggcctgttgctccagcttctggaacctcccatggccttcggtctacttgaatgctcctgaggccaggtagctcatcactgccggaggacctgttgccactcacttctagccacaagaaatgtctgcctgtcctgagcaaaacccaccttggaggaacttctttactcccttgttgaatttttggctctaccaaataaacatgaattgcttccctgtgaaagacctccaaacactttcctctgcctgtgtgttgttcatcagtggtgtagccgaatccagggcgaggaggacctgcattttagctggtgttaaccagagtggagggaggattaggagtggcctttgggtggacaggaggtatgacaggctgcagatggtggagcaagccttgctgtgcccccgacccagctcgacatgcacacgtgggtggttctggctccctgggtgggaagaatggtggggtgggtgggcattgtgagcctggcaaccagaccccacggaatagcagggaggaggaggaaggaggacgccctccaagaaacagtggagtgaaaccttagtgcctacttcacagcccatctggggtctctccctgcttgcttctgggcagagggtgtccattataccacaagcacaaccttgaaatgtgctggagcaggaagtcgcgcaggacctcattccccaggactttccatacatgaggaatgcagggctgagcaggtgagatgcggcggtgggaggcatgccgcctgctccctctcctgattcactggggttttgggctgcaggcagtcagaaggtctcattttggggggttctcagcaatagatggggatacagtaggagggcaaagtcacagaaattctctgccggaactccaagacgcaggggctgggaaccgtctgcaggacccagacccagagttggaccaggattaaaggtggtggggggtgtggggtgccgaatgtgaagaacagaacggaagtgcaggaagacagcccgacctccaggagacaccatcactctcggtgtttccctccctgtgtttctttcttccaagaaagggtatttccaagaggacagattggttgaccaaaaggccattttatttctactttataaaaatagatgaaaggagacttgaaattattttgcctcttacatcactgggtttgggttctggaagtccctggagggtgcgcctgtagcccagacttcacaggtagacatggaggtcatgcaggtcacatggctggttgacacctgtaaagctatgatggccaagcagaactttgccgggtatctctggtcctattccctcccccgggtcatctgcctccctcctggaattgattgattaagtgctgtccctccatttcgtctaatagaccacgggaaggataggccaaacaagaagggcctacttcaacttacaagtcaagtcacggtttcagaacaccttatctccaacctctgtcctcaccacaagccagcccgacaatgtcctcatccgattttctcaaaagagtttgggcgatcttgagggcaaatcccattaaatatctgtacccagtctagcatccagagttgtcagcgttcgtgagcaaacagatctcagaggcatcagtgttcgtgagcaaacagatctcagaggcgtcagcattcgtgagcaaacagatctcattcttagtgagagtgcttctcctctggaagctcttgaggagacaccctccttacatcttccagctgcaggtgttaccggcaaaccgtggtgcgccttggctcacagccacatctctccaacctctgcctcctcggagtccttttctgtcacttagaaggacgctgtccctggattcggggcaatgctagggcaggatgatctcatctctgaccttacatctgcaacagccctttccaaataaggtcccatcctaagattctgggtggacatgaattttgaggagacaccattcgaacatatctttgtatctcttccttctcagggtgtgtcctaccccctcacagcttattctttttcccttcaaacactctgttgagacccttacacgaggcggtttccccagacaccgcacagatctctcctccctaacgagttccgcagactctctggaagtctggctggaaatgctgctctccctttttccttctgggatggaaaaacgctcccaatggctccaccagtcagtcagtgagacgttccaaaccggtctttccacttgggcttcctcatctgtttatcttttatttatacaagcctcaaaccactgaacactgcttggtaaacattccctcatttactatgcaaatgttagcacgggggcccacgcccgcccttccccaggaaagccactgagtgctgaatgcggatggactttcttcacattctttggggttttcggaaagggtatgtttttcctaacgtcacttcaaatgtatttcttaacaaaaacctcctaacctttggaaaatggaaaagaagttactcatctgaaaggaaactccaagtttttaggacctctaccaaacccctgagtgactgcggtcacctcgcctgccagcatgctaagaaggcattgtcttgccacagggctgggtttctgccagcgatttctgcaacatgttatgtctgggttatgtatttgaattcccggccaggattttctggtgggtctccctaccctccatgaaagagtccctgtgcagtgccagccctgcatcatggttcttgcaacgactgagcattctgcacgcctggaaatgtggagcagccgggaggatgaatggccgtcagcttctgagtccctcctcatctttacagtgcaatagtgagagtctttttctaggtcagtggtttgtaaaatggccagctttagagggaaccaccacccttctaagaattgtaactatataatcacatggcatttaaatatattaccaagaccaagggcatcagagggcatcagtttctcagctgggagtgacttcctcacactcctggattcccttggcaggaggcagatgaagagagctgctgaaaaagtgactttcctggtttgtgatctccacgggaaagaacatgcgacccgtctgagccttgaatgtcggaatgaagtgttttgctgctggtcacggctattctgggaagcacggctgtgggtctgtgagaccatagaagaggtccttaaaataatatgcacgcccgggagttgggagcgatgagcggctgtggggagccctcttctgcctgctgcttcctggtcctaccctaatgtgtatgtgggctgaccccaggccattcaacaagcacttattgagtacctactgtatgccagacatgggctgggccccaggaggaagtagtcttaggtcctgattcctccttttgtttttgttttgttttgtttttgttttcgagatagggcctggttctgctgcccaggctggagtgcagtgacctgaacaaggctcattgtagcttagacctcctgggcccaagtgatcctcctgcctcagcctcccgcatagctgggtctacaggcacacaccaccacgcctggcaaattttttcttttgtattgttttgtagagacaggggtctcactatgttgcccacgctgatctcaagctcttggtgtgaagtgatcctcctgcctcagcctcctaaagcactgggattacaggcgtgggtcaccgcgccaggccctgactcctccctttgtgctgcccatcacctatcagggcaggggagaccttcactcacattgtcacagaataaagggaccaatgacctcagagaagcgacagcgaagtgctgttttaggtgtcgggaagtgggatggcagtgggccgaggactgaagggcagcagggaggaatgagaatttgaattggcgctgagtgggatgagtgtttgaattggcactgattggaatgagtatttggattggcgctgaatgggtcaatattggttctccccttttgggttgatgctgatttgtggccctagcgtcccccaggcagggccccaattgtgttgcttgaacttggcctctgaccccaggctgacgtggaccctgggtttagctgctgctgctcgtgggtttagctgctgccgctcggctctgcttctgttgcattctggttctggtcatctgctcagtggctcagcccctctggggatggctcttgccatgtttagtcccagtgtcaggagtttctggtcctggagtcagccctgccactccctggaggaccttcccgaggccagctgcctaatccccagccccgatcccctgtctgtggccttgtgtcgttgtgatccacactgtcctgcccaccacgctgtcacctgcttgcctcaacgctggccagctactgctgaacacccttggaagccctgacctggcccaggctgagtgtcccctcccctgaccatttgtggggacagctcctccagcactggccggctctcgtcggggtccattgggggccacttctaggctagaccctcactgcctgcctgtctgtccctagagaccaccaatggcaaggagtccatctggccagtggtcccatggacagtggaccgtggacagtgacagcaggttggacagtgactgcggtggacatgacacagccctttcttgcagggaaggttgatttcagggtcactcttgcacttgatcttcctaaagaggaagcaaggaagccagcctctccaaagcgctgattgcatcctggggtctctgagcaagctggctcagttgccacctgtgggcatgcactattcttccacttgcagattagatgccaggacaagtgtcttccaaaggccacctagaaagcaaacgtcaatgaatctggggttagacctggctctgcaaggacccaaaggtcatggcagccctcttcctcctcgtcgtcctcagcggtcagcggcttctgatgtctctgttccccagtcgctgcatacttgtgcctcagagctgagcttcttatctaccctccactgacgctgcccactcgggaaggagcctcccttgctctgaagctgccactcaggtacggaggctggagggcgccataggggacagacagggtgggtaggggagtgctgcctgcctggcagattcacccaatgccagcatttctcatcacagcacctcagacaaggcagcctgacacttaacagccctcattatctgacctaaattcctgctgaaattgaggtcggcctcttctgattctgccccaagtgatctggaggcctcggtcggtcaccatgcccctgtgaggggacacaccctgtgcacggaaactgatggtgaccggggccacgttcgctggtgccctgccttgatgcccacttctagagaggcagagctctcagcacctacattgtcctgggggccgggcaggccgggacctggcgtgtggctggaagggtggagtgatagggcagtggaaatgcatcttgtgccctgtgctccggcgtccctgccctctgcatgggttcctgggtgaggccagctcccggccccagcctctccggagggcccaactgacccttctcccttcaggcttcagtgttggtgccacggaccctgttgtctgggcataattgggcgtgggattatgtttaacctacaggtgcacacctgtagtcccagctactcgggaggctgaggtgggaggattggtgcccaggaggtcgaggctgcagtgagcccagatcctgtcatgcactccagcctgagtgacagagagagaccctgtctaaagaaacaaacaaacaaaaaaaccagccaattactaaacaaacaaaaaagcagtgagggtcggacatggtggctcatgcctgtaatcccagcactttgggaggctgaggcgggaggattatgtttaacctgtttaacatcttcccctttagactctgtgtgagtcggcttgggctgggaacaaagcagtgcaaactgggagcttaaacaaccgacgttgattccctcacagttctggaggccggaaggtcaagatccaggtgtctggacagagccctcctggcctgtgctggtgtgggcggaggcggtggtccctggtgtgccctggctgcagccgcctcgctccccctccacctctgttgtctcatggtactcccttctccattcatttgcatccaaatgtctctctttttataaggacatattagatttagggcccaccctactccaatttgacctcattttaactacacctgcaaaaatcctgttcccaaatacagtcacattcaccagttcggaggggtaggacttcaacatatctttttgagggacacaatttagcccccaagagactttaaggcttttggaggccatgagcgggtcccactgaggccccaggctggcctgcagcaggcagggccggcaaatgtgtgtggaaggagtggggcagggcagaggccggctctcagataggcagctgaagaaaaacccggcacatccacggggagttcgtgctggtgtcttctctctctcttttcctctcctttcttatatgttgggttcttctcaaatgtgaattttctgtatcagcatccctcctgcctgcccataccctcctcccaccacccaagtctcacttcctgttttcggcctttcgcctgaactgcttcagaagttgaaaccccacagggctgggcctgcccctgcgaggcatgttttttttctggaaggaggaagcggcaacgggttacaggctggaggctgtccctgtgctcagatcccacacacgtccccagcaagccccagcccctgccctgcgggaagtggggtcttgaacactgccccgtggggctctctcaggggcaggtgaggcagcgtcttctcgcgccctcatttccctcaacttatctccagggcaaaatcctatgcagtggcacccagtggccggccctgactttgatcttgggtgctttcttctccacccaaaaggctctgaggtcatctctgtatcagaaaatcagcaagatctgcagcgggacagtggggactgatggccactgtcatcagcatcatggtgagcacttgagctgtggtttcctcaggacaaattggccttccccacgtgaactcgcggcaggcagagaatctaggttgggaccctggactgcacccggtgctgggctcctggccttttccctctccgccctgctaaggctgctgtgccgagccctgggaccatccaacagggagaaaggccttgggacaaaaatgacactttctcaacatcacccactgttgaggttacaagaagcagagagtgtgagaacgtttccaaatgaaagtgggggaaggatcgcaaagaagcaagttagttagggctgtgcccagccagcgccagtgccaacgccgagccgcctctgcaggggaaaccgaagcagatgtggtgagataatacatccaaccctgagtgctactctaacctgccagaggcggagggttctcagtgagatgaaagcattacagatgcgttagatctaagggaggggcctgcagatgcgcagctggcagagaaaccagggaggggctgaactgtcagtcgcgaccaccagggatctgaatcagttcaccgacagccttggggacattcaccttgggctccacaacctgtcagaaatgcccccaagcccaaaggcgtcgagagaatggccaggttgtttcagattgacacatatcctaatgtacaagtcagcccacacaccccacgtgcactgagcgtctcttgttgttcaccccaaataaactctgccggaactggggcgggactcgcaggggcggagaaggggggagacgggcagagggcagaagtggatggtgagaagagccaatggaggggccccgtgagagtgagcaaggctgcacccctaaccgacgtcctggggctactgtacaaacaaagaaccacaggctgggaggctgaacaacagacctgcactctctcgcagctcggaggctgcaggtctgaaatcgaggggctgacagcgctggtttcctctggaggctgcgagggagaaaccgtcccctgcctctcccaggctctggggtgagcccttcctggcatcccgggctcattgtagatggatcactccaatctccatggcttctcagggcttccctccatgcacctcaaatctctctctccttccttttgtaaggatgccagtcattggatttaggttcaccttaaatccaggatgatctcatctaaattacatctgcaaaaagaccctttttccaagtaagttgacattcacaggtacctggggttaggattggacatatcttttgcaggggtgcagggggctgccactgagcccgctgcacagggtgacctgggccaagggcccttcactttcacttcctcattggcaagctgccctgtgtttggactgggtcgaggctgtcaaccttgctgcccctcggagtcccccctggtgtcccccaaacagattctaagctgctttcctggggctggaggccaggcattgggattttttaaagagcttcccagcaggtgagcagcctttcatgggtatcaggagaccttcctggcaaatgtggtgaaggtccttcctcctgagcgatgccttagacccaggagcccagggaggctgctcacctgatcgttaggacaggagcagtggaaacctctggcctcagaccccctggaggaatccctccctctaagactctgggactggtgcacgcaaggagctatcgtgaacattgctcccaactggccgcttgcttgtcccccggctccccttggccccagtggcggctttgcctgaattagagggcgtgagagccacctgtgtctcagcactgcaattaaagcaggaagccctttcggaagcagccgtgtgcaccagcctcccatgggtggagcagagcaaaccacccacttctgccctctgcccttcttcccttttctcgacaccctgcggccccccagtttcagcagagtttatttggggtgaaaaacaagagatgctcagcgcctgtgggatgtgtgggctgactcgtacattaggatgtgtgtcaatctgaaataacctggccgttatatggatgccttggggcttggggggtttctggcagtctgtcgagcccgaggtgaatgtccccaaggctgctggtgaatcagatccctggcgttctccgttggcagttcagcccaacagtttctctgccggccgtgcctctgcaggtccctcctctgatctgattggattaatatttgaatcaatagactgagtcaagcagaatgtgggtgggcctcatgcaatcagctgaagccctgaaaagagcaaaagggctgccccttcccccgaggaggagagaacccctcctgccggacggcctccgaactggaacatcagctttttgctgcctttggacttgaactgaaacattacctctccctgggtcttgagtctgcctacgttggcacgggaactacacgttggctctcttgggccccagcttgctgactcaccttgcaggtggtggtggacttgtcagctccgtaactgtgtgagccaatttcaatttcttagaatcacaaatttctttctttcttttctttttttcttttgagacagagtttcgctttagttgcccaggctggagtgcaaaggtgtgatctcggcgcactgcaacctctgcctccaggttcaagcgattcccctgcctaagcctcctgagtagctgggactgcaggcgcccaacaccacacctggctaatttttgtatttttagtagagatgggtttttgccatgttggccagactggtctctaactcctgacctcaggtgatctgcccgcctcagcctcccaaagtgctgggattacaggcgtgcaccaacatgcccggcccacaaatttctttcttttcttttctttttttaaaatcagttttctgtttctctggagaatcctgacaaagagcgcatatctgagaattttaaaatcatttattggaactattgaatctgttgtattctgtttttacttttgaaaatccttgcggctgggggaatgtacaccttctctcttttcctcttaaacattaaagcctgattcgaggtagaggcaactcactgttgtgatgtccttttatcccaacctcagccccggcagaaagactccgcgccttgggacattggtgttttccaggagtgactgtgctggggcagctgcctgttgcgatgagggctggcggggaacgatcccctctgagtttggcgtcacttatttggaaccctccagcagaaagctttctaagatgccacactataaactcattcatgcagttattgcgtttcagttcagattctattgctcttgcttcattatttcaaagccacatgatgatatccattactgggtgcagaatggccctgatgggtctagaagcaccgtggtctgacccgtcctaagagatgatccagtcacgaaatgctggtgcaggtgtggatcgagccagttatcttcactatctggaaacaagaccctgaagtccaggtggccaaggactgcaccagatctctttctttttttttctttttttttttttgaggcggagtctcgctctgtcaccctgactggagtacagtggcatgatcttggctcactgcaacctccgactccctggttcaagcgattctcctgcctcagcctcccgagtagctgggattacaggcatgcacccccatgcccagattttgtatttttagtggagagggggtttcaccatgttggccaggagggcctcgatctgctgaccttgtgatctggccgcctcagcctcccaaagtgttgggatttcaggagtgagccactgcactcagcctgcaccaacttttacagacaggctggagtcctgtctagaagtcaggacaccaggcctggctggcaccctattctccagaccacgctgccctccgcagccaggtcccaggacccagacataggtggatttttgtttctgacttgcattcgctcttttacatgaaccgtgaattctttgtcctaacgttattgttagggcgacagcattcctgatcgtggtgctaatgcggttatcaataggctccaaagcttatccttgatgctcacgatctcagagttggaagaggccctggcaagcacccaggccagtcttctctggtaagtgccctatgcccttaaaaccacctcaggatttcaaggacagagacaaattaaaaatagaggcttaattctcctgattgaaaagaagggaagagatttttctctcctttttctctgagcattactctttatttatttatttattttttgagacggagtctcgctctgtcgcccaggctggagtgcggtggcgcaatctcggctcactgcaacctccacctcctgggttcaagcaattctcctgcctcagccttccgagtagctaggattacaggtgtgtgtcactatgcttggctaatcttttttgtatttttagtagaggcagggtttcaccatgttgaccaggctggtcttgaactcctgacctcaggcgatctgcccagctcagcctcccaaactgtctcctggcctctctggtttcctagggaggccaaaagcctaacttagttgatcttgctccaagctgcaaaaccacctcctgtcatgaagataggagttcattcttcttctagatacagacaattaacaaacacagatggtaaccccagtgaccaggtggttctggggtcaacggtgtgtgacaaatggcactgtcagggcctcttccttaaggactagttattgtttatgttgaaaacacgcatgcagttagttgtacctgtttgagtctttaaaaggataagatcctttctttgcagtctcttagccattgcttgtgatgcatatcatcttctggcttaacggttattcaataatgaaacttttctttcttttccacctttgtggagaggtttcctgggtttagagcacacgtcttttttctttctttttttttttttttgagatggagtctcgctctgtcctccaggctggagtgcagtggcgcgatcttggctcactgcaacctccgcctcctgggttcaagcaattctctgcctcagcctcccaagtagctgagattataggcatgtgccaccacacctggctaatttttgtatttttagtagagatggagtttcaccatcttggccaggctggtcttgaactcctgacttcgtgatccaccccccacccctcccaaagtgctgggattacaggcatgagccattgtgcctggccagcacattttatttttaattatatttccccagtaatggccttacctacatttaatgacaataagtgatggatacttaaaatacactctagttctagaaggcattcccatacattaattaatttggttttcataaaatcaggaggcattaaaacaccattaaattagaaggcatcactattcccttttggtaatttctcatttaggaaaccgaggcactgaatggataaatgccacccaggggaccctgtccagccgttggcagaacgaggactggactgagggtatttggctcctaatccagggctttccccaggttccactgtgaggcatgcagggtctgaaaacacaccggcacgtgcgtgtccactgcccccctggccttagctatgcctttgctgtgttacggaagcacctctgaaggcctgggcgcctcttctgggagtttctcgtgtctcttcgccttccgatctgctctggccttgccacgagaaagcgacaggcccatgctgctccttggggcctggagacaatgtcccaaccccaggccgcaccctcgctttccatccaacccggcaactgctgcccgtggagggccacagtctccgaagtggaatgtggaaaaggaaaagtcattcgggctgtgataagaaagccgagcttcttcaaaggtaaacagaaacagagacaaagacgagggcacgtgtctgtgtgagtgagggagagagagatgggggaggggagcaaaacagaggcggcccggagaactctccagaagggtccgaaggctgccacatggaggagtggcactcactgtccagtgtgagggtggaccaggcttctcggatgtggtcgttccagcaggaaggccaaccgtgattccatatcgtgaggaattttcaggcagagccatctgtccacaaaaggggccatcccactggattcgtgtcctggtgttcaggaggacacggtcccgtcctcaaggtcgtgtgagcacctgagtcacccggatgccggggggcctatcctccagtgcctgagtgagagaggggtgaggctgggagcctgcattttctatatgttccctccccatgcaggtggtccccacacacaccccgagaaacagggtgttaagtcaccgccgctgtcagagagccacctggatgggctggatgctgggctggatgactcaaggtctcttccaagtccaaaccattttttggttgcatgactctcctccctagctcgtcctcacattctccatcacaaccagctttccctgaaaataaacccagctggccaccccttggagatgagggcttctcccaccctgcctctttctgcctgcacctgcccggcagccgttaccatgcatgcccatatacatatgagtgaatatgtgtacatgtgttagtgtgggcatgtgtgaatgagcatgcatgagtgatgtggcatatgagtttgtgtttgtaagtgtgtgtaagtgtgaacgtgtgtcagtatgtgtgtggacttgtgtgagtgtgtctgtatgtgtcggtgcacatgtgagtgtggatgtgtctgtgtttatgcccagtgtgagcgcatgtatgtgagtgtgagtgggtgtgaatgcctgggcatgtgtgccctgaaagccagcatggcacaccagtggcctccattgtctctccagcccttggatgctgtgtgggggatgctggcctttctgcacagaggccctgagcgaatttggggctctctgctggatggactgtggaagacacaccccggcattgttggacaccaagtgctggagaattctctccctggtgggttacagtatggggttgtttttctcctcagagtgtttacatggacagggcaaatgtgaaaaatccctccggccatcatgcaggaaaatatgtataaaggataactggagaaaaatgccttccatggacaaaacacagacagaaacacacacacacacacacacacacacacacacacacacaaacagcaggggtatctttcattgtgcctcaataaaacagaggttgaaggagacaccaagctagaaacagactgttaattttgggatttttttctttaatcattttaatataaagagacagcatgttacaatgacattttatggatgattataaattattatgaagtcctcaactggtaaaatgtcttgattttgttcccctgtcttggggtctgtggttaaatcatgacagaccagcagtggagtggagtgtgaagaactgcggcttgaggcttagacaagcctgggtttaatctcttgtttactggctgtgtggcctttctgaacctgttttctcacctatataatagggacaaaggacctatttcatagggcaatcgtgaagatgagagacaacagtgcaccagacgaattttgagttttaacctgtaatattatccctgatttaccttgatattttatagacattcatacattatagtagcaaacattttgagatgatatatacaagataatacaaattcatcttgcattttaaaatgttcagatttacttaaatcataatactttttattcttttagtgttaataaaatttcacttccttgagtattatataatagctttaacatttattcttttcgtatgaaaacgttttttaatgagccaattctgtgtgaagcttttggttttctataaaagctgctgtgttccaaggacacccgttgtacgcagcccctttgctgtgagatcatttccagcctcctttttgtattcttgtcatggcatctgacatttagtcattagccaagcaaatgcagcagttcatcatctcagagattaatctacagagaataaaagaggtagcaacgttggtgcgggagttaggcgagaaggtcccttctggaggaatcgttttgtatctagaacaccagggaattatgctcccgaaccatgcagccaacgtgaatctttgttaattcatctgaatgtttcctcagtaaaatcaacaagatcttcttcatccaatgttaaaaattgggcttcagcagtcaacactaagaagtgagaggcaatcaacggtgcagtatgaaaacatcatgagctagaaagaacttaacatgagatttagaaatctacttcacatataccatgatgactactgaaataaaacattaatcacctgtattcttatcactcctcaaaatgttttcttcctgtcccagggccctttctggagttttctccatgcttatataactgtacagagttgtcactttcatggagatgaaattgcatgcgttgctgttttgacttcacattgttaagtatttgtttgtgctactaaaacttcatggtgagcatttcaacgcccgtgtaatgctgcatccagatgctctgtaataattactctcccactctcctgtggctgtccaattatgtaatttcccactttaagtcataataggtaatgcacatccctgtgaccacagcttcgtgctctcagcccaagctccgggaggagaggactgggtcaaagcacctggacatttttgtgacttttgaagtgcattgtggaaccgtgtgaaggacgcttttctgaacgtgatgttccactttgatttgatgctgttttcttctgccagttcagaacgatagggtaagagaatactccgtgttgatggagagactcagatatgagtctcaaatgtgttttctgcgtaacaacgagatgggatccagcgatgcggtctgggcttttgggtactcacctttcctaaaagatgccatctgcttggagcagaataggctgtgacacgcaggagcccccagggaaacggccatggcaatggtgggtgttaacgagcaggcataagggactgctcccagcggtgcttcctctgaagtcattgccacctgcagcagcacaggggacagaaaggccgtttctccaggtccaggcagctcaggcccctatgagccctggcgtagcagagacccaggcttcttggtagaggcccagagccctgtactgccaccactgccggacgatgctcaggacctcggggctggcactgctggctctggtcagtgctgtgggcccaagccaggccagcggcttcacaggtgaggggtctgggcttggcatgggcagttcttaaggacaggggcttcctggcatgggtctcatgaggacagccccctgtggagacctgggcaggcaaggacgcctctgcttggagaggcgacatctgttcttttgtggacaagctttttggtaagcgcacatggtagcagctgtggaggtggggcaggagtgccgggtagggttttgggaagaggactcccccagtgggaacctgttgctgaatcacctgggcgttcgtgggggtaaaatgcagattcttagccagcaggtctggggtgcagggcctggaactctacatgtctgtgggtgatgcagatgctgtgggtcctcagatcccactgagaacagtgagctcctacagacgcagaagaaaggtctcctgaaccttggtgcattcaagtcctcacttacagatttaaaaaaaaaaggagacctagcctgggcaacatcatgagaccccatgtgtaccaaaaaaaaaaaaaaattagccagccatggtggtgcacacttgtggtcccagctacacaggaggctgggatgggaggatcacttgagcttgggaggtccaggctgcagtgagctaagattgctccactgcactgcagcctgggcggcagagcaaaagcccccaaacaaacaaacaaacaaacaaaaaaagccacaatacaaaaacaaaaaagaaagggagacccagaatggatcagggacttgcccaggccacacagctcacagggcagagtcaccacaggagccagaggctgcaccagggctctgtccggagttttcccaggcatgcggagagcagggcagcttcttaaaaacacacgggagttctgaaaccccagaatccagggaaatgggactgcggaattttaaaatcattttcctcttaaaatctgtcatattcagttacaaatttaaaggaatccattctgtttctaaaatcaactatgtttttgtactactttaacgtttttcacccagaagcaggattttgctttgtgatttgtgaaatggattttcccattggaacaggtaatgtgtagaccccacagttcagatgcataatgggtgggtatcctgggaagctggagaaggtcttaggaggtgtttccagaacccctcattgtatatgaggacacggggcagaacctcagcaaccccacacgtggtcgccccgaattttccctgtgtgccagcactgccttcacaggcatgaccccacttcagccttttgcagccacaggacatggctgttatttcacagatgacaagagaggggcactgggagggcatgacatgggcgcaatcatgcaacaggggtttgtgagcctgggtgtgagcacaggtccatctgaccccaggactcttgttggccccagagcattaggctttcccatctctgagaccggaatccaagacccccggctcctgctctgatggcccttgtgggtctttgcgggatggcaggatctgctaactgctttcttctctgggcttggccaagaagccaggcttgggatggcacgtgacctcggataaaatgttaaaaacaaaacagggcaaacatctcccgggttccacaggagatgagtgtgtgtgtgtgtgcgcgcgcgcgtgtgtgtgtgtgcgtgtgcgcatgtgtgcaggacggctctgctgcggaccagctggggccatgtaacgatcaggtggggccctggcacctctctagagaccaggagctgtaagtgtccttaatgtggttggcatctctgctcaggttacgatgaaaaacgcaagctagatccactctgctaagttcttggtgcaggaagtcctcggcctttgcctagctcggcgtggtcactgagtaggtgagcgcgttccttccggccatattccaccgttcttcatgcaagtcacctctaggctctcagccaagctgccctggtcccggaagctgatttgtcctgttccaccccgtacgatgaggacctcccgttcctttgcagagctcacagtaactaccccactggtgatgccaagcagcaggtggtccccatccccagaggccctgctgggcccgcagggtgatttggggttcagcccccagaggaagttgcagctccagtccctgttgcttgtggagtggggtcgctgtgcagcaagtgtgtggtccagcacctgtgttctgcccagagcaaatctgcagcctcttccctcaccgtgtttgagggctggctctgccctatttcttcctggggtgagtaacaagcccctggagtcctgctttctgcacacttgtaggttgctgcgaggtccaaggagggaatcttcagagatgctgccccagtggagcgaataaggacagcagtggttttgtgatcatttctgctcccatctctgtgttcctccccagaaatcaatccagctactcattgagggaaatcaactgtaatactgagcccccacctcttgggggtacagtctagtaaagcttagagctcaggggttgagtgtctgaaatgcaagcactgtatgtcaaatcctccgttcatcctgcactgagagtccatgtactcagggccccctgctaggtgccacgggggagctggaggggacccttcaccatccctgtgtgcactggctagggctgctgtaacaaagaaacacagcctgcgtggcttaaacagcagaaatggattcggtcacaggtctggaggccggaagtctaagatgaagttgcgggcagggctggctcctcccgagcccctgcaggagtctctgctccgggcctccagcttctggagctgctggcaatctttggtgttccttgacaggtagaagcatcaccctggtctctaccttctccctgtgtgcctgtctgtctccacatttccctttagtataagggccagtcatattgtattagggcccaccctaatgtctccactttaacttgataccctctgtaagacattactgcagataaggtcatattctgagttactggggtttaggactttaacacactaatttttggaggaacacaatcaattcaaactaggcagtaggggctcccggggagatgggaagcccaggcaccacgtcaggggatgtccatgaccaaagagtctcgtggtgaatgtcatggggccaggggtctcgagaacggagtaatcacgttgatggaggggcgatgggccttgtgtaaaggaaccaggctccagtgagagatatgtggggcccaatagggtaaacctgatgcttgtcctgcagcgggggtgactgtgcctcctcctgatcacagtggtaacggctgaaaagttgaactggtcttttttttgagatggagtctcgctctgtcacctaggctggagtgcagtgacatgatctgggctcactgcaacctccgcctcctgggttcaagcaattctcctgcctcagcctcctgagtagctgggattacaggcaccagccaccacaattttttattttattttttatttttgttttttttttcagagggagtcttcactctgtcacccagggtggagtgcagtggcgcaatcttggctcactgcaacctccgcctcctgggttcacgccattctgcctcagcctcccaagtagctgggactacaggcgcccaccgccactcccggctaattttttgtatttttagtagagaggggctttcaccatgttagccagggtggtctcgatctcctgacctcgtgatccgcccaccttggcctcccaaagtgctgggattgattacaggcatgagccaccgcgcccagcccacacccggctaatttttaaaaaatatttttgctggagatggggggggggtttcaccatgttggccgggctggtctcgaactcctgagcttgagtgatccacctgcctcggcctcccaaagtgctgggattacaggtgtgagccaccacgcccggcctgagctggtcttttatcatcaacaaacttctcacacacttgccacagagcgaccgcactccacaggtgctttaagtacctgcttacttatcttccacctcattgaaaagaaagccgtcattgtcatgtcctggccacagcaggccttcagtttgcactgtggagggaactgctgcacattcacttcccatgtggcaaccttgaggctcagggggactaagagatagatgtgcacgagattctacggcctgtggaatcagctcacatggagcagaacaaagggacgtgatctctaagcattgattccagcgctgtgctctctccttcgtatatggaccgtgagaaccctgtgcttcaggaagcatgcgtggggcccaggtggcacctcctcctcggtcacagcggctttcttagcaggccaggctacgtttatgctttattcttctgtgctcactcatgcaacagccttcctggtgcactagcaggcaaaggccagtggagagggctggtgggcagcttctgagaggcctgcgcgagtgcgggaggtgtgctctcacttgctattgcagagggacgccttgcggataaccgctcgcacggatctgatcctggtgttctcagtcgccttcttgcttggcctctttcagaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcgtgagtccagggctgctgggctggggcggggccacccttgccgtcgagacgcctgatgggacagtcaccgttggcatccattggccccgaacttgctagatcttccaggagcacggctcccagccttgaccaggcagcaggtcatcggcagggctttccctggccccactcctaggtttctgagtccgtgggtgggggtgaagtacaagaatttgccctcctgacaagttcctgggtgacgctgacgctgctggcccagggaccccactttgagaacctctgctgttctcagagggctcctggatggctttaaaaatgcagatgcctgggtctcttcctgagagagtgtgagggaattggcccggggcgttgagagagtgtcggaagttttcaaagctcccagagtgattctcatataccactgagtgtgagagccagcactgaactctcttctacagcagccttttctttctaaaagctgcagtgaaatgctttcgtagccaaaatcctattctgaactccaatacgtgaaagagctggaaggagccccgagcctaccaccctaagtgctcagaggcccccaagtcctcccagttcctcagtgcagtttggaagctgctttcctgtaggatgcttggggccagttaccagggtgacctgtgtggttatgccaggccagggtctgagccgttgggatagggcagggactcagggctcagcctactgacacacaggtgatctcttccaggggaggggtgtgtgtgtgtgtgtgtgtgtgtgtgtgtgtgtgtgtgtgtgtgtgtgtgtgtgtgtgtgtgtggtggctgctaattttgagtcaataccagatctgcaatgagtttctgtacagtcagaaggtcctgccttgcacccccactgtggagggatgtgggggtgtgtggctccagcttggtgttggccagggtcactgagacataagggctgtgacctccagagtgcagaagccaccagctcctgggtgccacgaaggggatcctgcaggacccatccttgtggcctgagactgttgtacccaggcgagttagagaaaacgccatactttgagacgaattaagagtcttttattagccggcgaccgagagacggctaacgctaaaaattctctcagccccgaagaaggggctagattttcttttatactttggtttagaaagaggagtgggggtctagttaaaacaattttacagaaataaagtaggcaaaaagttaaaaagataaatggttacagaaaagtaaacagttccaggtgcaggggctttaagactattacaaggtgatagacacgaggctttgggcgttatcaatcagacgaattcctgggaactgcggatatagctcgccacagtatcttatcagttaactgcattcttggatgtgctgggagtcagcttgcacaagttaagtccttgaggaaggggctgccagtgaaagaggcaagatggagtctgtctggctctcttagctaagggagagtccattcaggtggaaacaagcctaaaaacagggttagtaaaaacaaggttgggcattacaagaccaggacaacagcagaatggagcgtggactccgcaaaccagggtgtctgcctcctccagaaaccaagggccccagattgtagagtctggggtctgcatagacctgcaggctgggccatcctgagtgggccctccctcagcccccagtgctatttcactgatgacagggagagttgatgcgtttctgttgccccgttcagagggccaggcagagagagggcctgatggtttcgggtgtgctgttaacaggcatgttcctctttcaggagtgttaaaacaataccaccataaccaacacctccatcaccaacagaaaccaggcagggccagctgaccccagagcaacacctccatcaccaatagaaaccaggcggggccagctgaccccagagcaacacctccatcaccaatagaaaccaggcggggccagctgaccccagagcaacacctccatcaccaacagaaaccaggcggggccagctgaccccagagcaacacctccatcaccaacagaaaccaggccgggccagctgaccccagagcaacacctccatcaccaacagaaaccaggcggggccagctgaccccagagcaacacctccatcaccaacagaaaccaggcggggccagctgaccccagagcaacacctccatcaccaacagaagccaggtggggccagctgaccccagagcaacacctccatcaccaacagaaaccaggcggggccagctgaccccagagcaacacctccatcaccaatagaaaccaggcggggccagctgaccccagagcaacacctccatcaccaacagaaaccaggcggggccagctgaccccagagcaacacctccatcaccaacagaaaccaggcggggccagctgaccccagagcaacacctccatcaccaacagaaaccaggcagggccagctgaccccagagcaatggcccttctgtactctcattggttccctagagggccactggcaggacaagcctatgccttggccatgctgctcaggtgctggtctaaggagacccttcctgtcctgatgcctggccccatttccactttcttcgagggccacacacacagaggggcctgctgagctacagttgctgctgtgcaacaactccactcctaggggatagcggggggccattaggacacaggtgctggtgccacggcaactcggtttagagcatgtgggctttgcagtcaggacatgccctatcctgtccagtcttacctgtgaaggccacacctcttcctacctgttggcattgtcaggactagtgaggggaggaggccctgggggaggctgatcagcagccccttcctgctcccgctctgcagggccacaccagccccacccatgcccaccatcaccttctgtaagagaccctggcctgctgcagcaaacaagttaattccctcccagaagatagggaggcctctccccaccacctgccctgcatcctccttcacagaccagcctccaggaagcgcctcttgttggaatcagccccacttttagagtgttaacacctttaattagggactcaccagggcgatgcccttgcagtcagggagtcccgtgggtgagagtgggctgccctggggagctgcagggagtggagagtgaggccacagggagggacgtgaggcatgaggggaggtggactcaacctgtgggccctgagcccctcagtaatggcccctcaggttctagaaggctcactctggcacagtgaagagggggcagatctagaaggaggaaggaagagaagagggagggaaacaggcactgcctgagtgcattctttctaagaggccagggcaggagaccctccaatccctcgggcaccaaaggaatgagtatccctggctctgcatgtggggatccaggctaggggaggcccgcgcctccaccaccatggcacagttccaggaaggcaggctggggatgtggaccggggctctctgacccccaggcagatttttgggggtttaccaagctgcactttagtataagggagtttgtggcatttgagtgctgtggctgtggcgactgtgggaggaggaacatttcagggcactgaggacacggagttctttctcagaaaggtccctgcctgtgccggggcctggtgaagggcacagcccacgaggcttctgcaactcctgccgctggagggcctgtatcccatttcttcccagccccacggtcagagacaccatgctggtggtgtgaaggcgcctgtggtgggcggatttacaccccggattttggcagcgcgaacttctccatgcttgcacagctcttttgatcaaagccgcctttttctgggatgccacacagcaggttggctccttggagctggatgtgagatggtttcagtaagtgacctgttgagcaccgtgactctgatttgtacagaacgaagcagggcccgaagctggacctggcagatgttggaggcccctggaaatactgggaagcgtgaagggcaggagatgctccttcctctgtggcggggcctccaggtcacccgagtgtgggtgactcacacctcagctacccgggggtctgcgcctcggagtcctatcccccagacagtggtaaaatgccagacatgtttcctcctttctcctcccactcaataatgacttatgcaaaaaagggaacggaagcatggacacacacgtgatatgactttcagtgactttttcaactttttcagtccagcatttggaatgcgatgacaactggtgcattattttaagtttttaaaaatataattacagaaatgaacacacgagccatacagaaaatttggaaacacagaaaagaacaggaggaggaaacgatcccaagcctgctgctcacgaataaccacctttcacatgttctttatccagggcagacatttcacaagaggatggccactgtgtccaagacatttgtagcacgattttaccactcagcaatgtatccacagcagctttcatgcctgtgaacatgactccactgcatgcttttacggccacatggcattacctcatacgcacatcagcattcattgagcaagctcttgccacttaactgtcagttgtttccaattactcattatcatacataatgctgtgatgaacatcataccgtacaaacacgactgtgcacaagttggattatgcgctgaggatgaattctgagaagtggaacccagcatcttagctgtgctctgttaactccagtgacaccccagctctgcacaggatcaacctcctggcaaactcagcctcgttaggcaagtccaggacccccagaggaccaggagactccccaaaacttcctgtccccgcatgctgatgaccaggggccctttggtgagaacctcctgtcccgaccaggcgaagaggccccgaggaaggaggagggagacaggagcgactcctcctcagcccacccagtcctcagccctgggagccttgggttttgttgctcaaacacaaagctcccctgttgcctcactggaccatgactagcagtgttgccaggagctgagcagttctgttttattgtttgcattgagttagggacgaaggagatttgtgactttctaccaagttggacttgttcagcgttctcagggcactcagtcagctggccagctccaagggatggaggggcttcccggcagtagccagttaagatgcaaacctttcacttaaaaacacgcctctggtgattaggcaactatttttagaagccagttttggggggattgtttctatttaaataggcttttagtttagaatagttttagatttgcagggaagttgcaaagataatgcagaaaggtcctgtaccccccaacccagcttcccctaacgttagcatcttacagctctcgggactacttgtcctaaggaactgacactgggcattgtcgggaaactccatagtttatttggattcccctgttttcccctgaatgtctttttctgtcccaggagcccaccttccatttagtccgcatgtctgcttaaccctgaggcctttgctttttgcactgggagacaaagcagagaccttcggattctcagcaagcctccaccaggctcctggcgttgccctcctcgagctgcacccaacgttcatttttcatgcacggccatcggtagagctgcctggatgatgaggagatgaagagtgagtcagggacaacgcaggaaagagagtgcggctgagaggaatgcccacagcaaggccgggcgccaggcagacagggctgggtgaggagagcggggatgcaggctctctgcatattccgtgactctggctgcccctgctctggccagctgagcagtgtccttggtgatgtggtcccagcagaagccagggccgccacctctttcttcgttgcagagtgctctgcagagaacttgggggacccgagaaggccagtccctgggactgcagcctgctgaggctgcccttccgcttggccaatcccacgagttttccccaccctcgcgggggtgagtccaggacccagttaccagctggcctcctctagtcttctgggctctgagaggtcttgagctgtgctcctaaacatccccgggccatagacacacaaagcttgccatgtatctgggcatgaactggacagctctgagtaaagccccaggggggcatggcacccaccgtcagggtggctggctatggaggccacagagctgggcaagccttctctggggcccagcactggggtccctcctccctctgtgtcctcctcatggctgccctcagcctcgtcccggagctcccatcttctcagcttccttccgtcctgggagatggggtcatctcctgccctgggcccacctctgccgtcttggcaaaggcacactgcaggctctgcggcatcgggcacacgctctgctgtctcctgacccctggggttcggtttcttctccttgccctcctcttgtgcttcttggagccctgagcatcagcctccggactcctgacagcttccctttgggtggattctcagactcctgcagtgctttctgagacctctataagcccctttttctggaaagcccaccgtggcctccccctgcagccttggctgaggtctggtccccaggaccagcacacctcccatggggaccccaccgggttggcctcttgccttcctcatctttgcctcctgcagaggctggccgcgtttctgtgtctagagctgcatcggagctgcactcacactgtgaagggctggggagctgtgcagccaacagccagcgggctggcctcaggggccacctccagtgccactctgccatgcgtctccacatgggcgagcagtggacatgtccgacttcacatttgcactgccacactcctggtctacaccaggccgttcttcccgcagctttccccagctcaggaatgaagccccagggatgccagacccgaagcctgggagccttcctgaagcttcttcttctcttacaccccatcccgtctgtcagcacatcctgtggacgcccccacctgatctccccagggacccatgctgcactcacctgcactgtcacctaggtcggcccccaccacaccccacaccaggcctgtacctcgccttgtgggcgccagggctgatgtctgcagagctgctccgagctcccctctgcccagcctaggcatgagcccctctccagagtgtccttccaatcccccacactgcttcattccctgaggctctcaccccatctgaatatctgtagatctccttgcactattgttcccccactggaatataagttccctgaaggctgggccctgggcacccggcattgtgcccggcacatagcaggtgctcaacaaatattgaatgaatgaatgaatgaatgaatgagctatcaggacttgaagcagcaaggggccctttcagggggtggtggagccccctggacctggacttctgaggcctagaggaaacagagacacctaggaccccagctgaagctgccctggaaggacagatgggcagaggatatgaaaaccaaagccaatggccctccaatggggtgggtgtctgcccaggcatggggatgggccccgaacaggccacagacctacaggcagaattcagcaccaggaagcaccgacgtgaggtccccgtgcagcaaatcaggtttgtcttttatcgccagtatcattaattgtatcattttctcccagccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaaggtaggctgctgcgggccatgcttatggacaggcagcaaaggcgggtctcggtgaggcctgatctgtgtgaaggtgtgggggggagtgtgtttctaggagcagtgaccgatttcatcaggagcccccaccgtgtgcacaggcagcacctgctcttagataatttcttagtcaaaatctggccactgaactctcgggggagaaatctcatggcgctcttaggggccctgaaatgggaagacacttctggtggagcagagacccggatttcccagtttgcctggagaggccaggagctccaggtagattagttgcaggtgtggagctggctgtgcctgcagtgccacaggggcctgacgagcgccacagcacccgtaggcaggccctgccacctcagatatgcgcctgctggtctggaaagttctcttttgattggggtctgcatccaggagaatgggagaatgggatggcctatacatatatatatatgtataatgttacatattatttaatatttaaaatattatatattatagcgttagtatggtatgcagtaataaagcaatagtatacataatatcagatattatgataatactatatcattatactacatgctattatatagtatatatcatattacatatgattatactatccaatatttgtagtatcaataaaataatgacaaagtataaagtaattttctatatcaacatactatgacagtataatgaggctgataggctctatttacctcctaagcagatctcttcaagggaaggcctgctgctgtgggtcccaggcccagctcacctctgagcagggatcggtggtcttcagggacattaggatggagaggagcgaggggcgggcagtgaggacatcccccgtctcctgtggtagatgtctttttgcagggaggtaaatgcagagcagggcctctcatggcctctggttccctctcctgccccctctcccaccccagcagcttttgtgacttcaacctgtcctgggtccataatcatcagtgttttcccttgtgtagctccagagagggaccctgtgggctcctggtacaacgtcaccatactggtgaaaatggacttcaaggaactccagcaagtggaccccaggctcctgaaccacatgcgccttctgcattccttggtaggtgagacagacgggggctgcctgcaccctccttgtggcagctgctcaggcagacccaggtatggggccgtggaagggacctgggggttggggagggtgatgttccccaaatggccccaaatgactgactctgaacgaaattctagttcttaaaaaatcagcttcaaagaggtatgatttacatgcaacaaaatgcacacaactgaagcgtgtagttggctgagttgttatgtgtgtaccctcataggcccgcctgtcgtggtggagaacgcggatccctaagcttgcaggggtctgcagtcccagcaaagacagcctaagccccgagctcttccctcaccaccctcagtcccaatttcttcaagttctggctcctgcttcgtggaagccagcaccaacctgggagtgctgagatgggaaccgtagcccagggctggagagcaccctggggtctgatggttagcagcgcccctggcctctccacacaagtcagaagcacaccccagggtggcatccaaaactgtctccagacgtcgcccactgtcccctggggataaaaacaaacaccctggctgacccttgctgatgacacaggtcatgctttctggcccatcagcagtgattaccaaccaggatgtcttctccagctcaggccaccatcagtctcgggaatcccagtgtggacagggcgctgcgtgtccccaaggctgccgcgtgtccccaaggccgccctccctgggggatggtctggcttcaggaccggctgctgacaggggcttgtgctcagaggggcctcagcttggtctaatgtgctgctgttgcctctggaaatgccgaacacttttcagacaaggggccccgcattttcctttggcatctgtgtagctgttctgtgcttcagatcttttgtgtgtcccatatgtccctgggtgtcttggtgtcaaacccagggttgggtcactccttggccgttagactaagctggctggcagcccagatcagatggtgcacacctcatgttgttctgggctgctggccagtgagctgctagacaggtagtctgcagcctcggccttaacagcccgggctaggagtgattcctgtttcctcttagcttgttaaggggactgcccaattggccagtaagaaactagctctgaagccacactgcctggccctagtgttgccactcatcagctgtgtgaccttgggtaagtcacttaacctctctgtgcctgagatacctcctccattaaacataaataatcggccaggagtggtggctcaagcttgtaatcccagcactttgggaggccgaggcaggcggatcacttgaggtcaggagttaaagaccagcctggccaacatggcgaaaccctgtctctactagaaatccagtaattagccaggcgtggtggcacgtgcctgtaatcccagctactggggaggctgaggcaggagaattgcttgaactcaggaggcggaggttgcagtgagctgagatcgtgccactgcactccagcctgggctacagagcgagactcttgtctctaaataaataaaaagtaaataaatagaaataatcataaccctgcctgagacagggccatgagcttaaatcatacatgtaaagagcttgagatggttcctgagcttcctgatgcgtgtggggcctgagatgttgtggttgttgtgttttcaatattgctgcgtgacacctgctgtctcctcgtgcatgtaggtttcatgtctccaaccagcccattaccccctgcagaagcgcctgccttgcacaggggtcaggcaccagcaggggctggtctctgaggcctgcttctgctgctgaataaggggttccgatgaggtcggggctggttcccagttctgtatgctaaattatgagctgcatctcctcccaggaaggggcttcaagtgtgtatcggaggactcctgctctccccaaacctcctttggagttcccagtggaggcttgggggtttgctggcaaagtttgttctggtgaccactggtctggctgtgcagctgccagttcacctggcttcccaagggttgagatttcaagatattaagctgaaataaaaatactgcatatgaaatgaggaaagtgatcattaaacctcagaaaaataattggatgtgtacaacaggagaccgtggcttttgatctctaattgtctaattctagttctaattctctgttgtcagctgcaagagacctgcagtcttggcaagggcagaagaccgagggtcctgggtctggctgctgtattagtgtcctggggccactgtaaccaaggaccacagactgggggcttcaaacaacagaaacttattctgtcacagttctgggggctgaagagtctgaaatcaaggtgtcggcagggctggttcctcctgaggcccccaggcctctctccttggcctgcagacggctgtcttctctgtctcttcacactgtcttcccccattcatgtctgtttctgtgtccaaatttcccctttttgtgagggcaccagccatattggattagaacccaccttcactaattatatctgcagtaaccctatttccaaataaggtcacattctgaggtactggaggttaggacttcaacatatggattttaggggacagaattcagcttatcacaactggtactgaaaggtactgatagttccggtttgtaggacttctattgggatagtgatggatagataagtactgtagaggttctttgctgaagagcagaatggtacgtgtgtgtggacagttcatttcagctctgcgggcctcagtctcctcgtctgtctgacggggtgtccttctgctgtgtgacactctgattctgccttcacaggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaaggttgggcttccctcaatcctccctctggggaggctgcagggtggtgcctgaacagccaaaatgcaaggtggacgctaaagccagaccagtcctttgtcttttaaaggaggtttaagttcaggagcaaaagaataactggttcaagtgtgttcatcccacaggtgtgggacccatcttcagctcaccctgtaaattccaagtccccaagtgcagacctctagaacttattttgccccccatttcccgcccctctcctcttccctccatctctcctcggatccctctggcctcctgccccctcggcaggcttctccttccatcctagtggacactggagtgcaaatcccagagccacacacaaagaacttgtttcttcatttctttggtttcctaaatttccctctcgcctctttcccacccttgccaaggacatccttgtactccaaaggctccttcagcacaatttgtctaaagttgaatttgtatctggcaaagcacatagacgtggccttgtttctggaagaaattacctattctttgttgttgttgttctatgtcaggaattggcaagcctcatctaaaagggatcagatagtaaatatttttggctttgcgggcccacgtggtctctgtctcaacgactcagccctgctgttgtagtagtcacagacagtccgcaagcaaacccctgggctcccgtacggcttcctgtacccaagcaggaggcagccaggctagtctgctgctcccagggctttgcaggagggtggctgccttggtgaagcctcttctatgacactgaggaggcacgtgacaatgccagggctcagagccgtgtgaaagctctagtgattgcattgatctcccttcagatccgcacatgttctgcagaaccaagctgcattgctctagtgccattaagcaaagtgctcgttctgtcatctgctctgtcaatgacctttggccagaggttgcaggagcacacctgtgggtggaccagttgagtttattattcgaggcagcgagggagaacccacaccatggagaaccatgtggtttctcagtaggagattgttagaaagaacctgttataggatgtgggttttgactgggtggtttggggagggtctagggaagtgtgattttgttctgaattgaatgccatcagaaaatggaggcaactccacgactgggaatgtcaatacatctaagcaaaagagatgggaacaattgcataaagataagccatagtttgtaaagaactaataatcactcatttgggccaagggaggggcattagtattttgtgggtgacacatgagcttatcgcgctgtctgtacttagacagcattatgaagaggccctgtctgaggctggctgctgtgagatggttctgtttgggaggcctgggccagcctcagaacgtcaggggtggctctgggtttccttgttggcgcagaaaacacccactgatttactttacgcttggggtgggatgttttggccccaccttttcatgaccactcagactcagtccagcccagagtgatttgctcacgtgaggctgcccggtgagccagccgcgagccctgcctgaacgtgggctgctgcttggatgacgatggccagcagccgcacagggccttctaagacgagacttccatagtctcccttgggatcactgcccaaggcacccctcaaccgacgtggcacaaatccgtggcacgagtccacagaggccgtgtgtgtgcaggtagatgaagatgacgaggtagctgcgactgctgagtgtgggtcctgctctccttccctgtagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaaggtaatggctaggctctctcagatggcatgggaatggcttaattcctgtttgccccgggaatactcaccagcagtgcttacagctgcagcattcaccccgagataactctgccatgaaatatcttgcttttattattattttcgcatcactgtggtatattgactttggaaacagaggacacaattctacttatagcattctgcttttagtagtggtatttccatttacaaaatatagtgattctcaatcactgaaaatgtcaaatcctagaaaacagcagtcccacgtgtgttgttaacattgttctcgaacaagttgttggccgacgattcatttgctgaacctgtttttctgaaatagatgattctgatgattcagacagttctgatgttagttctgtttagaagtaattccaagaacagtttttatattttgttttcatattgaaaatcagttagatttgcttcagccccaaagagcttgtttatgtaaaattaaatgagtgccggcagtgagctgccgtttttttcttcgaaacgggaaaagggtgaaggcattttttaaaggctggatggtcttcagaccacagggactcttcttgccaagagggaatggctggctaaccggcacagaatacacttagttctttcagccattattgatctcctagtgggccaccctcgcatcttctttggcttaggaaatgttgatttaggtgctattcactgtgctaggtgctggtaatggaagcatgcagaagcaggtcctaatctctgcctgtctagtggattgtggaaatggagacattttggcgcatgaaagggcaggactgatgtctgcactggaaccacgaggataagctgggaccatccctagcatcgcgggatcagcctggagagcagaagagcggactgggtgttgggggaagcatgtagataaacgtgcccaggtctgtccctgttgggagtggggagggatgtaccagccaggactggcacacgggattggctctgccatcaagcagcttggaagaagaagtaactgtgtaatctgaaatgtaggaaggtgctataaagacgatactctgagtgcaggagtctagggtgtggaaggtggtggagaaagggattccggcaacattttagagatagaacctctggaacttattgattaattcagtgaagaagaggaaaaaggaaagaagacggaatccagatgtcttgactgaacagtggagtagaaggtgtttccattggagaggatggggaagacccgagctgttgttattattgtcaataatagttatagctgagatggagtgagtggcggtgccaggatgctgattgagttggacgcgtggtgctggagcacagaggcggggctgggctgcatacgtgagtccagggtcacctccaggtgacacttaaaccatggtatggctgagagaagggaagaggcctggggcctgtggccagagaaccccaacagtgccaggtcagtgcaggaggagaggctgcagatgacctgggtaaggcaggaaaacagctggaagggcgtgcgcagcaaggtcagcagggaaggctcagcaagccccaagcgagcaagcggtaagctggccggcaagcagggagggtacacgcatgggtaacagcagggcaggaaagtgcctgtgggaactacggggatccggtgcagacttcaggagagcagaagggaagcagccagcagcccgggttaggaagacagctggaggagagaaagaagcgagaatagccgagaatcctgcagggaagcttgactatgaacaggctgagggaaggaaagcctgatgtggaggaggctgtggactcccagggggtctctcaaaagacaggcgaagctgatcccggctctttctattccctgttcctttccaggttttgaccttattgaacgcagggttgagggtttttttgtttttttttttaaaccttatttaaatcctgctacatgtgtaattttataagctgctttcttcagttcctataatgtgtataaagtttccaagaagaagcctggttttcaccatgataattattggtggttgaaaactagtggctttctaaagcaatcatataatattctttcccctcacgggagcacttctgttgctttcaagagtctggaactgtaaccttgtgacaggggttacagggaatctctttatatccaatttgaattcgttaatcatttaatttgcatgttctttttccttaaaagggactcaacattgaggaccatccctttgttcacaataacaccacagctggcagttgcccgcacttcacgcgctctgggctctgctctgagcactctgtgggtattgcttcgtttaaattcttagactaaccccaagaggcaactactctccttaagctcattttttttttcagaagaggaaattgagggggacgaaggtgattttcttgcataagatcccaaggctggtcctctgaagacgcacatgaaccagctgtgtcccaaggctgtcttccctaggagccctctggcggggacctgcctgagagtgtgatgggctctcccccgccctcgggggctgccttttgtcccagtgcactcaggaaaaccgccatgccctttccaaccttcatgagtgcttaggaccaagagttgggtagagctccagaagagttgaattattttatttggcgttctagaacccaactaggaaaaggagtctaaggttctggtttatttatttatttaattaattttattgtttgttttttatagagacagggtcttactctgtcacccaggctggagtgcagtggcgtgatcgccggtcactgcagcctccagctcccaggctccaatctcagcctctggagtagctgggaccacaggcatgcaccaccacagccatgcgccaccacagctggctcatttttaaatttttttgtagagacgaggtctcactgagtagcccaggctgttctcaagctcccagcctcaagagatccttcctccttggcctcacaaagcgctgggattgcaggcaggagaccccgtgttcagcctaaggttctgattggctcttctcgttgtcctgtgggcgaggggttgggggagtggaccagttcccagagccagctgtggatgtggcgggctccagggtcagatcttccccccatcaccaggaacgttcccctcctatcagaatgaggctgtgtggggagagcggacttgccctccacccactggcagatgaatccctggtgccccgcaaagagcaggcactccacaaacgtttcctggatcaatcacggaaagagaggttttcacagtggtcatccccggggtctccaggtattaaaaatttccagcccagctctgccagcaaaacactgagaacactcctgtaccccgcagcacgtggccttgagatccacttagaacttcgcgccacgtccacatcccacggcaccccactaagctctgcagagaactgtctatagattcctgctctgtggcttccagggtgagaatcctgtccctttcgtgagcacagaaggttggaaaacaggtattttccaaatagttatttttaccctggtcagtcatccggaaaaatattagattctatttacggttaggtttgttggcagtcacactctgccgtgttgcttggcacagtgaactgccagattgcgtcaggatacagggccgctcgagcgaccgccaaacacaaagaggggaggctgcgcggccccagcttcacttctaatagggcaggacacactaatccagtgtttccagatcagcagtttagagtgaattccaattgcatattgctaagggaaacagcatccccggcaccttccctgctgaaccagagatgagtcacggctgcccgggaagaaacaagggccagactgtcagacgtggagaacccagggtgctttacccagatagaggcaaagttctgaacttgtgttcctagctgtggttggggagggctgtggagcaagggctctggggcctgaagtttagattatccgcattgccgtggccttgggtcatacaaacccagagtcaagagcatcattttctagggccacatttaagggggacactgaaaagggtccccatttaagggtaaccaaaggagggtgtcctggctaatgaaaaaccaaaaaccaagttataggggcctaccctggaagagaggagtcgggggtagaaggaagatttccagttttaaaataccccaaggtctgtccaacaaaagagagattggccttagcacgttagaagttggttggttggttttacaacacaaagaaaactctccaagctgtgctgtccagccacgggaacagctgccgtgaaatttcgtagatatgtaagtttcccgggtttccctaacaaaggcccatgaactgggtggcttcaaacaagagaaatgtatcctctcacagttctgaggaccagaaatttgaaatagttaccactgggcctaaatcaggttgccagcagggctgtgctcccaggaggctctgggagaatccattccttgcctctctgccctctggtggctgccggcattccttggcttgtggctgcatcactcctttgttttcttctgctgtttttttttttttttttttttttgagacagggtcttgctctgtcactcaggctgaagtacagtggcacagtctcggctcactgcagcctccacctcctgggttcaattaatcctcctagctcagccccccaagtagctgggactataggcacacatcactacgtctggctaatgtttgtgttttttgtaaagatagggtcttgctatattgcccaggctggtttcaaactcctgggctcaagccatccgcccactttggcctcccaaagttctgggattacagatgtgagccaccacgcccagccctactccatcttcaaggtcaacatctttgttttttctctattccagcttcataccgccttctcctttgtgtgtgtgtgtgtgtctgtgtataaatccccccgattctcttttataaggacacttgtgattgcatttagggtgtacctgggaaatccaggattatctttccatctgaagatacttcactgaatcacatctgcaaagattccttttccaaataaggtcacagtcgtaggttgcagggattaggacttgatatctttgaagctcattattcagcctgctactggtgataggaaagcttagtagtaaggcaagtgaactttgctatttcctattgttcagctttgccatttactacctacttgacctttctaggcctcagttttgtcctctgtaaaatggggatcctagaagaacttattacctgggattgctgtaaggactaaataggataacatggctggtgcacacagtacccaggaaacattacctgtaaccatgtcgctgatagcttggctggtttgtgacatggatgtcatgggagggagtactgcagggggctcacaccagggagttaatttatagctccctgcaagttcctaccgctgctataatgcatgctgcgttagcttggacactgtggaccttaactcatcattgttccctcagtgtttatggtgatgctgggtgcatagtagaagctcaattaaaaaaaattgagccataagaaattggtgcccttattggtcaaacatggtcaaatatggacaattccaaatgcttcaaggtaacacactggagaaagggccacacagatattggatgggaacattgtcctcagggataatgcatttctttggattagatgagattcttttaccccaaatgcttgcaatctctcttagttgcaaaagtcactgacggcagcttctgcagatgcctcggagggcttcacagcatttgaaatgccaggtttgcaggtcccccatccagtgatccaaaaaccccctggcatcttaatttaaagagtaaatatacttattaaaagaggtaaagcatgcattgccagccccgtaccctgtgagacttctttccaaacaccattcctctgcgttcttttcaaataagtacgggtgcccttttaattttaactctgctccgttcagaagcactccttatagaatgcgtttttaaatggcctgtaatctgggtgggccatctgttgtcccacccatgtgctctctcgctctgcgtcaagtttgatatctgaatggcaacaaggaggcaaggttggagccctgggtgtgggctggggggctgctgttatagctgctgcgcctgctcgtggccgccccactttcctgtttgcagggcgttttgctgtcacaccatcctccaccaacgtggattaaaaaaatgcttggggctgtgtcctgactgtacaaaaatagaacagtcagtgcttttagcagactttttggaaaagaaattgtagcccgcccttcctttttcagtgagacatatgttcccaaggaacagactttaagaagccgggtggttgttagaaggccaggcagtgagtggggggtctttttgattccagggttctggtgaccctggagacgggggtgccacccacaatctcaggtcccaagctttgggccaccctcagttgaagcatttctgcttttcttgccactaaagaaaatatcataaagaatgaatccatgtctgtttccctgaccagtatgccgaaaatcactggacaatcctgtaaaaagtatagatgtgtcttttaaaaaactacattctaccccacatcctagaagtgttattaggacacatcagaatttggatggatgtcactgatcctgtctgagtgaagcctgtccagattccagtaacagatgctcatctgctgggaggtggagtggcaggttctcagtgagggagctcacctacacagggaccaagattcaaaggaggcagctcagtctcaggttggaaggaggagacagcagggctatgtcgcgtggtggtgactgggcactaaattggattctgagcctctcagcagccaaggcgcaaagggaaatgagttggacagtgttgggttttttttgtttttgtttttgttattgagagaaagcaggcacatatgtctaaaagcagaattcttttcatgatactagaaagcatatatcctaccagtccttacagaaaaggctttgggaagccacacattataaaattattattttctttaccatggttttgcaaaatatatttttaaaagttctttgttgcttatttttatagagcttaaattctgatgtgaaaattttggtgcgtagactgggggccgtctactttttatataattcttactgcccagacacttgctgtacagccagaatgtttttaaccaaaaaagagcttcgatgctatttgagcactagaatatatataggttggtacatcagagctttgctctctgaggcatggatttcaataggaaagcataaaaagggcaataaaggaagctcagcctgatttctgagtccggcttcctgatgaggccattgtttatggagtgatgagtcagcccagtgcagaagttctcgtgcaaatgatcaagtgcttgtcatgaatcagagcagcccagggcctcaggagaggctggcaaggcagtatttgtagatgtggcacagaaaccttacactgtcgtggccattgctacaaatgttttctgtacgatgactgtatacgggtccccagagagactgttctgactttctagtaaccaccgattccggatcccagagagccccacgactcaatgctgttcactgtgtagacagaggcacacttggatgactcccaccctctaacttggctcagtgatagagaggctgggatttcaacttcagacctcttgcttctccatttcatctcaaatatccccatcacctaatgcaatcctgagctaccttccaaaattactcagaagcctagagagagagaagattgatacctctgttttgaatgaatgggttgcatttattattggaaaaaaaaacagtgagtgggtcaggtgcggtggcgcacacctgtaatcccagcactttgggaggctgaggtgggtggatcacgaggtcaggagttcaagaccatcctggccaacatggtgaaaccccgtctctactaaaaatgcaaaaaattagccgggcgtggtggcgagtgcctgtaatcccagctactcgggaggctgaggcagagaattgcttgaacccgggaggcagaggttgcagtgagccgagatcgcaccactgcactccagcctgggtgacagagtgagactctgtctcaaaacaaaaaacaaaaaatagccagtgctgttctggatgggtcaacttgatcaataaatcagtgagaaccaagttgagatgaggctctgttacctgcttcagaagagaaagccgccctcactgaccctttgctcatcttctctgtctgtgctttcgtagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccagtaaggcccccagtcagagacccacgttagcttgcgagcttgtctttctatcccaggtctgtggccctagcatgtcgcgttcttcttcctataaccagggcaccagaagtcactgaccgccctgcacttcctccctcccctcccagtcatcccactgcctgcccggcattgcaccggcccgctggtgccttcactggctccctcgcttccctacatgtcgtcctgttaggggttcgttctgccgtgtgaggggacaacatgtggactcagaagcaccaataaggcatcagctagggtgaagcaaaggaacaaaataataataataaagcagaaggcggcagctcctggcaggcagatccggaccctgcccgcttacccagcagcactgaggccgtctaagttccctccccgagaggggagcatcgctgacgttttcacgccttgcttcactcatgatgcatgtaaagcgaatgccatgcccaccacattggtgctgggacaaaacgttttttctttttgagacagggtctcgctctgtcacccaggctggagtgtagtggtatgatcacagctcgctgcggcctcgaccccctggactcaagtgatcctgccacctcagcctccctagtagctgggaccacaggcacacaccaccacaccaggctaaattttttatttttcataaggatggagtcttgccatgttgctcaggctggtgtcaaactcctgggctcaagtgatctcaggaggcaacttttgtctccaaaacacacacgacacacacatgaacttggggcttgtgtcaggaaggcagccggtgtggcccatctgggtctgtcccgggcagcccacttggctctgcccgtgtcttgctccccacttgcctggtgcccgtggtgcctagacttggtcagatgaggcctggctggtggaagttctcccccaggctggcatctgtggctgtggggtgtgaatgtggggttgctggggctccattctggttctgggttccgatgtgtgtccctgacgtagagccagtgggagccctgggctgtgggctttgggcttcatgtctcagcagagcgtacagagcatacaagttgctgcatgaagaccatactggggcctttctcactcacaggggttaatgctagtgacagtgagtggtggtggagaatgaatggcggaatgagcgaccttctgtggctcggccctacacccttttcaaactgatttggggcggacctcaagctaagtcctcatagcagccagcacgggcatccagaaagccctcaagcaccccggccaccctcgacacaagccctccactgtgcacgcggcatcccattccaagctgactccacctcatcttctcatttcatttccaaagtacaccaggactgaggggagggacactcttttccctttttggaaactgaggcctgagaggcagttccattacagaaccatcctccagggtacaaaattgatctctattgggaaatgcaataggaacttgcagctccctccccaccccagcaaccccgtgccctcctcaccctccccaccccagcaaccccatgccctcctcaccctccccaccccaccaaccctgtgccctcctcaccctccccaccccagcaaccccgtgccctcctcaccctccccaccccaccaaccccgtgccctcctcaccctccccaccccaccaaccccgtgccctcctcaccctccccacccaccaaccccatgccctcaccctccctacccaccaaccccgtgccttcaggaaaaaaaatacctgcattccaatgtcaggcacagataatttggaagactctagaagactctagaattaccaacctattccacttcccagccttgattttctttccttttccagattataaaaatgccctttttttgtagagcccttttttaaggagcccaatttgctttaaaggccttgtctaattccaccttgtcatgagcctgtgacaccgggaggcagcagggcaggtgttacggtggcagcggatgcccagagcctccagggagtccaattcccagggccctggaggaggccgccagtccacggggctctgcgatacgtcggggcctgagaatcggaggccacatggagtgctcctccctcttgctaagatgggagattcacaggggccccaactgggaaatatacaatatataacattggtggcatttctgtggccttaagtgtggcgtgcataggtgacacactctgatggcccgtagcttgccagctgggagagagccagggtggggcacagctgcaggtggctgttagataactagagaaacatgcagaattgccgccgacctgctcctgtgcccgccgacgcttgggttgtgcatgctgggtttcctttcagtaatgaaagatgaatattcccgtgtcccatcttgaagcttttttccatctttgcttatgccccaaaataacgcaacctcccttgtaagtaagcaaccctaccattttgactggcagagtacgttcttgagaagttggactttcagagctaaattctggaacctcccgggcaggttggaacccattggtcaccctgatgttgggggcctgagtaagggcctcgtcgtgtgagtacctcctgggccctgtggttgtgaatagggcaaaggaaggcagcagccaccccacgggaaaggaccctccatgctctggttgaatcccagttcccgtgggtatgggctgtgtgtgacgtttgtacctccttcctgggatgtctctgccctggacataaaagtgtttgtttattctctcgtttcttacatttatttcccccaattaggatacctcaatctaagattcatgcctcaatctattaaaaaaaattatcccgccaaagagtaggcttcatggaaaacattaacagacaagtgtgtgacttttgaccacaggctaatttgtttcactgtctgtctcagatgcccaggtatttgaagtcacaataaagattgtaaaccacaacctgacggagaagttactcaaccgcagcagtgtggagtaccaggacttttctagacaactgcttcacgaggtaaagccacaatgcagacagaaatcttttcttgggtgttctgagtgaggacatcaaacacaagccgttaattcctgcccagctcttcctctgggattgtggcaaaaatacatgttactgcagcttcaggggaggccaaacccaaatcgcacagtgattagtcaaaagctttccccctgcttttatggggtacttaatccagatactgggccaatccatctttaagatatgtgcctttattcaaatggtgtacaccacttactcctactgttggattttctgtggaaccttctgtctgagggccctggcttccagctatggggtagcttcattagtgaagcatttaccaacaatcatggcatccattcctccctcgtgactaaagggagacatcagcagacagccagggagaagcaagccagtgggaagcaccatctatccacagatggtgcattggagggagaagtgacttcctaaactgccaagaatcacataaagtctgaggttttaccctccctgcaaactaacaagtgagtctgccacagtttcatggatgctggcagaagacacgagactcctgggccagagacggaagactgtattactccagcacagcaggcagcatgcgtgtgctgctgtgccggttccccttcctgcacccgagtcccgcagaggtgatgcagaggggaccaggggcatgaagcacacaaagtgggtctgcacctgagctgaggaaccccaactctagggaacctgaatcttttataatgggtgcaagcactggctccagaaggagacattatctgttacatcagacagtaacaaacctgccctttgctctggagggagccaatatctctccctcccaaggctgttcactatgcaaacatccttggaaagatattctggaacaaaagggcagttagtgcgtctacttgcaagatgtgtagaaatgccagagacccacagagtgttgcttcccaacatttgcctggaggaggaatctggttttcaatgttttcagagaattccctcccttttgaaatgttaactcacttgtgtgtgcaagtatgggttggcacaaaggcagggaaccaggctggtatctcccttgcttgggcatgggtagccctaagcacctggctctgtgtgcgtgttttgtgtgggatacagcctagtaagaggggggacagctccaaatagccataggcattgttccttggtggggcctctccatctatcaatcaatcagtctttctcacacgctcacacaaatgaccttcgcaccagttttcaggacactcagaggggattgtccatctgatgctccacaactgggagcttgattgcagtggtcactgtgagtccccagcacacaccaggccaggcccggccgtcccagggaaagcccagctaaggtgctgtgaacggacttctctgcgtgctctgagaggtcggtcgtcaggtgcctcctcttgattgtagaggagagaaatggctccaagcaccatccatcggtcacacctggaaccctgcttaatggtcgtgaagacgttgatggatgtctgctgttgcctcttcttggctaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaaggtatggcccagccacccgccctgctgcctggtgtcctccagctcagaaatcctcttggtgactttatttgagtcagtctttcctttatttcaaagggtaaagaaatgcaaatccttattctatcttcctccaccggaaccaggggccagggcagtagccctgaataactagctcacctgtgtctcattggtcagcccaggacactgagtgaaatggggctggaaggtaccctcaggggaaagggacaggagttcactgtgtctgtcgtcagggccccccagcacttctgggcagcgggacaactgcccacctgtgggtctatttcttttctttttttcttttcttttttttctttttcttttcttttctttttttttttaagacagagtttcgctcttgttgcccaggctggagtgcaatggcacgatcttggctcactgcaacctccgcctcctaggttaaagtgattctcctgcctcagcttctccagtagctgggattataggcgcctgccaccacgcctggctaatttttgtattttaagtagagacagggtttcaccgtgttggtcaggctggtctcgaactcctgacctcaggtgatccacctgcctcagcctcccaaggtgctgggattacaggcgtgagccaccgcgcccggcctctgtgggtctatttcattacgctgtgtgttatttcattttacttggtgttgccttgaagcaggaggtcatggacacaggacagacacaaagagacagagagataaagagagagacagaaaggcacggagaccaggttcttgctgtcctgcagcaggcacggagttctctcctggctgtgagggcacacacagtctctagatccacaagctccagttttgggctcaatctgtggagtgggcacctctctggtcgtctcccggggtgctgggtcttggagctcagccacgtgctggcttcctgtcccaaccttcccccaccaggaggtgccgggaagaactgggttgggtgtggggggatctactctttgaagtcatgcctggaaacctcggcctggggttactctgttcacttggcactccctaaggatggggatactacagtggcccctgtacctggtaagatcccacctagctgggctgcagggtagggcctgaggttggggtccacagggtatgcccccagcagggtcctcagtgtgtgaccccgtgatccaaccttcaggcggatccagccttcaggtggatgccacccagcccgccctccacacctccctgcctccctcctcccatcctctgggactagggctcaggcgattccagatccctgccaaatgagaacctcggcagcagggatgtcgtgggtagaatggtggccccctccaaaaagatatgttcacctggaacttcagaatgtgaccttatttagaataagggtgtttgcagacacgattaagttaaggatgtcaagatgaggtcctcctgccgttggatttgggttggcctgaagttcagtgacaagtgttcttatacgagacaagaggaggagacacagacacagaggccaagattggagtgatgcagccacaagccaaaggactcctggagccacaagataagacactggaagaggcctgggaaagcccctttcctagagccccagagggagggcggccctgctgacacctggagtttggacttcgcctccggaacggcgggaatacatctgtgctgtttcaggccccccagctggtgtgtttgtgatggcagccacaggagacccgtgtcttgcacctctaggactggatgaatccattgtaagcattcgcagcaccccactccccacgctgttcagtggtcctgcagaagttattaagctccttctgcaggctcttgcccggcagggtcccgggcaggctgtggcctgcttcctccacatttcagagctgaggtgctggtgcgggcaggtctcctgagctggggggtcagctgtgtggccagtgatggtgacgcctcaggccgtgcatggccggggaggcggccctgcctctgcactcttttgactccatgactactggtgtcttcggacgccagagtcgggggagcaaccatggggcaccgcccctgcctggggaggcagcacgaggcctgagcccagcttacagggggacatccacccccgctgagagccccaccttcacggcgaggatctgtagaagaagacatttgatattactcggcaaaaaaaacaagaaacgaaaacacaaaaagagctcctctgaagaagaaaaggtatttgcgctgtggtccacctagaaataatgttgttggcacaactagagcattcctcagtcattcaggagcactccctgccggtgcgtccacatgtcccaaccccgatagatgaggcgctgttcgcccgtggaggggtcaggttgtcgtgaccttatctttacccttaggccgtccatcccggggcctggggtttcctgcgccagtcacggtgggctgtgtaggtggccatgtgttcggtctttccccaggaggtacgtaccatgtgctgggaggcctggaggctgagccgccccccgcgcctatgagttgcaccctcacagcggcggccaaacctcctgctcactttgccccataggaagaggttagagtgaggcggaacgggttggaatcccagctctgacactcactcactgtgggatgctgcacaaatgacttcctctccctgggcctcagtatactcatctgtggaatgagattacagcaacatcccacctcctatggcgatggagtaaattaaggcacaatgcctgtgtgggtttagcccagtgcctgtgcatggcgacagtgcatttctgatggcccctccagcgttcagggctaactcttccaggattaactttcatatcttggatgagagctcatctaggaaggtctcctagcaacccctgggttcccactggtccttccgcctcacggggctcctttttgaacccctcacatcatttccattcaatctcttgctcctaacagcacggcccctattccttctctttcccaacatctgctctcaggagagattctcatacagtgtgcatttgttctagagtgagggtcatcactgggcttctatgaggcaccgctgtgaaccctctgcaccgaccttagccagaggagcaggactcccaccggcatccttctgcgtaagaggccttgtgggtcttctggggctctggaatcaacgccgcttttcctggggccagagtaggtggagctgagctccccaaagcttccagtttgctgcctgctcccacccgcctcgccactgcgcgagccctttccatcccctctgcagagtgagagaagggccgtgagtgaggatcctggcctagggctgtcaccatccccctcacctgctggccaggctaacctactgcaggctgcttcctttccttaggttcacgggtaccgctatttgtccagcgtccatttgcggtggcattaggatgaggtgctctgtgccctctttctcccagtgtgaatctgacacacgcccccaggagagtccgaggggcatcacttctggaggacgccctgggccctgaaagacagctcatggtccaactgaggagcctgcaccttgctgggacagggtggcccaggagatctggggtctgtacctgctcctggaccctctccagcttgttgttctgggtggggccagctcaggaggggcacctgggctgggagtctctgaagcagctgcccccattgctccaggagagggctcagcccttgtcccagctgcggggccagtgggagcagtgtgcagcgtcctgccctgggctctcgctggctctgcgccctcgcctggccagcccgggagggtgcagaggctcactggcagctcttcctgctcccacacctgcctcttcctctgaactggagggccggcaagcctcaaggcttaatgcaagactaaatacagctgtcagcgccttcctctgagctcgcttgggagctgtctggggggacggaggagtgaagattaggtgaatcaccacgccccaaaatagacatcaggtgcttggtggtttgagccagcgtcttgcctggtgcctctgctgtcctccgtggactgcagcccagccagcctaggctccaaccccaacccggagcacccccaggagagttacctgtaggctggaggttgagtagcaccccaggaagaggtgtgggttggcaccagcagtgttctgatggcaaggcagcccccaggccatgctagggtggtggcatagctgttgtggcagctgacgagcttgctgttctccagggaagctgcttctgtggagaccgcaggaagcacaacagaaaaaaacccacaaaacgagcctcagagcactcagcagcagggttttctttgcccagaactgaactggtcctgcatcgtggcttaaattccacctgaattggaacttctctggcatgccgggtgtgggttcgttcccgagcacctccacccgcagctctacagaagcacgcgcagaaggcactgtcacctccagcagggcctggccctgacgacctcggctcagccaccccatgggagctacattgtccttgtcctcaccttcattcccctcaggcgggccccccggtgacatgacatcacaagtctttgggcacaggaggagggacatacctgtggagacacccgggtgctctagaatatggcgcgggaagttcatgttgtactccgctggaccccacccccggcgtgggaagttcatgttgtactcaggctgacccccaccccccccacgagagaagtccatgttatactcaggctgacccccactcctggcatgtaaagctggtgttatgctcagctggacccccacccccggtgtggaaagctcatgttatactccactggcccccacccccggcgtggaaagctggtgttatactccgctggacccccacccccggcgtggaaagctggtgttatactccgctggacccccaccccccatgcggaaagttcacgttatactcagctgtgtccccacccctggctcagttactttcctatttcttggttgagacactaagtattggagaatgttggcacatcaaagagagaggagaaaacatttcaagttttgggtgtggaaacagaataaagaagagagggctacatgcacacccatgggtgctaatatttaaggaatgaacatttcctaatctttgcccccaaataagccaaccaatgtgaaggtgggcacaggcaggccgtaaggttgtcatgagagtgttggacggatgccccaaaatgcccctgctcccggccgttcactgcaaagacggctaggaaggactccttccagcatgggtctgtcttctgatcactctttggctgttttctcatgggttttgattgtgtctccccctggcagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtacgtgtcgacccccctgccgactctgggaagaccccctgcccgagaatctgggggtggggcaaagcccaattctccataggcacagggctgaggacctatggtaatgttaggggcctacagaaatgttttcatttcaatttattttaaaatcagaagaaagaaattaatagaaggatagtaaatatacataaaacaatgaatctagcttggattacactcatctctatctaaatgccattataaaatgtaatttttgatagattgttaagtggaggggtgcaggggtccatgaaggccaagttccttgggcccacagaagtcaggatgcagcccggggtcgagggattccttccccagtggcctggagcccgagagggtgtggcctggagcccgagacagtgtggaagcccagagaagctgcagagaggcccgatgggggccgctgagctctagtcctgctgtatcggcccccagtcttttctgtggaccagttctgatgagtgggtcggggatacctgggatgctgaattgagcagcaggaggaggccacgtagggacctaaaatgcagtgactgattagcaatgtcggcccggacacaggcgtggcagaggcgcccagccactggcttgccagcccctgctgagggctttctagctggaaggagcagccgagaccagttccctggggagaatattccttagacactgcgtgtgctgtcctgcttcctaacatcccacaccttgtcttctgtttttctcattcgcctaatgtcctgcaagtcgatgacagcatccagcaccaagtcccacattgagcacaaatctgggggaaattgtcccattttcccagagtcctgatggattaatctgaggcctatgagaaccaagccctgcattcaagcccgggttttgtagccccccgggtggatccctcaccctcaacttcagtttcctcatttatccagtggagaggcgtgatttgccttcagagagccccggggaggctgcaaacatgggcccaggaaacactcctgaacgctggcgcccgcctgcgtccctggccaggtccactccgggatgcagagcagtcctgctggacggccatgctgccctcctgggagggctcttactcgtgggtgggatccagcaggctctgacagtggatgtgtcttggcaggtgacctggtgagccccatgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggaggtgcccagcactgccccgggtctggggatggaccaggggagccccagccaggtgaaccccagccaggggagccccagccaggggagcctcagacaggagagtaccagccaggcgagccccagccagaggagcaccagccaggggagccccagccaggtgaaccccagccagcggagcaccagccacgcgaactccagccaggggagccccagccaggggagccccagccaggagagccccagccaggggagcaccagccaggcgagccccagccataggaacactatcggggtgataggcaccacctcctccccgaaggctactgggtcaacccacagcttccctcctggggccacagatggcccactggccctccctggacagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtggtgagttcctcgaatggtgcatggggactaggactaataggacccatagcctgtgtgagcctctggggcaaagctcctgcagccgtggagtcgcaggctgctagcaatgctcaggcggcatcctcatcttgtgcgtgtggaaacggaggcacccagcagctggtttctagttgagttaggaagacagcttggtccccttgcctgtcccagatctctcttccccatctcttagggctccctgtctgcagcagctggggcggaggtctgccttcaggagcaggctttgggccttacttgtcgcgttaggtgctggagccatcccctgaggtgttgcccacccccgctgtcctgcctcctagcagaactgtgtcccggccccgatcagtgtgatgacacccccacaacaactctgcaccctcccagtaatgctgcactcccatagctgttctgcacccctcagctgttccgtcaccctgccaagcattctgcagccctgcagctgctctgcacaccaaggtgtgctgcaccccagcttttctgcacccccggctcttctgtactcccagctgttctgcacctccccagctgttctgtatctccccagctgctctgtatctgcctagctgttctatatgccccagagattctgcatttccccagctgttctgcacccccagttgttctgcatctccccagttcttctgcacccccagctgttctgcatccccagctgttctgtatctgcccagctgctctgtatctccccagctgctctgtatctgtccagctgttctatatgccccagagattctgtatctccccagctgttctgcacccccagctgttctgtacccccagctgttttgtacctcccagctcttctgtatctccccagctcttctgtatctccccactgttctgcacctccataggtgttctgcacctccccagctgttttgtgccccctcagctgttctgcacccacagttctgtagttccccagctgttcttcaccccagatattgaacctctgcagatgctctggattgtcagctgttccgtacccccagttgtttttttaccccctaagtgttctgtacccccatctgctctacacatccagagttcctgcaccccccagctgttatgcacctctagtcataccgtaacccccagcaattccatgttacttgtagaagatttagccatcaccaaacccccaggtgacatctcaggagattcacagcaggaatctgtgcaggagttggatctcagccgtgacagccctgtgagcttgcagagctagcctgcctctggatttcatccaaatgagctgtcaaatgtgatcttcctcaatgcatttcctctgctaagcagcacaggctctaagactaaactcttagcccatgtaagtcagtattaccgagggacctggggtcttcctgtaagaatggctctctagccagcattgtcaccaatgtcaactcctagttggaccctgggtaaatccacccaggggtcaagagtagacagtccatctgaggcgccaccaagaacctgctcaagaggccttcattttggggagtccaggggcctcagggatgtatatgaaccatctgctgaaacaaaacaaaatcagaagccatttgctatcatcccaaggaggggcaaggatgcaggcccaggaagcccgggcttgggaggtttgtacaggatcctactcacccatcacctcggcggccatcacctgcaaatcgctcatgtccccatggtgatgaatttgatttttggcattgggcgaggcttcttttctcctagaaatggcttgattgtaattttggtgtttatattccacttcccagttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacaggtaatgggcttccatttgtttttaaagagaggaacaaaaagtatgaaaaagactttctgtgggttaaggcttaagagagctggatttgtttatgggctgctaggtgtcattgttcttctcagcttagggacatccggctggcttcagcaggcgtgcaatgacggccagacaggaggtggcttattcaggaaaaggcattaggcagcccacgggtatggaggcggcagcagagtgccatagactgcgcctggaaggctgcgggtgcggctcacccatgtcctccgggggaggcagcatggaaaatgcatgcggtgctcatctgttgagctgcatccactccctctgatctcaacagtcctacagaggacttggctttcaggaaggacatcaacagacaatcggcagtcacatggatgatctgtgagcagcctgccagagcctggggccacaaagtaaagaattgagcaataatgaatcaaacatagactccactgcgttccagctggacagtgacaatattacacatatttggatgaaattcctcttttcttttcattagcatcgctacctgggtattttcttatgtgtaccttacctgggtagtcaagagcgtgtctgatgttgcaagctggttttcacgccatgggcagcttcccaagcgttgatagcagtggtctgcacggtggggcgcacaccccttgagggaggtgtaggatggtttcacactgtgggcagcattgatagcagtggtctgcacagtggggcgcacaccccttgagagaggcataagatggtctattgggatgcaataatagaagttgagaactatgtatgtgctttaaagtactaatcagccatggcctgagaaattagagaacagatggagtgcatgacgtgaattgtgcacgttcacgagcagctggagaggagggagatcagtgctggctggacagtcagacagggtggctctggggtctgagagccagagttgggcctctgaaggtctcagctgctctggacgggacaggctgcacgggggaccccaaacctgtgggtgcacttatacctgctctcacctgtgcacctgtcctgctactgatggctttcagactgggttgctcatgccagccatggagactgaaccagaagccctcaggggcagcaacaacaatgatctcaaggacgtagagtttggggttcgcccaggaatgcatagcagaatggctctgtggtttgtcttaaacttagtgagaagctctggggagatggactctaagccccctgaggggagagctgtgtctttctccttcactgtctagaatgcctctggcgcatggcaggcgctttgcaaatatctggtgagggactgactgaacactggggtggctgccatgccagggccaggatgggatggcgacattcctggaccacatttatgtgccacatactcctagaagccctctgcggagggaaaagattcagatggaacagatgatgccaaaacagggactgcccatagaccaggggaggtggggctgctgggggaggaagaaggactggctccaaacaagacccctgggcaccctgtggccacgtggactctgagcagaggcctggccagggccctaagtcctgttatacctgggacagcccagtttgcacccgtagccctggcaaagttatttaatggtgcctccacatgcttcaagtcatgccagcttgctgggaaattgtctgaaccccagcatgggggaacggcagcaaggaaggaaggctatgtgtggtggggagacagttgcaggggcgagctggctctgtggcctctggaaggttctcccactgtgttcaggctgtgttctgtgtcctctggaatctgatgggctgtgtccctgagccctggcactattccttctttctagaacacgggttggctttggtgtgatgctcttcctggacatgaaaatacatttattaatattgaaatgttagtctgttatctaatacagcaccaattccaaatgtgcttatcctccatcctgcagcagcccggaagctcattggaaaggtcagaatcaaaaatgtcaggtactcagaatcctttcgcaacgcaagcagccaggagtatcgagatttcctagaactattcttcaggatggtgagttggtgatatcagcccttaattcctttcaggagggaaagggtggaaggctgatagaattctaggttaggcacggtggctcacccctgtaatcctagcactttgggaggcagaggcgggcagattgcctgagctcaggagttcaagaccagcctgggcaacatggcaaaaccccatctccaccaaaaaaaaaaaaaaaaaaaaaaatacaaaaaatgagcctgtcatggtggcgcatgtttgtgacctcagctactcagcaggctaaggcaggagaatctcttgaacccaggaggcagaggttgcagtaagccgagatcgtgccactgcactctagcctggacaacagagtgaaaccctgtgggaaaaaaaaaaaaagaattctagtctcatccaactaggaatttgacctataggtcctatgagctcctcatttctgaaggaagccaggacgttaagctctggcctgactccctgagtgtccctggatctgccccggcgaagacacggttagcagacaggaggcacaactcttcctctgctgcatccttacttcacacttcactttctgtccagtgaaacctgtttttcagttgtggaacctatgaagcagaaagtccctccacggttttttttttttaaacctgtaaaaaatgagatttatttcacagaccataaaatctacttttaaactgtacaattcagtggtttagactattttgcaaaattgtgcaaccatcactactaattccagaacattttcatcacccaaaaagaaaccttatacccattagaagtcactcgcagctgggcatggtggctcatgtctataatcctagcactttgggaggctgaggtgggtggatcgcctgaggtcaggagttctagactagcctggccaacatggcgaaaccccatctctactaaaaatacaaaaattagccggatgtggtggcgggtgcctgtaatccgaggtactcaggaggctgaggcaggagaatcgcttgaaaccaggaggcagaggttgcagtgagctgagatcttgccactgcactccagcctaggtgacagagcaagaccccatctcaaaaacagaaaaaaaaaagtcactccctctcgccacttcctccagctcctggtaatcacttatctgctttttgtctctatagatttgcccattgtggacatttcacagaaacagaatcatacaatatgtgactttttgtgtctggcttctttcagttaaaatgaggttttctggtttcatccacgtggcagcatgtgtcagcactggattccttgttatggctggggcataacccatgcagtctcatccattcattcaccgagcgcactgggcggctcccgccttctgtctgttataaatagtgctgcaatgcccctgcctcagagaaagttcttttcctgctctttcctgcattcctccctgccatcccctcagcattctccaggatgctatctgttaccatttagtgacatgccttcttgtggactttttgaggtatagggagtgcccttgtcataatctagtgattttgtttgcacggaatctcacattgtagatttcctgagtctgagctcagcacagagagggtttgacattgccacctagtggcctgtcgtggtaataccgtagcagggctgcaaaccccagcgcttcccccacagatgagaagattcgacagcctttgggaacggcctagctcattccctgctcctggtttgtgcattcaacagttgttgacggtttgattaataatgtgatttcattgataaggttaaatagtagttagaatattaaacaacaaacactgaatccttccacctggctcgagtggtcaaaagaggcagctccgtttccttcccgagtttcttgattaatctttcctctttgaaccatttcttcctttgcccatttttggggtgttgtttttctgtttgcctagaatttcaggacagcaaataattatacaacttaatcacagaagtaggatgttaagagaaatttcgggggtttcacttgctgataaccgcagacgtggatgtcaggaggtgttggctgcatggcttggtccctggctcttcaccacttcctagcaaggggcctggaagtttgcttagaggttggtttgaaatgcagctaaaagtcacattaatccaagactatgccagattcctctgagagaaagagagagggaagaactgattgtgaagatggtcacgacaacagtcatctactgagccaaccaagggcagctgtggtctccctggggtccacaggctctgagagggacaatggatctgttcaccttggtggcccagaagccgggaagtgagtccatgacccaggccttgagccatcgcacctgtgaggacaaaccctggaagtacccataggaggtttgcactgaggatgattgaagctcattataagattgtttgcctttctgagtgctttgaccatgatgggttagcatggaatcaatcatatagcgtgtggtgtgtgactgtgtccaaagagacagagtagaaagcagggcgttcgggggcaggaaccccctgtcctaatggggaagttggaaatgctcacaggaagcagtctggggagaggtagggaggaagaatgaaaggggacatgttctgcagtgccaggagcaaaagagctgttccagagaaggcagcgggaagtggtctccctccccacgaccctgcactcagccccctgccctcggtggctgcaaaccaggagtattaggttctagaagcccttgtgagcccccagcaaattttaagccccatgaggtagggtctctgcctgtgcccccaagtcccaccctcgccccacaggcatctttctgaagccgtttactggtttggggggggaaacaagggctcttctcatatcacagacactcccaggcgtttgtgctgggcttgaaaacacagcagacaggaaaggggcccagaaccaacctgtggcttttactttgtgccacgggccagccctgctgctgggcagactggcaggaggaaccgccttgagacgggcatctgtttcctctcagcgtggggacctcctcacatggcctctttccccgcaggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacagggtacgagaggctgggatggagcctctcccgtgttctggaaccagaggcagccagagggcagccaccacccttcgcttttgaaagatgtcgtgttgtgcccatgtggtccttcttcccccagaattagatgaagatgtgaaatagataggaccctgtctgtccctcttattgtgattataattgtgtaaaggttgaagtgttgaaaacatctttgggtgaacctgcagatccccaggggtgctgctttctttccgggtcgactgccccctcgctgcttgtttccatgggctgagggcagatgcatccctctctgcagccagactctcccccaagcatagttcccaaggagatcccagtaaagataattaacgagaaaagcagggagaaaaagacaattcagattcttttctcctatcatacttgaacataaatgatgaatggcttatagttacatgtatcagaaacaaaagactttttaaaaattggagattcatattaattttttgatttttagaataagaaggacttcctaaagaaaatacgatttttagaggaaaacgatgagatgctgactgcatgcagagataaatcaaaataaaggcaccattttaacgcaaagtaaacaaaaaatttttcaataatttggtgaagtgttagtatcccaaatatatagagagatcatacaaatagataaatattaagaacctgatggataaatgcacgaaagctctacacagacaaggtataaaagaagaaatatgaatgactaacaaagatgtggtaacccaagacatccccattagaatgcattgcactgtttgcccatcaaattgcaaacaaaaggtctctttactgctgacatgaatactggtgaaagtgtagtgaggcaggtgtttgcacagattgctggtggcagaaggatttgctcatgcttcctggaaaccagtttggtgacataaatcaaacgctttcaaagtggccatccacttggattctgaaatatcagctctacgactttgtcctaaggaatttgatctgtttggaccgtagtttaaatacaaagatgttcatcttcagtgttactttaaaagccaaagagttggaaatcaccaatcatccagtaacaaagaaggtgctaagttaccaggtgtccccgccccgggctgttatgcaatgatgagaatagcggtttgtggatttgcatggagctagttggtggcagaggcaagctatgctctcagagcatgcctgcattttaaaaggctggaaggaaatacgtccacatgctaacttgcccctggccacgcttttctggttcttatccatgttctgcagtaaacctgttttgctgtcaacaatcaacccagcatcatggcgaaaggcaaatggcctgagggccttctgcccagggttgggcttgcagcctgggtcccttgggctggaccgaggtggatctgggggcctgtgcatctcctggttactcccgggaactgaagggatggccctgctctgcccagatccccctcccagccctgggccagaatcctccttccagaacagcccctgcagacatacttagccattcccagccccagcttcaggaagcctcctgtactttccagaactggtgagcttgactgcagtctgctgtggctggagtttccagctttgtctgtgagatgcactctcccccaaccaggctgctgtgagaccacaagcccccagggatgttcttctgttttgtcttctaaatgttgtgcagattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtaatgtcgtcagagtttcttcttctggaatactgtatcataatcggttttttttaaggacattcacgtgcaaagggcttcttgtccctctgaggtcatatttttatgtcctggggaagtttcctgtgtgtgatgtgggtgcacgtgtgtgtgtgtgtgtgtgatgtatgtgtacatgtgtgtacgtgtgtgcatgttccttcccattctttcatatgtgtccaggcttctgggcagtgccttatctctccaagtgctagctctgatatccatggagagaaaatatacacatacatgaggtgtgaacgtgcagatgctgagcgaccgtcttgtgaaacacgcagccgtgggacacgcgacacaggggaatgtttcctcttggccactctttccacccagctcttttcctgctaaacggggtcttagtggatttaacactgaccccacgttggccactgctatccaggaatctgcgtcaagtgaagggaggtgggcatttataccagtgagtgtggtatccggggggctatagaacgtgtcctgcttgaggtagaatcaggaagcacagaggaggctaagttgcttcagtccagtgagtgtggccagggagggcttcctggaagtggtgtcttgaagctggtcttaatggatagctaagatggcacccagcagggagggcagggcatggtgggtgggtgccgtggtgagaacagagctggtgatgggcgtgatctcacatgcagggacctgcaggagatgggtggcagagagcgagaagcaggctgcccagggaggcgggtgaggcagcagccaactgtgaagtcctcagcaatggtttggactatggcccagagacaggagtgagctgggtggagctgcagggtgctggggctgggcaagccccactctgagataaaagaaggcacaaaccaggcccacagatgatggagccactgctgaaggagggtggagggcacgtgcggagctgtgtctggggtctgcttccatatagaccaccccgagaacaggtgggtggattggaaagctttccgggccccttgttctcctaggcattgaaactgaacctgctctgggggcaagaagggagctggagtgggaagtttgggcacaaggacctcaagaggaggcatcattaccccatcttagagaatagactcagggctctcagggcagaagactcaccctgtatccactggcttggcacatccccggcatcaggtccctcggtccttggccctcgggggcccatggtgagcctggatccctgagctggtggaaatgtgcaacatgtgcatgtgtgcgtgtgtgtgtgtctgcacgtgtgtgcgtgcgtgtgtgcatgtgtgtgcatgtgtgtgcatctctgcgtgcatgtgtgtgcatgcacgtgtgtgtacgtgtgtgtgcatatgtgtgcgtgtgtgtgtgtgtgtgtgcacgtgtgtagttgtggctggaacatgcggttcccaggtgtggctgctgcagagtgcagggcagctccagtctgctccttacccctgcccctccatgccaaccccaaacacagagccactctttgccttttcctccttgtgccttgcaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcgtaagaccaggagagccaggctcaggatgtacactagggcgcaaggggctctaggttacatgggcctcgatgtgggagggccaggcaagactctgcaccccgaggggaacccagcaaggggggttcaggacagggttgagttctcaaccagggaccagcctgcaccccagaatcggaagggagctgtgagtccacccaggagggactctggtgcagagtgctggggcaggcttcagagtcacggcttaaaactcctccctgcacagacaggatgagaggcagtgggacaggaagaggcaggaaagccaaggagtcctgtgtgatatgagagtgtgtgtgtgtgagtgtacgtgtgtgcatgtgtgcatgtgtctgaatatgtctgtgtatgtgggggtgtgcatgtgtgtgaatgtgtgtaaatgtgtgaatctgtgtgtgcgaatgtgtatgtgtatatgcatggctgtgcttatatgtacgtgcgtgtgtgtgtgcatgtgtatcgcgtgcttgtgtgcgtgtgggtgtgcatgcatgtatgaatgtgtgagtgtgtgaatgtgagaatgtgtctatgtgcatgtgtgcatgtgtgcgtgagttgagcatgtgtggatgcgtttgtccatgtgtgagtgtgtatgtatgggtgtgtgtttggggggcattggatggcattagtcagaactgctctgtcggagggactgtgttcctagcgaacattctctatttcagggtcctggatgggctgtggggctcccgggacagagggagcccaggtggggaaagtgggttttcctggcctgaggccttcgcacctctgtgtgcacagatgggctctggcacctccccttgcaggtgactctgggccagtgcgtcctgggtctactctgagcctctagtgtgtggcacccatgaggtagctgacctggctccaggtcctgcttcttcccagggtgcctctgtgtcacagcgaacgctcccatgcaggcccttgttcgtctccaaccccacttggccacatggagcacaaaggcttcgtgttcagggccctgcttgggggacaagaggaggggagagccagcaccttccaccagctcagcctggtactggacacaggggcctgggccgcatgggcctgggagtgcagggtggatcagggaagctgcctggaggggccggcggcttcagagggagcccgtgccggctctgggttggggaagtggccttctgggaaggggctcgacctagaaaggaggccagcgtcgttccaagggtgagtgagagagctgtgaatgtatccaagggccatgccgggggtggctagatgagggaggctggaaaccatggcggagttaagagtctgtccgagtggttctggtcaggtgggcagggatggaagggtggacactcatgggcagggtggggtatgaggcctggtgggaaagtggggctgtggatggggctgagcagggagcagtgcctggcctaggagccagggccagaaggctctcctaatggggacattgtcctcatcgggagctaggcaggaatggtggttcctggtcgttggcgggaactctgggccctgggcttctgtccctcaggacctttgagcagtccaaggcattgcattctaaaaaaagggattggttggggtggtgccctgaaaccaccgtggacctgcttggctgagagttctacatgcatgatgatgtttagtcccttagcgaccgcatgggtcaggcatcatcatccacgctctgcggctgagccctgggtgctcggcagggtccatgggagttcagggtcaaagtcaacctgacaccgagaagcagccccgtccctgtggctctgcctcttgaggagccttgagggggtgctgcttctggttgggggtctggacacactccttagtggggacagggcggcctctggcactggatgggtcaaagctgtcagatgaaacccagagtcctggcatggggtgtcaatgtctgggagccgacaaagtgggaaccgggtggacgtcctgagcaggaggctgggacatggaccttggggctgagtaaggagctagccctggggagcagaggccagaaagccccaggggctgagggatgaggtggggaggtggggcataaggtgattccatggtgtggagcctgcttggagcctggagctgggactgagggtggccaggaagctgagggattcacgtggacgcgtcggaggccattgcagagcacaagcttgcctgggaggcacagctcactctgccgagctcattccgccccctcgggggctcttcagatcctccctgggctgaaggagtaacctgcactgtttcaacagctacaaaaccttcctcacccttcagcccctcaaatggcacaacttaagcagaactgcccagaattagttttctccctcaaagcttcttagacggccacctggaggccgagcgttggcagcaggggggtgtctgcaagggggatgggcggtgatcagtggctcctgtggcttctcggcagtttccctggtgagggaggtctggggtgagaggtgcatgtgggccgggccacagcggcatcctcaagcctatgcagggctcttgcagggctgcggggccaagtggaggggctgagggtgcaggacagcctgcctggtgctcagatcgccacccacacagcggcagctccagtggagagacagcgcctcccaggactggggccctgggcagagcctgcagccggcagctccctctgtgtttttctgaaccagaccaatgcttggcttgattattaaatgcagcagggtttggggcatgttgaaagaaaagggaatttgtctctgatgactcacccagtccctgaaatccacaagagctcttgacggtttttgacacttgtcaaaaactaagtttcccagaaagacttatttgtgcagctgccacggaatccccacaggttcaggtgctgcctcctctggtcaatagggaatgagcagaggccgagcccttaggctcttaggcagtttatggttgggagaatcgccaggatctcgatgctgctggggagaggctttagagaagaacccccatccccccagcacctagagccgtggcccacagcagggcgtggggggccggctggggcctgggagctcctcatgctccgctttgtgctcagaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtgggggtaagggagaaatgccccggctgccccacagccacgtgcctccagaccacctgcgctttgagagttctttagggtgtcaaccacttaaggacccttccttgagatggaatatacaaatgggtgtggcctggctgctccccaaattttgttccctcttcccactcagggctagccagagaaggccaaatatgtcccgtggccaatcccatgggatggccccacttccagtgagccactggcaggccgccacccaagcctccatcaggcaccactttttctataatggaccccccaccttccactgagtctccacctatacaactgagggaggcaacccctggaccagccagccctgaataaatggcctccaagtgctctcgtttggggttgagggggtcttctcgttcatttgcacgttcctctggagctgtgttttaggggagaagtgggaatgggaggggccacgataatgcgcctcctgaaacatgcctcctgcaagctgcttcctcttgcagggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacaggtagggctcaggagtgcaggcacccccatccagcaatgcctggggctttattaacaataggtagggctcaagaatgcagacatccccatccagcaatgcccagggcttcattaacaataggtagggctcaggagtgcaggcacccctgtccagcaatgcccagggcttcattaagaacaggtagggctcaagcaggcactgccattgcctggccttgctgtgtggccagctctgggctctgcaggatttccaggcgagtgctgtcatggacctgggttttggggaacaaatgaggtgcccggtcctcgacttccacggagcctgtggaatctgcgagtgtcgtcagatgtagtcgtgagtaaactcatctgagaacaaggacagcggggctcgctgacaagcaaggagtcccatttcctctcttctcagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcgtaagtgttttttggttttctaaacgtttggttggattcacgttccttattgttacggttcgaggctctgttaataaaaacctagggctcgagtggctcggggccaacctctgggaggagtcgctgtgcctgtcctgcagactccgcgtctgaaatggtatttccacggcaggcagcccttggacggaggactcatgtggactggtgggcatttcccatttctcaatggctgagctgagttccttcttgaggccataatattcaaccggctgtcgcgtcagcactgccttgccatgatacctagtgcttctaaggtgatttataggtgtaaaaatattttttaaatattatttttaacaacattgatggaacatactaaatatcagacactctgttatttaataaagttttttcccctttcctttgttcaacaatcatgcagggataattttacattcctgttttccttagatttttgaatttgaaatatgctttgtaatcctgaggtttgaaaactgtgctttatatcacagacaagtacatgaggttcccacatgttggtcgcctgttgtctgaggcaggggacagcttagggagctccgctgctttttgctcagtgaccgaatgcttctctctcctcggaggtagtgcttgttcctgctctcatctgagctgttttcctgggtgaccaagctctgagcgtctgcaggacgtggatagagaagcaacacaaggaaggctgattctgttcatgtctgttttgctcaaacactagatcttcctgagcaatgggacagaaggaacctcaggtcctaatgacagcaggctgagggccacacacgaggagcctgcccctggttccactggagcctcagagatgacaggagcacggacagccaccgccaggcttcgtctctgcagggagcggctggctctcaagttctctacaagagaattctttacaagaggagcggcacacagtgtgtttttcaagctcctttaggatggatagatagtgtatgagctttccgggctgctgtaggaacgtaccacaaactgagcggcttaaacagtggaaacttattgtctctgttctggaggcaggaagtccaagatggaggtgtcagccggctggttccctctgagagttctaaaggaaggatctgtcccaggcctctctcccagcttctggtggcctcgggcgttccttggctggtagacggcatttgccctgtctctcggtgttgccttccctcagtacacatctatgtttgtgtccaaatttcccctttacagagggacaccagccatagtggattagggcccaccctgatgacctcagcttgatgatctgtttccaagtaaggtcacatgcacaggtgctgggatttaggacttcaatccctttttggaggacatgttgcagcccatctcaggcatctagtgagcagatcccaccatgtcactgagccaggcagtcttttttgtaaggcaaaggtgtaaaggggaacaaatggctgcagcaacctttggagaacacagagggactctgagggctgtgaccaagacacagtcctcaagggacccaaggaagcagctctagcaaccaaaagcagctcaaggggtcttctccagcctgctgctcttgcagacctcacttccttccccgctgacgcctgggcctgcctcttgttgcaccaggacccaccaccctggtctcaccaggtctcccactcctctgtctaaactcagcccccttgccttgcaacttctagcaggataaaatcgcatacatcacattagcatccttgatagtagctcctttctcataaatgttgttcaattaatttgacgtttctcttcttggaaaaaaaaaaacagaattgcaataactttcggttgctgcaaaatagtgaaacctctgccacacaccagatgtcctggggacccctcatccggtctgaaggtgagttgatgacttggtttagacaatgaaagaaaagatgcaaccgattccttttcaccagcatgtaaataaaaaagtaactgttgtgaaatgcagaactcttgagagacttctaagaggcttatcataacagaaatactcatagttagtattcactgagagctgctacgtgtcagcctggcactaagttctttacatgcagaatgtaatatgctcctctcagcaaccctatggagcatgagctattaccatacccatgctacagatgaaaagactgaggcttcaagaggccaggcacaaagttacataatgaaatgttttgagctgcataatatcaagctggtgaagttttctgacactgggtaaatacatccagtgggctgttaagagataagaactcaagctataatcaggccatgtcaacgtgtgtgtgtgtgtgtgtgtgtgtgcgtgcacacgaatgtgcatgcacaaggaaaagctattttattcaaaagatgcaaaaaatggcatatctgttccccctcagtttaaaacttccattagccaattacattgcatgtattttcaaaaccccacatcaactttccagaaaaacattttattttctatatggtccatcatcttattttgaaaaaaaaatacattggtttggggaaaattgtgtgctttgggtattaagagagaaaccgctagttgtcccgtagtatctgttctcctcccctttcatagaaatagcgtccccaggttttgctggtacatggctgccaggaataaaaactgtaattccaacctcctggcagctaagtgtggccatgtaagttctgaccaatgacacgtaagtggaaaagtcatgtgacaacttttagaggtgcaccctccttaaaagacgtctgtgcctaccctctgcctctttcttctttagggctgtggggcccagtccttggagggatctggcttcccaggacaccatgggcaagtggccaaggcaggcctgggttctgacctccacttttttttttttttttttgagacggagtttttctctgtcgcccaggctggagtgcagtggtgcgatctcagctcactgcaagctctgcctcctgggttcacaccattctcctgcttcctactcagtcccgagtaacagggactatgggcacccaccgccacgcccggctaattttttgtatctttagtagagacggagtttcactgtgttagccaggatggtctcgatctcctgacctcatgatttgcccacctcggcctcccaaagtgctaggattacaggcatgagccactgctcccggactgactcccacttttatgacagaaggaaagaaacttccatgtcctttaagccactgctattttgatttttttctcttgcttgctgctgagcctaatcctagttggttttcctttttttgttgtttttttccctaatcttgatgaccctctcccttctctgtctttccctgtatgagaacttctggggtttggatgcagggtgtgagccagaatctgaatgctgctcaggtcttggccatgaagctggggaacaggaggagggaggtctcggccatgaagctggggaacaggaggagggaggtctcggccatgaagctggggaacaggaggagggaggtctcagccatgaagctggggaacaggaggagggaggtctcagccatgaagctggggaacaggaggagggaggtctcggccatgaagctggggaacaggaggagggaggtctcggccatgaagctggggagcaggaggagggaggtctcggccatgaagctggggaacaggaggagggaggtcttggccatgaagctggggaacaggagggaggtcttggccagtgactcaactgctggttctcatttaaagcatttgggaaactaaaaaagtagacacaggtcccaggccacaccccaggcctacacacagaatctctagagttgggtcccaggcccctgagctggtcatcaggtgactgttggtcaaggtgctgggacaacctgcttctcctcactcttcattttcttaatttcctgggaagaacgggtcagcctatttctttcaccctataagaaatagcatatgtgtgaaatatgttctcattaatagataatgtgttctttcatgaatagaaattaaacttcctccttcattcattgatatcatagggaatgtcatgactagggggtgaaaagcactagacttggacttgggacacctgaatttgattataggctctgacacttatgagctgtatggttcatccatcatccacccatacatctatctcatctttccatctatcatttttccgtccatccatccatctacccattcattcatctatccatctatcatccatccatccattcatccctccactcatctatcatccatccatccatctatccattggtcatccatctatccacccattcattcatctattcatctatcatccatccatccatgcactcatctatcatccatccatccatgtatccattgttcatccatccatccacccattccttcatccatctatcaaccatccatcatccatccatccactcatccaaccatacattcatctgtcatccatccatccattcaactatcatccatctatccaccatcatccatctatcatcatccattcgtccatctatcattcatccttctgtcatcccttcattcatccatccatccatctattcatccatccatcctccatcatccatccatctgttcattaatccatccacccacccatccatccatctatccatccacccatttattcattaattcattcatctactatgtttcagatactctgatttttctttgcaacatgccctccctacctcataaggttgttgtgagtgtctaatggtaactaagaattctttgtgaggctaagatttgtgaggttgaaactaggctccctggattcacaacttggctctggcacttaataattttgtggctttgtgcatgctgcatatgaattgtgccttattttcctcatctttgaaaagggaataataataattcctacttcataaagagcctggcccatagaagttattgaataagtgctacttttcacttgtaaccagtagagcactacactggcataaccaaagcaggaagcacggaatgtaataagggtgtaatttctcacgttcaagaacaaggactgtaaatattcatgttgttcaacattctttctcattgtgttagtagcttttgtttgatctatgactatcatacaaatacacagcaaaatcatttagacacatggaatctcccagttggtggggacttggctgcattttaatagtgtatattaacagaaacactgttggagactgcagagatgagaggaggctggcagacaggttcctcaggacctcaccgctatccgcggcctctgagatcccacgctctgtccctgccatcaccatcacctccgtttcagggaagaaatgagaacaactcagagattttagggaatgtgcctaagctcacacagctggtacctgcacgagctgggcctgcgagtgcagatccaggctgctcataacccactctcctctctctgtctcctggggactgagctggcttcattttgaggcttccctccaccccagccctcacatcacactcacgatgtcttggcaccaccacaacaaagtcccacagcctgggtggcttgaacaacagaaatctgttctctctcagttctggaggccagaagtccaaaatcaaggtgctggcaaagccacagtctctcgcaacattgtagggccaagtcctcccttgccgcttcctcgtttctgctggatgtgcccaatctttggtggaccttggcttgcagctgcctccctccagtctctgcccccgtctgcacatggccttctttttataaggacaccagtcatgttggactaggggcctatctacctgcttaactagttgcacctgcaacagttccatttccaaataaggccatgccccacagtactaagggttaggatttcaatatatctgttttttgttttgttttgttttgttttgttttgtttcgttttgttttgtttgagacagagtctcactctattgccaggctggagtgcagtggcatgatctcggctcactgcaacatctgcctcctaggttcaagcgattctcctgtctcggcctctagagtagctggggctgcaggtgttgtgggccaccacgccaagctaatttttgtattttcagtagagatggagtttcaccatgttggccaggatggtctcgatctcctgacctcatgatctacccacctcagcctcccaaagtgtcaacatatctgtttttgcagggggtgaggggttcacagttcaacacataggtaaccctgtatattgacaatttaagaaagaatccattcgggcatcttccctgaatgtctgccaccaacaaatagtacatcagcatgataatttttgcatattcagttttcggaactcctccatggcctttcttttcctagctggcccacttatttcacattcatgagcatgtccctgtgctaaaaggccaagaaatttcgaggatagtgtccagggagtgctcaatgtcccagcaggaagggcctggagcaattactgtagctgctcagcagtgaggagactgaggcggtggctgagctggaactcaaacccctggaagggccctgtttcctctgaacgcgggttcttttttaattttttaatttttaaaattagttaattaatttatttatttttgagacagagtctcgctctgttgcccaggctggagtgcagtggtgcgatctcggctcactgcagcttctgcctcctgggttcaagtgattctcctgcctcagcctcctgagtagctgggactacaggcgcgcactaccaagtctggctattttttttttttttatatttttttagtagagacgggggttttaccatgttggccaggatggtcttgatctcctgaccttgtgatccgcccgcctcagcctcccaaggttctgggattataggcgtgagccaccttgcctggcaattttttattttactttaagttctgggatacatgtgcagaacgtgcaggttgttacataggtgtacatgtgccacggtggtttgctgcacccatcaacccatcatctaggttttaagcctcacatgccttcttccctttccctcactgggttatatccccctttacaaaagcagccattgctgaatttcagccgtcatttaaatttcccccgcatcgtggactgacatgtggtccaacggtcacgatgcatacacagctcatgccacacgcatggagcctccctgaacagggagatagatgccctgtttggcaggatgcctcaccagtggctgtgggaaattaccatccacagttttcagggcttgctctccacttctagctaatctggccatggggagtaaccattcctggactttggtgtcagtcagtgggcagcactggcctgtggaccccctgtggccagccctgagctagtggttcagttcggagcacacagctgcaggtcacagaaacctagctggagaggtggcaactgaacagggatgggtctttcccagggctgagagtccagggccattccgggctgcaaagggccagcaggagcgggtctccttggtctttctactctgcatcctcagggcggcacccccccttgtgctggcaaggtggcccgtcactcgaggcccaggaggaaggtccactacagagcccctgggggctggatttagtgtccatcgtgatttaggagttgtctggggaagtggccggccgggatctgggggcctcggtttcttggggagggtggagtcactttggctggagggtgggaggtgttccctgtccctctctctggaggagggatggtgtggttctagctggcttatgttcagcaccccagggatccgacagtgccattgttggatggctttgctgatggtgacgctccatgctgttccctgggggacacacagcagcgtccactctgggcagactgcccggaaatcaatacagggaatgaaaatgggatctcagatgctcctggttgcacagaaaggctgtttccaatgcagaccttcctgatatgtggggatgaacaccctgagatggaggggactgggtggtgcaggatgtggctgtgacctggctatagacgcccttgacaacgaattatacccacacacggtgggcagagggtcacatctccccctgggctcataggggccagccagagagccagcaggcagctggcatctttctcaggcagcacagtttttaaaaaattaaactgagatgaaattcacgtaacctcaagctaactgtgttagagtaaacgactcagtggtgtttagtacattgagagtgttttatagccaccaactccatgtagtttcaaaacattttcctcaccctaaatgcaacttcatacgcatgagtccctccccatccaccttccccctgtctctgaaagtcactcgtttgctttctgttcagttccgggtagttcctatgaacagggtcatgttattggtgcctcttgggcctggcttccttcactcagtgctttcactcagcgtgacatcttcaaggttcatttacgttgcagtgggtcagcgctttactcctttcacggttgggtcatgttccattgcacggtggggccacaatgtatggattcattcacctgttggtggacacttcagttgttgccaccctttggctggtgctgtgaacaggggtgtacaaatagctgtttgaatcagttttcacatcttttagggtccgcactctgtttttctttttttttgtttcttgtttttttgttttgttttgttttgttttttctttcttttttgagaccgagtcttgctctgtaaccagtctggagtacagtggcacgatctcagctcactgtaacctccgcctcctgtgttcaagtgattctcctgcctcagcctcccgagtagctgggactacagacatgcgccaccatgcccggctaatttttgtatttttagtagagacggggtttcaccatgtgggccaggatggtctcaatctcttgaccttgtgacccgcccgcctcagccccgcaaagtgctgagattacagtcgtcagccactgcgcccagcctgcactctctattttttaattgctcctctgggtctggggatggctcattcctctgtgttgtggagcctgtgtaggcccaacccgtgtgtccatgcagggaatctgactgggctctccccctcccaccaggaggacctgctggtcccgcgcagccccaccctcaaggcccaggcctccccaggctgcgctgtccttactgcaatgctgtcctgggcttggacaccttcctcagctttggtaacccacaggcacacgggtgcacacgtgggccttgcattccccgtgcttcagatccatcagccccggatccgggtggagggcttgctctatcgcattcctcccgtttgtgcagatctctcacctgtgcctgtctcctccccgaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtgggtgcggagtggggtgggaggtgcaggctgacaggaaggtgggtgtggagtggggtgggaggtgcaggctgacaggagggtgggtgcggagtggggtgggaggtgtaggctgacaggaaggtgggtgtggagtggggtaggaggtgcaggctgataagaaggtgggtgcggagtgggggcatctgatgtgcatgtcctgccttgccatccatggtgatggggacggccagcaggattcagccaagggtagatatgtgtgtgtctgtgttttgtggccctttacggagcgtgcagcctcccttctgaaaaagcaaccaggagcaggcagagaggggaaactacaggtaggttggtgaaggttcgatcgcttcacacacccactggactggctccacgataccagcggcagtgctatatgggtgaccacaggacccaggggcccaccacaaatcccatctctgccacccactctcttgaccacccgggcaaggtcctgagcctcttggtgcctcggtttcatcatttgtaaaagaaaccatggtaacatttccggccacgtggagggtgtgagatttaaatgggaagatgcccaagaggccccgctatggggtctgacgccctcaattgctggtggatcctaacgatggtcctcggccgagtgtccctgaaacctggtgctcgtagggattgtcacgtgtggtgtggatgccacagtggaccccccacaccttgctgctcatgcccgcagccccgacttatgtatgaccttttgaggctgaagatgcttctctgatctgccctgtggacttttgtttttcctgggcctgcacatagttcaccacaaatgaatgacaagcattatggagggcagtatggttagtataaaccttcagtgggaaacaccaagactgggacttttgtaaagattttcagattttttttttttttgagatggagttttgctcttgttgcccaggttggagtgcagtggtgcgatcttggctcaccacaacctccacctcccaggttaaagcgattctcctgtctcagcctcctgagtagctgggattacaggcatgcgccaccacacccagctagttttgtatttttagtagatacagggtttctccatgttggtcaggctggtctccaactcctgacctcaggtgatccacccgtctcggcctctcaaagtgctgggattacaggcgtgagccaccgtgcccggccaaattttgagatttttctaaaaaaagaacatgcctgtaatcctagcacttttggaggccaaggcaggaggatcgcttaagcttaggagttccagaccagcctgggcaagatagaaagactccatctctacaaaaaatacaaaaataagccgggtgtggtggcacacacctgtggtcccagctacttgggaggctgaggtggaaggatcccttgagctcgagaggtggaggttgcagtgagccgagactgccccactacactccagaggggaaccctgcctcaaaaataaataaatactaataaaagaagaagagaagcaatcatgaggcttatctggcagcgtgtgagactgctgactccaaatgctgtaagggaagcatgcggcttcggcttctggggaggcctcaggaaacttacaatcatggcagaagaccaaggggaagcaggcacgtcttccatggctggagcaggaggaaggggttggggcaggtgctacagatgtttaatcaaccagatcttatgagagctctatcgtgagacagcaccaagaggatggtgctaaatcatttatgaaggatccgccccatgatccaaccacctcccaccaggccccacctttaatatggggatcacattgaacatgaaatttgggtggggacacagacccacaccatatcaactgcccaccctctcagccaacaggagaacaaggaaagacgagaggccaattttccctcgatgttttaatttcaaggagggggacatccagcatgacccagcaccgacccaccagatgtccttagaaagctagtgggatagtgttggcctcatcgctgggattcgcatcttaaatattaagtaaaaggcactgacatttcctcgtaactctatctagggaggtgactggtctctagcactggtcccgtctatgctgtaagggtcctgagaccccagaatactgcgcatgttagttaccaggagtcctggcaggagagacgggaaagacaaagctaacacaagcgtccccctcacatgggcagaatcacttccacaagcgggtggcgttttctttgaagttgcccagcaagggcagcatggaggttgccttttggaaacgtgtgctgtagtctgggctttgctggtgacctgggaggattggcttgagttctctgggccccatttcctcattttaagattggagccagtgtctactacactttgctgagttgtttcaaaaatctgttatctcaagaaaataaggacctgagcacaggaaagatgggctgggctggagaagctgcctgcccgacgaagagggggtgggctgatgttgacaatgtctgttgtttcccaacatccccgtgaggttgtgctgttattagcatcctgtgttatagatgggaatccagggcagaaagggatagacgtcccaggtcacgtggctaggaggtccagggcaagaagggataggtgtcccaggtcacgtggctaggaggtccagggcaggaagggatgtgtcccaggtcacgtggttgggaggtccagggcaggaagggataggcctcccaggtcacatggctgggaggtggccgagctggggctgcatgggatttccgtttggctctggggtcagctctcttagctaccaagcttagagcctttcttacactagtgttcacatgactgatggacccttagaacaatgccccttgcctttccccttcatcagagacccggagaatttgtattttagcagctgtgcaaggggatccacaattcttaattcttgcagtggggacaccaggtgtcccagttgagaggcagcaactgttgtggttacagggaaggagccttcccaggacccctgagcctccccgggaggcaggtgctgctgctcaattgtggtctgggtcctcagccacctccggggatcccaaaggggcagggaacaacagcgaagtttcagttcaactttacactctaatagtgaaaaataaggaagcttcctcagtttggtagcttttggcctctggtttggggcccatggggtttgggccatgaagaccccctcctcaccaaccccattgcctcccatcctgggcaggagacattgtcaataccagcccgccccctcttcgtcaggcaggcagcttccccagccaagcccgtcttccctgtgctcaggtccttattttcttgagataacagatttttgaaacaactcagcaaagtatagtagacactggctccaatcttaaaatgaggaaatggggcccagagaactcaagccaatcctcccaggtcaccagcaaagcccagactacagcacacgtttccaaaaggcaacctccatgctgcccttgctgggcaacttcagagaaaacaccacccgcctgtggatgtgattctgcccatgtgagggggatgcttgtgttagctttgtctttcccgtctctcctgccaggactcctggtaactaacatacgcagtattctggggtctcaggacccttacagcatagacagggccagtgctagaggccagtcacctccctagatagagttacgaggaaatgtcagtgccttttacttaatatttaagatgcgaatcccagcgatgaggccaacactatcccgctagctttctaaggaaatctggtgtattggtgctgggtcatgctggatgtccccttcctcgaaattaaaacatccgagggaaaactggcctcttgtctttctttgttctcccggggctcctgtctttcgaagtgagaactgtctcaccagttctaaagttcctgcagacatctgctctttgaaaaccatcagccaacccacccacccccaccaggtcgacccttgggcagccccactcagagatgttcccagagtcctggtgggttctccacggatggtgcaaaggtgcaggggccccagctgtgctcgtctggctcaggtatcttcaccagccacccccaccagttggcgtgtcaggagcatcgctcacctgagggcaggcacagccccatggtccccgttccactgggcactctgggagtggctgccttttcattaggggcttgatctgtccctctccagtaaacatagacgccatgtcctcgggttggtgtttcctccactacccctcctcctggggttttctgtattaactttacctttcctgcgtgcaagctgacccaggtgacctcttcctccacacaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctcacacctgaaagtagagtgtttttcctcagtgaacttagaattataacatggccttagttttcaacccatgatactaattttgttgaatataattaattgtcattcatacagaacatttggggaaaggagtattttgatttactggatattctcagagtcagtaaagaatgacagtgggtaatatgtgtggatcacagattctgatcaagtagaatcaatcgcataagacactgaaatgtggctggttgtgctggatgctccatttgggatggtccatcacaggctcgctgagcatccaacgagggccggtgctgtgttgggcacgctggggaggccagaaacgcatctctggttcttcccaagtcatgtcccgctgttctgatgtcagctgaggagctttcacttgcctttcttggaagagcatgacacatattcagtaaaaccagctgttgagccccatgactgtgtggctctttggatttcagataaagtcattgacatatatttaaaaaccctgtctttcaaacttcatctacagttttcaagtaatttttttttttttgagacaaagtctcgctcttgttgtccaggcgggagtgcaatggcgtgacctcggctcactgcaacctccacctcccgtgttcaagcaattctcctgcctcagcctcctgagcagttgggattacaggctcctgccaacacgcctggctaatttttgtatttttagtagagatggggtttcaccatgttggccaggctggtctcgaacttctgacctcaggtgattcacctgcctcagcctctcaaagtgctgggattacaggcatgagccgctgcgcctggcctcatgtaatcttaatacatgtgccacgtctgttcatttgtgttttctgtaataatgaaaacttggtttcctgtcatcctacctcccccatccaagtctattcttcgacaaacacttcctgagcactcacagtgctccaggccctgagcttagcgctctgggcgaagtgatgagagggacagaccaagccctgccctcacagagcacacggtcttgtgggggagggagacgctgaagtcagatgatgacagccatggtaagtactgagagtgatgattgcatgtgtgctgtgagatgcccctgacctggtcccttcatccacccatctaaccatctaaccatctacccatccattcacccaccgacccaaccacccatttgtccacctgttcacacatccgctcgtctgtccatccatccacccacccacccatccacccattcacccatccatctgtctgttcatccatccaaccatccattcatctattcaaccatccatccattcatccactcaaccatttatcgatccattcatccaaccactcacccatgcattcacccactcatccacccctccatccatccatccacctccatccacccatccacccaaccatctgactgaccatccactcaaccatccatccatccatccatccatccacccacccatccatccacccatccatccatccatccatccatccaaccaaggaatgtgtattgagtcccagtttatatactgacatgaggaagacaagaaaaatgaggcagagtttttgccctcaagtattcacaatccatctgaagaaaaacccctgtggatactataatacgtgcagtaaatacagggaggcctctggtggaaggaagagagagaaacagaaaaatgcacgtctatgcatatggacttgtgcacctgttcccattacttcattggaagggctttgggatgctgctgtgtcatgactgctgtttaagaatattatcagcatgcatattgcttgcagcttaaaccctccgatcctagactgtttccactggcatggcttaagggattaaatccaaagtgtatggaaacagaaggaggaagggagggcccctgggtgacccttggatgtctgtagaagttgttcactgctctccagtgcagatgtcaccccagggttgtgcagtgcacaacctgtaaggccagacttcagggccttggagacttcccagaagatctcttaacagactgagtgggcaactcaaatcctcctgtctgtggaagcggggaaactgacatagacatattctatacaagcctcattataagccctccacaaatgattgttctcactgcgcagttgaggaaatggagacagcaacttttctgaagccaaacagctggccagtgaaggaactgcaattcaaaccaagctcattgggtgtaaagttcatgccaccctctgctttctgtgggggatgggaaggagggtctttgcaggctttagaactcagagtacctctgagatgtgggaagagggcttaggggttccccaaggccagtgggccttgggctcctggggttctgggtccctggaggttctcatgttcagacactattgggatctcaatcttcctggcccaggatcccaagctgtgaatcactggaaagtggaagatctgatggaggtggagggtctgatggaagagaatctgatggaggagggtctgatggaggtgaaggctctgatggaggagggtctgatggcgggggagggtctgatggaactggagaattactggggctttccatgggccctctggcccaggttgcatctctccatgctggccactagatggcgacattagctggagtccacgctggaaaccgaatgtcccctgagtttccgcagcaaccacatccctgggttctcttgtttgttctctttcactggatttgagcctcttgcgtgtctgaaattgttctgcagacctgcaggctccggggcacatgtgtgcaaaggtggtgccctggaggccctgtaaatagctcagaaagtgaggctggtcttcttcagagactgagtgattgcgaagtgcaggacaaatgagtctatgtgggggccacagcacggatgtccaccctcccatctggatttcccaagaatgggagacatcttttccctcccttcccgtttctgggaggacaggggcagatggacaggcgagtaagacaggtggcagggagccagcagccctaggagctggtgctggggaggcccaggtgagatccctgtggctcagaagaggacctctgcatgtggaagggacgcccgcaatgcccagtgacacctctctctattgtggagggtgacggagtctgctgaggtagccacataagcacctaaaccagaagtgagtatctaaaacggccttgcatgccataagtcatcagataagaggggctggacaggggctccccaagcctgtcctcagctgtgaccaggtggctagcaaccctctttagtttgagcacctgctttgtcccagagagggagtattaaatgtccgctgttcaccccccacgccccatctctgtccctcctggggaggaaggctgtggtgggagtcaaccctcgcatcccatctctgtccctcttggggaggagggctgtggtgggagtcaaccctcgcatcccatctctgtccctcttggggaggagggctgtggtgggagtcaccccccgcactgtgtctctgtccctcctggggaggagggctgaggttggagtcaccccctgcaccctgtgtctgtccctcctggggaggagggctgcagtgggagtcaatccccgcaccccgtctctgtccctcctggggaggagggctgtggtgggagtcaccccccgcaccctgtctctgtccctcctggggaggaggggtgcagtgggagtcaatccccgcatcccgtctctgtccctcctggggaggaggggtgcagtgggagtcccaagatgcaggctcctcccagttctctgctcacctgtgctgaggctctgcgatctgtggaatggggccgtgttgcaggctcttgtaaggatcagtgttgcccaccgagggcccagcacacaggctcctaaggtgacgaagcacacatcctgctgccaaagtcacagcagcagcggcgccctcagacgggcccgtgggcctcctccgcacagtgtcgggtgctgagtgcctcttgtgggctctgggcttcgcgtccagcactgccaaagttgcccaggtttcacgggaagctcgcggcaggccgggcccagcagccttccgggagaaggacactacgcatctgcggccctgcatgcccccaggagcccatgggctccagcacgggggtgggcaaggggcgagagtctggcccctcatctcctggcagatttcaaagtgtggtcagaaacatagctggactgggcaactggctgaagtggaagtcatcattcagctaatgaggcttgatcttttctccatcccctgctactgctggtgtctgtgctggcctggagctcaccccacctcacccgggcagagcaaaggcccttggctggcagatgctggagggtctgtaaacttgctggtgaatgcccggctgtggacacacagcagatgcctgtcaagggagaaggagccaaggagagccctggggattcccaagagctttagggtgtagggaaaatcgcccaggcaggctgattctgcgaggcttgtccctatagcaggagatggcctgtgcgaagtgggactcctgggaaggagcgatgaggactagagggaaggggcagcatgactccacaggctctcacaagggacacagcatggacatgcttctgcctggatgcccctctgagtcgacagagatccatgtgccctggcatcaaggtcaggcaggggagacgtgcagggagtggagtggacaccagaggggcaagcaccacggtgtggacaccgaggggagccatgggtcctgggggtggcctgggactggactgttgagtcttgggtgggcagaaatcgttcccctcatcaaggactgtagatcctcacttgcgacacccaggacaccaaagcgcttctgttactggataaaaggtcttgactgtgtgtcatccaggctctttgtgttgaacaaaaaattgaacagaatgcataaacaaagcaaaaaagaaggaagcgacgaaagacaaagcaacaaaataacagtaaataaagtgcaggtatattgaagctaaagtacacttcacagagtgggagcaggcttgagcaggtggctcaagagcccccattacaatgctctttagggtttttataaagctcaaataatctggtgacacccctaggcaccctttagaagcctccaattagtcagaccctatgaaggattggcctgtgaccaatcagaagctgaagtggaaacttctgtcttgttatcgctggagtgaggatgtggcccgtgtgctgcctaatcttgcctagaactggctgcacctgctgttcttttgcttatcccttaacccttggtcaccctaatccctattctcctgtctcagttctgatggaaagaaagtgacagatgacctggaggttcctaacccagggaatagctagagttcgcatcccacaaactagtgttagactgtgggaggctaagggtatgggctttgcggttgtgagagtttggaggttgaatctcagccctcctatgtggggcatgtcacccaatctctctgagcccctgtttcctcatatttaccccacctgtgaattgaagctgttgctagcattggttagggaactttgggcaacaagcaatggaaatgtcaactccaacagtctttaaggataaagtcaatttatgaccccttgcaagtgagaagtccaggccagggtggagctcaggtgtggcttgctcctgcagctctcaatggcccagattttgtctgccttttgctctgcgttccatggtattagtttaacccaaagctccctcttagctcccaaatggctgcgagcagtaatcaggactaattgctcatttgtgcatgtccagctgaagacagaacaggtcttcccccaactacggattaaaaggctgggttaggcggggcgcggtggctcacgcctataatcccagcactttgggaggctgaggcgggcggatcacgaggtcaggagttccagaccagtctggccaattggtgaaaccccatctctactaatgatacaaaaattagctgggcgtggtggcacgtgcgtataatcccagctactctggaggctgaggcaggagaatcgcttgaacctgggaggcggaggttgcagtgagccgaggtcatgccattgcactccagcctgggccacagagtgagacgagactcgtctcaaaataaataagtaaataaataaataaataaataaataaataaataaataaaattaaaaaaggttagcattatctcttgattgaaatgtcctacgtgattccccgactccgagcctgtcgctctggccaggaggatgttgggtgctcctgataggctgaggcctgggctatttgcagtgtcaaagggaaaggcctcatgctgttggttcattagtgagaagccacaggaaggtgacatgccagggaaagagactaggctctgtgttttgggttcacagcatgcaagcatgcacccaaacatggaggaggggacttgagtgtcttttgaatgggtctacactgatatttgcttctctgacctccgaaggctccatctcctaggacgttttccgggagccagggaaagcaggatagcagagcctggtcacgtagtgctttgagaatgcgctgggtgggcgagcggtgccttcttattgggttgttcttgtgaggagcattctgattcctacttagaagccctgaatgaaggtgggagcccctgacgatggcagaggcaggtatgtctagggtctgggggcacctggtgtcatctacttgagtcctctttgaactctgcatttggcagctgagcgataccgaggaagtcacttcccctcagcgtcaagcacctgtgctcatcctcaaaggggtcaatgacgcttaggtcacactctccagggcccagagctgctgagctgcacacatgtacgtttctccatgagaccatcttgggggacaagtgctggcacccccacatggtaggacaaagacagaggccttgagacattagtaacctgcctcagatcacacagctggggccagaccagagcccaggctgcccgcggtcatgtcctaggcaccatttctcataggcatcgttgagtgggagtctgggctaaacaagaccacactggttttgatgacggcattttctgcccctgtaccgcatggtaggccagggcctccctcccacctggctacgctgcgcctccaccttcactctcagtctctgtaaagacatgttttgagtgcttggggcagtcgctgagaatattaaagacataatacaggggcgtgcacgatgtggggccttggtacaggttggtacaggttggatccatgcctgccctggctctgggaccctcctccccaggatagagccaggacaggtggggagggggtcactacctggcatgatccgccaggagctggggcagagggacggagcctgcctggcaacagccatgatccaccaggggctgggcagagggatggagcctgcctggcaacagttccagggggggtccttactgggacttccccttcccaggaccgccagtcccccaaacacagcgggagccctggtcagggaggctggtaacctagggggaagccagcgctggagctctggctgaggatggagcaggcactctctgttcaaccctccaggaagccagcatcaccaggtggctggggtggcttctggcctccactgtctgcacgctgtaccctggagctgccttgggaaggtttcggctcctgcagctcccccacgccaatgcagacattggcctcattcagagcaggtccgctcttccccaggggcaggcccctctcatgcggcccgctttcactttatcggagtcacaatgatctgacctcctcctattgatcacgcacagcatttcctgggactgagtttaatttctaatatctgccccatcaggcccctcctgggcaatcctcttccttcctggaaggtacattaaactctgaggtttcacaagggctggctgcatccctgtgcaggcagacaggaccccacacacccaggcgagccctccttggcggcctgttcatctgcagggattcttccggttccccctctggacagccccacggcccagatgccttggcttcccagccacagatccctcattgacctcccctccttgctggggagaggcaggcgctgggtcatccatggggcatgaaagtgacagctacaccctccaagcccgctgggtccctctgccgggtgcctcccatacctgcccctctgcagttgagcaggtgagatctgctgggggaggaggtggccccaggatccctgtcgccgtcccggcctccccgctgccctgcactggctcctgggcttctccttggccctcagttccacggcttcctggctccagcctcctgcctggggctacccagggccgtcaggggcttagttgttccaggaggctgttgtacacagaaaacaccttcatggctgcttgaacatttaatatataatttattgaggttaatttaaaaaaacaattagttttccttaagtaaactcaattcatgaatcttatttatttgttttatattcatctgggagcttttggcaatctctttcagagggacttttgattaatgtttgaccaactcagttgaaaaaaaccctcatgaacagtcaattctgttaattaaattccctcagacatttacactgaacttagaaatttatttgattttctttttaagacacttcagctgcctgacccaagtacttcagaggactctgagaaaaccactgacacctttgtaaacaggcagctcccagagtccaggaaacattccaattctacttatatatctagtttgttttgctcacacctttcaatttagaatcactagtctgtagagaatggcacattttaaactagaatcagctgttctggggaataaactaggaaagtgtgtgctgtgggagcctctagtatgcctcattctcttacacactgtaaacactttcaaacacatacacagactgtttcagaacacagcaggaaagtattaatatgataggtttgatttacttcatcatctgcaaacaatggtaaaccttcctggagttgaagtgctttctccactgtggaagcaatttcctgtagcaagaatggggttactttctctaagtgtgcgtgatttcggtctgggcttgagacctgggatcataggccttctggatgattctgtgatgccactgatgagaactttggaagctgccctgacacagacctccacatcctccagaggggccagtctcccaggcatgacctggttcagataaatcattcccggatccttccatcagattagtctgtgcccattgcccggtgacttcaccactgattagattcaatgtttctgcttcttctcgagttattttcaagctcttctgaactggagaagtacaactgattagattcaacttctctgcttctctttcaagttattttcaagctcttctgaactgcaggggtacaactctcacaggcagagtctccatgtcttttgtgctctgcccagctaggtggttcctgggctgtgatgctgcctggtgctctgggctgccccttgatctgtttctgatttagcatctggctctagctcctccactgtggtcctggccctacctgtgctcttgcaaggagcgtttggcctattcaaaaccaaaccctaccacccagtctgtccacgtgtacttagagagtgtggcacaattggttggctgtgtaggactgtgagctttagagaccttcatacacatttgatcattgatcctcacaaaggctgtgcaattagcaggcatcctcccaggttcataggtggggaattgatgccaaggcacgtga

SEQ ID NO: 311 - DNA, 24438 bp, Homo sapiens
ttggccacccaaagtgctgggattacaggtgtgagccaccatgcccagacccatctttctttctttttagagacagggtctcactatgttgcccaggctggagtacagtggctattcacaggtgtgatcccactactgatcagcgtgggagttttgacctgctctgtttcctacctgggccggttcaccactccttaggcaacctggtggttccttgctcccgggaggtcaccataataatgttgaacttagtgcagatacccgatgggcatagcacactatagcccagaactcctaggctctagtgatcctcctgcctcagcctcccaagtagctgagactacaggcacctgccaccacacctggcttttttttttttttttttttttgagacaggttctcactctgtcacccaggctgagtggcatgatcacagctcactgcagccttgacatcctgggttcaagcgatctcctcgcctcagcctcctgaggagctaggactaggcgtgcacccccatacccagctaatttcttatattttggagaggcagggtctcactatgttgcccaagctggtctcaaactcttgaacacaagtgatcctcccaccttggcctcccaaagtgctgggattataggcatgagtcattgctcccagtctgagatgtatttcttaatccactgtcaaatactggcccaaacaaattcagtttggcttaggaaatttgtatccactcgtctaggactgctcaatattaatgcttccagtaaattcagcatttatggtctgttatgtgctaaggactgaacaagttacagagagggggaaatgactcaattgtagcctctgtcttctaggagttaaatggtaaggaaacatgataataataaaataatttagaaataataggatagtaataacagtaatagaatgtagaaagtcataaatactattaaatgagtgcaatggaagcattgaggaagaaatgaattacactagagaaatcaggaaagctttttttgagacagggtctcccggtctcacttgggctttgaaggatgagtgcagttttaaaaggagagagggaaatcacgttcttttcaaacttttttttaatttaaaaaatattttggccagacccggtggctcacacctgtaatcccagcagttcaggaggccaaggcaggtggatcatctgaggtcaggagttcaagaccagcctggccaacatggtgaaacgccatctctactaaaaatacaaaaattagccaggtatggttgtgcatgcctgtaattccagttacttggaaggctgaggcaggagaactgcttaaacccaggaggtggaggttgcattgagctgagatcgtgccactgccctgcagcctgggtgatagagtgagactccatctctaaaataaaataagataaaataaaaaaaaaataaaatcggccaggcgcagtggctcacgcctgcaatctcagcactttgggaggttgaggctggcagatcatgaggtcaagagattgagaccatcctggccaacataatgaaacccagtctctactaaaaaaatacaaaaattagctgggcgtggtggcaggcacttgtagttccagctactcgggaggctgaggctgaagaatcacttaaaccctggaggcggaggttgcagtgagccaagatcgcgccactgcactccagcctggcgacagaacgagactctgtttcaaaaataaaataaaataaaataataaatattttgtacagatggggtctcattatgttggccagactcatctggaactcctggcctcaaggcatcctcctgccttggcctcccaaagtgatgtgattacaggcattagccgccttgcccagctggagatcaaaagttcttaatagtcttgggtgaacaagagtattctgtataggaaacatacagctaatagctgggcgcagtggctcacgcctgtaatcccagcatttagggaggccgaggtgggtggatcacgaggtcaggagtttaagaccagcctggccaagatggtgaaaccccgtctctaccaaaaatacaaaaatcagccaggcgtggtggcgggcgcctgtaatcccagctacttgggaggctgaggtagagaattgcttgaacctgggaggtggaggttgcagggagccgagattgtgccactgcactccagcctgggcaacagagtgagactccgtctcaaaaaacaaaacaaaaaaaaaaaagaaaagaaaagaaaagaaaaatacagctaataaatgagcttgctaactcagtatctccaggttttcctttcaggaccaatatacaaagatttgtgatatttagcattcatttatccataaaataggtcaaactttaggaaagaaatttctctataaatcttttccaacaaaaatcatctttctctgtactgtggagaaagcagctttctttcagacttctcagttcaatatctgaaacctttagtgagttgcctacatgtctaggacatatgtcatatactacaaagggtaccaaagtgaggactcagtccctgcctgcctttataggacttaagagtgttggaggggtcaaatatgtatgacaaagtatgtgaaagattctttaaaagaaataaaatgtgatggagatcagaacaggaacaagttagcttcagtggggaaatctctaaagcttcatggaggctatgtcttaaatgtgaatagaattgtcataagcagtgatgagtgaaggccttagggaaagatatagaaggtggatggtgtacgacgtttgagaaaggacatgtaatttggttgactggagggctgggaggtgaatctaatgggagagaagttcagaaaagcaggttgagaacagtcttggaatgccatgctaagaagtttgggctttatcctggaggcagggtggagcatacaatatgtgtttctggaagatagcaatcaaccacagaggggtagatgggaaaagaaaggtgaatttagaggggattggaattgtccagggaagagatcgtgctgctggcattaaccaggaggcaggagctggtggaccaaggaggtggtggatatgagaggcacgaccaagaatgaaccaattgcctgatttttgtgcccttgtaaaaaatttttttaaaaaagtatgaactaaggcttggtgacgaccttgcatgtgaaggatgctttgtggttcctagcttgagaagcgggtagaatgggagtcccacccaggaggaggaacatggagaaaagataaagggtttggtttgggtgttggaggtgtctgtgaactgtccagggcattggagaggcagcattggtagttgagggagaggcccgggctggagataataaatttggggatttttcataaatggctattgaagccgtagaggcactgcacttccctatagggagaccagggttttctcagcctcaaaacaattgccattttggtccagattctttcttgtgagagggtgtcctttgcattgtaggatattttagcaacatccttggcctcaacccaccagatactagtagcacccctacccccagctataacaaccaaaaatgtctccagacattgtgaaaagacccctgaaaggtaaaataacccctctgagaaacactgctctaaaacagagtggttctcttcagaagtcggaagaaagattgccaacgggccgggcatggtggctcatgcctgtaatcacagcactttgggaggccgaggcgggcgaattgcaaggtcaggagatcaagaccatcctggctaacacggtgaaaccctgtctctactaaaaatacaaaaaattagttgggcgtggtggcacatgcctgtagtcccagctgttcaggaggctgaggcaggagaatcgcttgaattcgggaggtggaggtggcagtgagccgagatagtgccactgccctccagcctgggtgacagagcaagactccatctcaaaaaaaaaaaaaaaagaagaaaagaaaaagatggccaagggcagaatctctgtgttctaggggcacattcagagaggaagagggcacattaggagacaggtgggatggccagcagcataacaggctacagagagaaggtttggagacagaaatgaaccttggcagtggtgagaacttcatgatccttcaggaatcaggttcagttgagcctcctgaatgtaccttttccttgttctccagcttttttcctctgagatataggagtaaactgcccacctggggcataaatcagaagactgggatatatgccaagggttatgtacctgaaagtttgcttggttgccttttcaggtggtaatattccctttctcttagtttctcattcagttttctccattagtgtcctttttctcttttctttctttctttctttctttttttttttttttgacggggtttcgctcttgttgcccaggctggagtgcaatggcacaatcttggctcaccacaaacttcacctccccggttcaagcgattctcctgcctcagcctccctagtagctgggattagaggaatgtgccaccacgcccagctaattttttgtttttagtagagacaaggtttcaccatgttggctaggctggtcttaaactcctgacctcaggtgatccacttgccttggcctcccaaagtgctgggattacaggtgtgagcccctgtgccccgccttttttttttttttttttttttgagatggggtctggctctggctctgtgaaccaggttggagtgcagtagggcacgatctcagctcactgcagcctccgcctccaagcctcaagcaatcctcccacctcagcctcccgaagtagctgggactacaggtgtggtcaccatgcctagttaatctttacattttcagtagagacggggttatgcggtattggccaggctggtctctaactcttggtctcaagtgatccgcccgctgcagcctcccaaagtactgggattacaggcatgaaccactgcacccagcctattcttaatcctattttgcaaatgaagtgacttgcccaaaactgcacagccaggggtagtagtgtagaagagcaggaggtcagatgtcaccctagtctttttatcacacagggaattgctaggaagctggggctttatcctggaggcagggtggagcatatttaaatatctgttttgggaagatagcaatcagccacagaggagtagatgagaaaagaaaggtgagtttagaggggattggaattgttcagggaagagatcatgctggcattaactaggaggaaggggctggcattaactaggaggaaggggctggcatggaaaggaggaggtgtatatgagaggcacaaccaagaataaaccaagatttggcccattgcttcttgggctacaactcctataaccaagcagttcagcagtttttccttacaaagtcacttcactgaatatatatatatatattatgtttgaggctggggcggtggcttacacctgtaatcccagtgatttgggaggccgaggtgggcagatcacttgaggtcaggagttcgagaccagcctgcccaacatagtgaaacctcgtctctactaaaaatacaaaaattagctgagcatggtggcgcatgtgcctgtattcccagctacttgggaggctgaggcaggagaatcacttgaacccaggaggcagaggttgcagtgagccgagattgcgccactacactccagcctgggcaacaagagcaaaactccttctcaaaaaacagaaaaagaaaaaagaaaaagacagggtctcactatgttgctcaggctagtctcgaaatcccaggctcaagcaatcctctcacctcagcctcccaaagtgctgggattacaggtgtgagccactgcacctggtctactgaattttttgagtgctaagcacagatgatgaggtaactgaggcttagagttgttatgcaagtttgtcccaggtcatgtaaatattaaggtatggatcagccaccatgcccagtgataagccacattacaatatgtattttaacatttttcactaatcacataatttacatttttctactggccaaattttaaaagtaagagaaacagggctggatgcagtagctcatgcctgtaatgctaacactttaggaggctgaggcaggaggatcacttgaaaccaggaatttgaggttacaatgaactatgattgtgacactgtactccagcctgggtgacagtgagaccctgtctcaaaaaaaataaataaataaataaaaatgaattttaaaaaataaagaaacaggtgaaattattattattattattttttttttttggagacagtctcactctgttactcaggctggagtgcagtggcgccatcacggctcactgcaacctctgcttcccaggttcaagtgattctcttgcctcagcctcccgagtagctgggattacaggcaagcgccaccacgtccagctaatttttgtatttttagtagagacggagtttcaccatgttggccaggctggtctcaatctcctgacctcatgatcggcctgcctcagcctctcaaagtgctgggattataggtgtgagccaccatccccggctgaaattaattttatttattttattaatcttttatttaactcaatatatccaaacattatttcgccacataatcaatatataaaattattattattatcattattagtgacagggtctatctctgtctcccaggctggagtgcagtggcactatcatagctcactgatgtctcacacccctgggctcaagtgatccttctgtgctagctctccaagcagctaggactatggacatgcaccactatgcctggctaattttattttattatttatttattattggtttttttttttgagatagagtctcactcttgttgcccaggctggagtgcaatggtgtgatatcggctcactgcagcctccacctcccgggttcaagcaattctcctgcctcagcctcccgagtagctaggattacaggcatgcgccaccatgcctggctaattttgtatttttagtaaagatgggttttctccatgttggtcaagagctggtctcgaactcccgacctcaggtgatctgcccatctcggcctctcaaagtgctgggattacaggcgtgagccacggtgcccagccaattttatttttttaattttactttatttttattttattattattattattattattattacttgagacagagtctcactctgtcgcccaggctgaattgcaacggtgtgatctcggcttactgcaacctccgcctccaaggttcaagcgactctcctgcctcagccttccgagtagttgggaatacaggtgcccaccaccatgcccagctagtttttgtatttttagtagagatggggtttcgacatgttgatcaggctggtgtcaaacttctgacctcaggtgatccactgcctcggcctcccaaagggctgggattacaggcatgagccactgtgtccaacagttttatttttttatagagacagtgtcttgatatgttgttgcccaggcttatatataatatttgctgagcatggtgggttatgcctataatcccagcactttgggaggctgaggtgggagaatcacttgaggtttggagtttgagaccagtttggacaacacagcaagacactgtctccaaaaaaaaaaaaaaattaactggacatggtggcccttgcctgtagtcccagctaactggggaggatgaggtgagaagattgcttgagcccaggagttcaaggctgcagtgagcttgaacacactgcactgtactctagcctggatgacagagtgggaccctgcctctaaaaaaaaaaaaaaaaagctacaggggtccgaagtttgtttaaagcttttaaaaaggcatttgtggccgggcgcggtggctcacgcctgtaatcccagcactttgggaggccaaggcgggcggatcacctgagaggtcaggagttcgagaccaccctgactaacatggtaagaccctgtctctactaaaaatacaaaaaaattagccgtgcctggtggcatgcacctgtagtcccagctactagggaggctgaagcaggaaaatcgcttgaacctgggaggcagaggctgcagtgagccgagatagcgccattgcactccaacctgggcaacaagagagaaacatctcaaaaaaaaaaaaaattatttgtgtctggatgtggtggctcacacctatgatcccaacactttgggaagctgaggagggaggattacttgagaacaggagtttgagaccagcctgggcaacatggtaagacccccatctctacaaaaagttttaaaataaattagccagacatggcggttcgcacctgtagtttcagttactggggaggctgaggcaggacgatcgctgtagcccaggagttcaaggctgcagggtgctacgatcatgccactggactctagcctgggtgacagagggagactatctcaagaaaacaaaacaaaataaacaaacaaaaaaagtgtttgttggagaagctgacatttcctccttggaactgatttcttctggaatgggtcaagaatgttcgttcccttctgaatgtccctgttattgttcttctgtcttgataaacactgtcaaggaagatcagattttctctggcctggagccaggttagtggaaaaatcctttgccttgggccccctgctctggttcactggggcagtcctctgatcactgactgggatcaattacctctgcggtagcccctaaagggaaatgcagaattgctgaactctggaagggaaggagaggtttggtgagccatcattatagacactgtgctagtggcattgcactgcacatgctatctttttgcttctttttttttttttttttttgaggcagagtcttgctcttgtcacccaggctggagtgcaatggcatgatctcagctcactgcaatctctgtctcccgggttcaagcaattctcctgcctcagcctcctgagtagctgggattataggcaactgccaccacgcctgtttattattttgtatttttagtagagacagggtttcgccatgttggccaggctggtctttaactcctgaccttgtgatctgcccgcctcggcctcccaaagtgctgggattacaggcgtgagccaccacgcccggcctctttttgcttcttaccagcaccatctgagctaagcatcagcacctgcaaactccacagaggtgaaaagtttccctgaggggcctgtaactagtaacccagaactttctgaatcagagcccaggatcacagtattccagacttcagggattttagtgctttctgccacccagggacctgggaacaagtgttatccagcaatacattttcataactgcattttgtttccctgtgagctaggcctggcatggttgatctcagtctctagaaactggagtcagatattcaagacattacaaggagatggctggtggggcatcatggctcctaggactttgggaggttgaggtgggaggatcgcctgagcccaggagtttgagaccagcctgggcaacatggtgagaactcgtctctatttaaaaaaaaaaaaaaaaaaaaaaaggctgccctttctagatcaggaggtccagcctctggaaacctcggagggctgcttgatctttcttttctaattcctgacaagttagaagacctttggcttctgagaaccctattactttaagtttaagctcttgtttgggaagccactgggaggacagtgaagaatgcccgcctacctggggaaacctgagttaggtgtggctggagcgactcgagatgcgaggtgggcgggggcaggctgaaagttggagcaagcaggaagtgaactgagggccaccctgggaggaagccgactaggcgaattcacttactgaccggcctgggctgctctgagacatggtgagccaactgggaactaggaaagggctggtttaaagaggagccagagggggcttgggactgggggttggctgtgtcgggggaggagagttggtggcaaagttagagggctgggccagtgctgctatggcctctcttctttgacaacttggctgcaaatagctctgagctgtcctggcaggtgtttctactccttctccctccctcccctgacctctgtgctggtggggagctgggcttccgtgccagcgccgatgggggctccgaattccaggcaaagagttgttgtgccttcctcctccagggagcccgaggcgggtgttgtgacaccacaccaggcagcgcctgggcagttcccagttcagattccagcccagcggcagaagctctcctctccggcctttcactttatccccacacagaaacacaaaggatttgtgtgtccactgagtcctttgggtgtcctttctccattaacatggagaagagaactaaaggtttataagagaaccagaagttggttctctgtgataatgtagttctgacccatgccactggcctatttttggaggtcaagcggggaggagctaaatactatttttctctccttgttcaaaaaccttgtcatgaagcctccgagatgagacatcagccagggaggactagtcctccatttcccccaacacccaggcgggtatttttatttaatatctgcataagcaggcggttgcttggtgcctgcacgtgtcgcccagtggtggggaaagcagaagtgtgtggctcaacggctccaggcgccttctgggatacttggttgcctgttgttctgggtcacagcaatggcattgcggccagggccgtgctccggcagctggcttagagggacagatgggtggggctgggtgagggtgttctgctggccagcacagacactttcaaccagggtcccaagaaatcaggaaaggggggtggctctgggaattgtaaatagtggcgggctctgctctggaagggaacattgtgagatgctggccctgctgtattctacggccctctctagggagcaaggaagcagtggggagggatttagtgatgtgctgcttttccttgtcaggggccctaataaccccaaaagaagtttgatctagtctgttcagcatcacatctcaccttctggggcttacaaatgcatttatttttgattacagaagtaatacatgaaaacattctctttgtaaacatttcaagcattttacaaaaagcttaagtctgcctgaggccttaccctccccagatctctgagcccaagtctccagttcccccaccacttggtctaattaaccccgtgttgccgcacaggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacagtgagacagggagcccactgggggctggaggaaaacagggagggagggaatttctttttggtggggcaaaatggacaggagggccagaagtttgacatttctgttgcctttcacctggtttgggagctgatgtgagctgagtctccacttctgaatctgctctgctccacagattgttatggatcccagggaatggatcccatgactggggcttgaggtggcagctcgcccatagaggcatgttctgagaccgaaagctcagtcagcccatgcattctcaggcttctctcccgggaaacttgttttccctttgaagcctgcccatgacaatcatctgggtctgaccttcccagggcagaaatattggctctgaggaaacccccgctgtggcctctagccttctctaggagctgttagacaaggggtgggaaattgctggcgtcttgctgagtaggctttaaaaagaagggggaaagagcagtgaaatgctttgatcccagggtcccctgctagatgaaggctaaaataatatctcccacacatcttgctagacctcattcttctctctctccagccaggggctgaggccagctgtttcagggaggaagtaactccaaagttgagcaaagtctggagcctcaagttctgtgttcagcggggaggctggctctggctttctgagtcctgtgtgaactcttggctcttgggtattgctcccttgtctccctggggctcattgcctgtttctgtagcttaattgtagcttaatttggggagcatggccccgggaattttttttttttttttagacagagcctcactctgttgcccaggttagagtgagtgcaatcttggctcactgcaaacttcacctcctgggttcaaacgattctcgtgcctcagcctcctgagtagctgggattacagtgtgcacccccacacctggctaattttttgtatttttagtagagacgaagttttgccttgttggccagggtggtcttgacctcctgacctcaggtgatccacctgccttggcctctcaaagtgctgggattacagacttgagccaccatgtctggacaagccccaggaaatttagtgtctataacttgaattgctgggcatggggaagagtgggtggaggaggaggagttcccttacttccaaccctctatcctgtcctggtccctcctccagcctcagcagtcccgatggggcaaggagtcctggagctgcgagatgtgcccacctggagcctgcacccctcagtcccagggtctgccctcccaagggcagattttgctgccagtgttgtacccttgggtgtaagcaggtgtcgaggacccctcagtgtgcaggggtaagaagagaaaggggacccctagtcatatctaggtggagacctcctaggatcctgagaattctaaatttcaacccggccttccagatttttaggaaggtacatttgtcaaggtaggcagatacagcatttttttttttttttttttttttttgagatggagtcttgctttgttacccaggctggagtgcaatggcgcaatctcggctcactgcaacctccgcctcccaggttcaagtgattctcctgccttagcctcctaagtagctgggattacaggcgtctgccaccacacccggctaattttcttgtatttttagtagagagggggtttcacaatgttggctaggctggtcgcgaactactgacctcaggtgatccaccaacctcggcctcccaaagtgctgggattacaggcgtgaaccaccgcacccggccagagcatcttttatttagcagtttgttacctcagcttacagtgtcagtattaagatgtatggcttgagctgaacgtggtggcatgtgcctgtagtcccagcactagggaggctgaggtgggaggattgcttgagccctggagatggaagctgcagtgagctgagattgtgccactgcactccagcctgggtgacacagccagacactgtctcaaaaaacaaacaaacaaggccaggcgtggtggcttacgcctgtaatcccagcactttgggaggccaaggcgagtggatcacctgaggtcaggagttcaagaccagcctggccaacatggtgaaacctcctctctactaaaaatacaaaagttagctgggcgtggtggtgggcacctgtaatcccagctactcagtaggctgaggcaggagaatcaattgaacccaggaggtggaggcagcagtgagccaagatcgagccactgcctgagtgacagagcgagactccatctcaaaaaaaaaaaaaaagtatggcctgtgggctgcacttgtactcttataatcttgttccagtgggaggagccactgggtcactcactctgccttttccccaacagtctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatccctatatgtgtgaggcactttctctcttcccattttgcctttggcttttctatttcttttcttcctgaggataccttctggctaaaattctctcatctgaggtccaagttgttggaagggcaaagagtatatgtttggagaagaaagttggagcccccaccctgtctttattcctcccagttccattcattgtcacaggtctcaagaacaagaattttctgggagtcttggcatatggaaagttcaaaaccttcatagcattttggggtggtatgcaagatttttaagtgttcccattgggtcctgccatggccctgtagtactcttcttctggaattgttagctgaggcatgaagctggttgaaatcctcctgcctcttccaccagagccatctctcttcaacgaccctgtagtctagagccgaggggtggaggaaatggactgctattcctttccttgtgcttctgcatgttttatttgtcttttctctgtccttgtcttctgggacttagcaaggcctctgggtctcagttgtcctgagggggcaagcatctctccttggcatcccatggctgggcacagtcagtcagtcagtgtcacaggacagggccaatggctcttcttcccctctgtgcacaataagcctttctgtcttcaggcccccctcctccctaccaggttccaccatcactgtcactttttccagtgcccagtccgccttggtttgcagggagggttcttgctatctctgttcctgtttcctccacaggctttccagaattggaaacaacctgttgtcaggaagaaggggaagggttgagagtcagggtttgggaccagattggcaagtcaggctctggaagaatcatgctctgaaatttggggagggaggaggaaaggtcagaaaagacccttgtgatatttttatttttattttttcagagataggatcccactttgttgcccagactggagtgcagtggtgtgatcatggctcactgcaacctccatctcctgggcttaagagatcttcctgcttcagcctcccctgtagctgggaccacaggtgtgtgctaccacacctggctaatttttgtattttttgtagagacatggtctcactgtgttgcccaggctggtctcaaactcctgggctcaagcaatcctaccaccttggcctcccaaagtgctgggattacaagtgtgagccactgtgcccaggcttggggtagtctttgctacaacatgttaatcctctctctcctggattcaaggtgtaaggaactgaagtgaagcttctgccttgggacccaggctgtccaaggtgggggtgagtgtctgtgaaaccctcttggtctgggacttctgtattcacagaggctcagccccagagagggaaactttcaattctgttggtcaagagaggcctcacttgagggaccaggcccagtggctcacacctgtaatcccaacactttggaaacctgaggcagaagaactgcttgaggccaggagttcgagaccagcctggtcaacatagtgagaccctgtctctctcaaaaaaaaaaaacaaacaaacaaaaaaaaaaaaacgagggaccttattttaagatgtccgaggcagcttggagtagtggagaacaggtagctggtggtttctctgtagcagtgagaggacaggatgggtagattcggctcaggaaggctctgaagtggtagtagatacaccagcctcccccatcctctgactgaggagcaagtgcatggcgggtgcatgacagcacagagctgcacttgccctcatggtgaggaaagacatacagaaaggctagagctagtactttgcccatgtggggctgctttctttttgaatagaggtgaaagtcacacaatgtacagtttgttattttaaagtgtacagatcagtgacatgtattcagaatgttgtgcaaccaccacttgtctttagtttcaaaactttttgggtgcctgtttttggttctgggtgagatgcactcaccagggtgataaagaccctgcctggcttgttcatggcgtctccaggacctagtatggtgcctgaccgtggcactcatagggtgtttgttgagtgaatgaatgatgccttttcagctgaactcgagctagaagactccagggctcactccactgtgcccattccacagatccggccccgaggtgtgcccgttcaccaggcagaggtgtcatccgaattcaggctcctggggcccgggagggtccgactctacggacccaggtcgctgtggcccatcgctttcgatttgacttggtttctgtcgccactcgcggaaggcgcgccccccgccctcgctcggcggcccgccccgccccgcccctgctcttcctccggggccgctggcactgcggccgctccgcaggcagagaagccgggagcgggcgaggcggcggcggcagcagcgatggtgagggcccaggcggggccggccagccctgcgacgggcagagggcgagtggcgagggtgggagagaggagtccaaagtccgcgggctggggcctcccctggggcccacgagggccagacctgaggcggtgaccactgctggagcaggacggggcggaccctccactccctgcgcgccgcatgggagagaaatgcgtgagccccgtcctggctgcaccgcgcagagcgagcgggactcgggctccccattctcctgaagcaaagcggttaagagcaccgactttggagtcggactccgggctgggatcccagctctgtgacccgggacaagtcacttaacctccctgagcctccttttccgcgtctgtgaagtggggtcagtaatacctgccttgttgggtccttgcgaggttaaaggagccacagtggcagagacccgcctggcactcagaacccactgctaagaagtggtaggaaatgtaacgacctcgtcagccctttccgcagctgtgaggagccaagcctggctcaggagttggaaacttgagcagatggggtggcagaggccattccagccccatggcagggtgttggagggcgaactcctcccctagagaaagagaaagggagatgtttactctgaaagttccactgaagttatcagtgtatggcacaggcctgactccctgctaacctctacctagtgacacattcctgagttgagtcatccccactcctgctgcagatcctggcctttgtcctcacttgccatctccaaggcaaagatgtcaggaacagctggtgccagtttctccctttccctagggctcctgggaaaatggactgggcaggaagtaggcttggtgctttaagattttgccttggagaaactgacagaggtgtgatggatgtggcctggctaggggtcaatgcctggatggccttatctccagggaacttggaggcaggaagaggaagtggggcaggaaggtagcactgagctctgaggccaggccaggaagctgaggaaggctctgagaatagggcagagcccagagcccacttaagggtgtgcagggcaaggggtcaggcaggggtaggggtgggcttcagccggcccttagctctttgggagaagctcctgaagtgaaggctgaaggcaggatattttattgggggaggaggatactgggaaacctggggattctcacgggtacatttgaggcagtctgtggaggagaggctggggaggtcgctcctccacccatccatctcctagcctcttcctgtttcttctttcactcttgcccctttagcgctttccttccttccacccatcccctttccctccctggtccttcttcctttcacttttcttttcttctctatgactcattcaaccaacaaggatttcttggaaatgtccttcatgccagcatggtgacaagtataggggacagagcaggaacaaagcagtgatgggaaagatggaaatggaatgaataattacttgaattcattaatcttgtagatgatcctctctccaaagaatgtgtgtgttgagccacaggcctccctcatatgcacacaaattaggttggtagcatcaaccagattctttagccaatcagctaaagtgtctgacctccttgtacctgcatctaatttagcacacgggttacaaatgtggtgcctggagtctgtgttggttcaactcccagatcttctactcactggctctgtgatcttggacaggtgatttaacacctctgagccaaagtttcctataaaactgggaaaaggccaggcgcagtggctcacacctgtaatcccagcactttgggaggccgaggcgggcagatcacgagttcaacagttcaagaccagcctggcaaacatggtgaaatcccgtctctactaaaaatataaaaaaatagccgggtgtggtggcacacgcctgtagtcccaactatgcgggaggttgaggcaggagaatcgcttgaacctgggaggcggaggttgcagtgagctgagatcgcgccattgcactccagcctgggtgacagagtaaggctgtctcagaacaaaaacaaacaaacaaacaaacaaaataactgggttaataatatggccttcaatgggttgttgggtgaggattaaatgagacagagcaaatgaacagcaagcagcatagtgcctacctcagagtatgtgcccattggatggtggctgttattcttgctcaagatgtaaaacctcaacagcctgccgtgccagatgaaaataaactagatgcagccgggcgcggtggctcacgcctgtaatcccagcactttgagagagaggccaagccaggtggatcacgaggtcaggagttcgagaccaccctggctaacacggtgaaaccctgtctctactaaaaatacaaaaaattagctgggcgtggtggcaggcgcctgtagtcccagctaccctggaggctgaggcaggagaatggcgtgaacccaggaggcagagcttgcagtgagtggagatcacgccactgcactccagcctgggcgacagagtgagacaccatctcaaaaaaaaaaagaaagaaaataaactagatgctagttaccaagttaccaaaagcccatttaaagttctgagccacaggttagaaacaattatgtgtactatgtgtacaagtttgccatagggaagagcttgcttggctgtgcattttataaaacgaagaggttttactgaccacctgtattacacaattttttttttttttgagacagaatctcgctctgtcgcccaggctggagtgcagtggcccttagttcactgcaacctctgcctctcaggtttaagtgatcctcctgcctcagcctcccgagtagctgggattacaggtgcccgccaccacgcctggctaatttttgtatttttagtagagacagggcttcaccatattggccagactggtctcagactcctgaccttgtgatccacctgcctcggcctcccaaagtgctgggattacaggcgtgagccaccacacctggccatattgtacaattcttgagatctgactgctaaaaaaaaaaaaaggagctagggaaatgtgggccacatcaatataatagctcttatttattgagcatttagtatgtgtcaggcgttgtgctaagcttttgatttacaataagtcacataatccttagctaacattattatcagcactttacagaagaggaagtggaggtcagaaaggtcatatcctcagtctcagtcactcagctggtgagtggcagaagcaggatttcaacagacgggtgcaaagcagagccctgctcctagtctctgagctgagtgccgacttagggaggcaatgttataccggtacttgcgcccattcatctgacgacagttagaacagtttcttggatactagacaggagatggggagacaaggagagttaggatagggaggtttttttgtttttgtttctttgttttttcttgagacagggtctcactcctttgcccaggctggagtgcagtgcgcaatcttggctcactgcagcctctgcctcctaggttcaagcaattctcctgcctcagcctcccgagtagctgggactatgggcaggcaccactttgcctggctaatttatgtatttcttggtagaggcatgatctgcccaccttggcctcccaaagtccagggattacaggcatgagccaccgtgcctggcccagatggtgtggttttgagaactgcgttttcataggaggaatcaaagagattgagcccagaaaaacctgagaggtttgagtgtcatagaggggatattctgtacagggggcaacagtctgtcaagaacatttcctgtgtaactgccactctctggcaattacacaactgctcccctctcgccctggctcaaaattccaagccctgcaggcttctggcctcaggtctcagaaatgcctgtctcacccttcttcctttctccacgctctgcttgtcacccctctcccgcctggtggccatctcctggcagtcttgctgatggtacttctccacccctctggctggcctctctgccattttcttacttctatctgtgcctgtctaccaccaatagagaaattatcctgaagcacttcttcactgtcacccgtggctcaaaaaccacactagctcttaagttttatcagtcgcttggagccagtcttctctacctgaccttttctgccttctgtcctgccccatccctcccatcctctgcctggtcctcactgtcagggtgtatccctatctctcagtgcaagaatgtccctgctccatgtcatccttcaaggggtcacccgcccccaccatggcaccctctctgtggcagctctgatacttactatctgtatcgcacagtgtaactctttactcttctctaattgtattacatgtgtcttttccccagggcaaagtggtctctttaagaataggcacaattaggccaggcatgatggctcatgcctataatcccagcactttgggaagctgaggtgggaggactgcttgagcccaggagttcaagaccatcctgggcaacatagcaagaccccatctttaaaaatataggcaccatttattcaggaactgtttatcacatctctgctgtctgcagacattatgctgagtgacagtgtggcgtaaggcagtatggcccttgtcctcttgcttacctccttccagggtccctggagctttatttctcacagtgccagcagagacctgtgtatatagtcagtgtcctttttcctctggttgagtgggggccaaggagggcccgagacttgagtctaaggcctctgtgttccctggagcgaatgtgttcttttaggcctgggtccatcttggctccaggcaggcctggcttcgcattgggggagactggtccagattacagctggaagcacagccagctctttggagaatgtgacccaaatatcaccccttgttgaaaaataaggtaacaacagctgtagcatttagaatagaaaataaaaagataatatccagcattttcccagtctctagcagtgactcttattttcgagtatttatccattctcaagtttttgctttggactatttaattttgttttttgttttgttttgtttgctgagatggagtcttgctctgttgcccaggctggagtgcagtggtgtgatctcggctcactgcaacctccgccacccaggttcaagcgattctcccatctcagcctcccaagtagctgggattacaggcatgcaccaccatgcctggctaatttttgtatttttagtagagacagggtttcaccatgttggccaggctggtctcgaactcctggcctcaagtgatctgcctgcctggggctcccaaagtgctgggattacaggtgtgagccactgcgcccagcctgccttggagtatttgaatgtggggaagttcaaaggattgaatgatggagccttgttgaatgctatagtagtaataatagtgatgacggttgactcaggaaaaggtgagagtgcagtttccctgctctcttcgttgttcctctgtgtttcctgcttactgcttcctccagcctgtgagcgcagcctcccctacagtggtttgcctgacctctcttgaagcaggttgcttttctagctcatgggtaaatattgacctatttgggtttcaaatgcctgcccctcgaaactcatgcagggctagaaaaacatgctgggagaacatctcttgagaataagaattgcttttggttaggctgtatcgtaattggcccactcactgattccttgcttgcaatggtcagcactgtgctggcctcccggtgggatggtggtggacaaaggcagggcactgctccctgccctccctctgggagtttgtggtccagctggggagataggactcatacagtgggaattcttggaggctgtataccaagcagctgcaaggatcctgaaggaggattcttggctgagtgggaggtagccctctgtgaccaccagatctcttctaacacttaagttttctggttttaagtggaattcagtcaagtgccaaaatgtctgttgtagacaatgggtgacgtgggctggcaggaaaagaagcttgcccttcttgtaaggaggggaagggaacagggatgggctgtggggaagtaggctaagaggaaggagtttctgtggtttgctaatccactggtattcatctccctgaaatgtccctgctcctaggcttctggcttataccagggcctcctgcctggtgtctctctctgttacgtgcacccaaagcccagtgcctttcttgcacatgacccagactttctctctcccctgtcatttcaaccttccccagcttggatccaagacctcccttcccagtcctctgaaatgagctggtgttttctgttaggcaaagctgccccccaggctgggaaatccaagagttagtctcatctctgtaagttggaccccagtgaggaccccagctgagtggaaggctggaggccaaaaaccggtaccactgaggttcccagacggagagggaagttggagcagtgatatagggagcaggatcaggccaggaggcagaactggcctgaccagtcagaggcccaaagaggaagatctgagcttctcagtttggggatagaggggttaggcagagactatgatgtgtgctgcttcaaaattacctttctagcctgtagggtaggtctcctccctgtgtgttccagccaggtagcttggttacccattctttgctgccttcttaggccagtgggaaaccttagggcagctgtgcattgattgggtagacgccattctggagcaggtgagaaaagaatcagctttgtgggagggtggggtcctgggaagatcccaccttgggacagcttagaggaagctgaggtgctggaagccgggacttacctaggtcctaggccctgccttgacgtgcaaggggaggagcctgtgagacttaaggtgtgccgcactcaccccgaaggccagaccttcactccgcacacatcatacccttacacgaaggatgctgttactctcatgctgtacccacctacagggggagaaggaggcttctagatctcaggggcagatgagggccaggtgggggcctcatgcagccctgacctcgggcttggtgtccaggcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatggtgtgaggcctgggggagcatggaggggaggggagaggattgggaaagtctctcttgggctgtattcaggatctccagttccttggtggggttgaggccttcttgagggccagtgtggggcctctgggtttcctcaggcacccatagcctagacatgcaacagatagac

SEQ ID NO: 312 - DNA, 44638 bp, Homo sapiens
acataagaaaacataaagaagttcatctactttgacctaatcatgtaattccccagaagcatcaaaaagatatattttggttgagtgaggatattcattgcagttttattttaatcacaaatgattgaaaacactccaaaaccccatcaattaggtgaaaaactacataatcatttaaaatgatatagaaagattttcattgacttttaaaaatggtcacagtatactgtaaatggagggggaaagcagcttaaaaatggtgcatgttggccggatacggtggcttacgcctgtaatcccagcactttgggaggccgaggcaggcggatcacaaggtcaggagtttgagaccagcctggccaatatgttgaaaccccgtctctactaaaaaatacaaaaaaaaaaaaaacttagctgggcgtggtggcaggtgcctgtaatcccagctacttgggaggctaaggaggcaggagaatcgcttgaacctgggaggcggaggttgcagtgagccgagattgcaccactgcattccagcccaggcaacagagagagaatccatctcaaaaaaaacacaaacaaacaaaccaaaaccaaaacaaaacaaaacaaaaaaacggtgcatgttggctgggcacatgcctataatcccagcactttgggaggccgaggttggaggattgcttgagcccaggagttcaagactagcgaccccattgctacaaaaaataaaaaaataaaaaattagctgggcgtggtggcacatgcctgttgtctcagatactcagaaggctgaagtgggaggatcacttgagcccagaaagtcaaggctgcagtgagcccagattgcaccactgcactctagcctgggcaacagagcaaagaccctgtgaaagatagaaaagaaaaaaagaaagaaaagaagaaaagagagggagaaggaaggaaggaaagaagaaggaaggaagggagggagggaggaagaaaggaagggagggaaggaggaaggaaggaagggagggagggagggaggggaaggaaaagaaaagaaaaggaaagaaagagagaatgtagcataagccagattttgtaaagcataatttatgtataaagactgcaagaccatgaggcaaaatgtcacaattttatctctgggtgatggccactcatgttttcgctttcttcttgcttacattttccaagttctcaaatatgtattacttttgtagtaagaaagttcacttagaaagtaagttaagtctgagttttctgcaaccagggtatccagaacttaaaaagataagcaggtagggcaggtaagaagtcagtcatgacattgtaagcattgaaataaaaataaaataagtcatagccaggcatggcctgtaatcccagcactttgggaggccgaggcaggcagatcacttgaggtcaggagttcgaggccagcctggccaacatggtgaaaccccgtctctactaaaaatacagaaattagccaggcatggtggtgggtgcctgtaatcccagctactctgcaggctgaggcaggagaatcacttgaacctaggaggcggaggttgcagtgggccgagatcgcgccattgcactccagcctgggcgacaagagcgaaactctgtctcagaaaaataaaataaaatttaaaaagtcatggcttttttccaggtcactaattgtctagtgagtctatgcattatcataatgtctgtgggtggtcaggctaaggagtgctttgccaacagtgaaaaatttttccagggagatacccgggagagatagtgaggcatctcaggaacttgagagttaaactaatttataaagttcatgcttgtgggggcaagatcagccatctggaaaagcacctcacctaagcagtaccttagacccgggtgagtgaagagtcatgagactcggtggagcccagccaatgtctggagcagaggcgtggggtggttttaactcatctgggaaggaagaggtggcagagggcagaaggatggagaaaaggtgatgagtgcagcaggtttagaatccggcatggtcagtgtttagcaggccccagtcaagggcagagggcaactctccctagggggccaccatgtcatcatcactcagagccttgcctgaggcttgtctagcatttaggacagttccggcagcataggcatcacttagagattgttagaaatgcaaaatctggccgggcatggtggctaacacctgtaatcctggctctttgggaagctgaggcaggcagatcccttggggtcaggagttcgagactagcctgggcaacatggtgaaaccccatctgtactaaaaatacaaaaatcagctgggtgtggtaatggacacctgtaatcccagctactcgggaggctgaagcaggagaatcgcttgaacctgggaggtggagattgcagtgagccaaaattgtgccattgcactccagcctgggcaacagagcgagactacgtctcaaaaaaaaaaaaaaaaaaaaaaaaagaaagaaagaaagaaagaaagaaagaaagaaagaaaaacagaaatgcaaaatctcagacccactccagacctacggaggcagaatttgcatttttacgagatccctgggagattcagagacacattcattacaagtgaagagtactgatttaggagacatacctccagtatatactccttgatgccttctgattatattcagcttcagattcataaaggctcccaaggacctgacaccttaggcagggcaacgtgaatcccagcctggggatgggcacccccggcctctgctgtgtgcagcatctgaatttgctttccaagtcacaatcccttattcaaaacatttggttccaagtgtgtttcagaattcagaatttttcataattttaggaaggtaagatgatgcatttgccaactctcccaattctcccagtgggatctggggcagtaccctatattcaaacattgatatcttgcagcttattatgaatattgacaccgaaaagaataaacatcacaagatcaggtaagttttggcaccaaatttaatggaaaaccttagttttcaggctgggtgcggtggctcacacctgtaatcccagcactttgggaggctgaggcgggtggataacagggtcgggagtgcgaaaccagcctggccaatatgatgaaaccctgtctctactaaaaatacaaaaattagccaggcgtggtggcacgtgcctgtaatcccagctactcaggggtctaaggcaggagaattgcttgaatctgggaggtggaggttgccgtgagccgagatcgtgctactgcactccagcctgggcaacagggcgaggctctgttgcaaaaaaaaaaaaaaaaagacagcaaataaactcacctaaaactttagacacagagataattgcccacacatttggattatagcttttgtctctctttacattttaaatatatattttatatattttaaaataatatatatactttatataatttcatataaaatgtcacactgtatgtagttttctagcctctgtttttcacttttcatctttttatataatcaaagagtcttctacagccttttcttcaaaatcaaggtagttttattgtattttggttgtaaaagtgataataggaaaaaacaaacatatatttgcttatatgtgcataaagtctctaaaaggatacactagttgctggtcacactgtttacctctggagggagccagatggaaggcagacagggacgagagaagaatttttattgtataatcttttagactcttgattattactttgtgaatgtattctctatttcaaaaataaaattaaaaaaactggtacatcctcactgcaaaagaaatcaagcaatatagaaaggaacaaagaagaaaataaattcatctttaaactcaatacccagatacaacactgttagtatttttgccacatttcttccaagtctttatctatgaatgtacagacatgtgtatggagatatttttaccaaaataggatgatgctgtacgatggtttttgttacctgtgtttttcatgtagggtgaatcacagacagcttccatgcagcctcattttaaacatctgcattgttattgcatgaagttagccagttaccaaaaaattaatccaggtgaactgagtccagcatctgaatacgcagtgccaggtaacaccaaccccctgatccaaagctgggattttcttttcttttcttttctttttgttttttttttgtttgtttgttttttgagacagagtcttgctctgtggcccgggctggagtgcagtggtgcgatctcagctcactgcaacctctgcctcccaggttcaagcaattctcctgcctcagcctcctgagtagctgggattacaagcatgcaccaccatgcctggctaatttttgtatttttagtagagacggggcctcaccatgttggccaggctggtctcgaattcctgacctcaagtgatcctcccaccttggcctcccaaagtgctgggattacaggcgtgagccaccgtgcccggcccaaagctgggattttcaatttgctgtctgtaggatcttgaataggcaggatgttatgttccagaacctggagagataacatatgggaacgggctggatgttccttctgtccatggtgtttaaacccatgtcgcttattccataggtacaaacacctctacctgcccccttcccctcagcctttatgcccactaccaccaggatgatgccagagagggccttggtggccagagccagtctgcatgtcaaagacccgagctcccatttgggctccaccacacactgagtgatcctgggaaagtcactttttcttctctgtagaacagagataataatctccatgatgcctttctcagagtgttgttttgttagaagaatcagataaggttatgactgtgaaagtagtatgtaaaatacagggcactctacacatagaagtttttattgttaaagtctggcctcttccctggagctgtcagggagaaggtagatgccaaaaccagctggcccagcttccttccgtgattggctcatggagcaaacattccccttgtgcacttttcaacatctacacactcatctttaaaatggagtgttgtaaaggtcaagggcacaaagcgttgacaagggcgtggaacaactgaaactctactaatgcttctgcacagctgctgggaagtaaattggtacaacctctttggaaaattgacagtatatactaaaactgatcatgtgaattcccctatgtacggcccagcaagtcctctgctatttatgtaataaacacaggtattgtggatgttcaccagaagacatgttattaagatgttcatagcagaactatttgtaagggtcccaaactagaaactacccccaaatgtccatcagtaattaaatggataaattacaatattttcatacaatggaataggatacagcaatgagagcgaatggtattcaactacatgcagcaatatggaacaatcttacaaacgtgttgagcaacagaagcctgaccaaaataagagtacatacttgtttcactaatctatacttgtttcgctgcataacaagtatagatcccaaaacttaatgtcttaaaacaacagatagattacttctcatgagaagatgggatagctgtgcaatttctcttctgatttcaccttagttgagtcataaggctgcactcagatgcagatttggctgggtgggaaggtctgaggtaccctcacgtgacctcattctggtgatgctcagttctttcccaggtggcctagaccaccttccttacacggcagtctgggggcagcatttcaagagagtgaaagtagaagctgcaaagttttaaaactaagggttgtaactatcaagagttgcaagggcccagcctcaggagcttcatcgtgtccatttctctgcattctattggtcaccccataagtcaaaaggccagcctagattcaagggtgtgaaaatagaccctacctctccctgagtagaagtcacattgcaaagggtcatgcatacaggaatggaagaaatctgtggtccatctaccacaataccctgtgattccatttatagaaagtagaaaagcaggtaaaatccactgaagctgttataaattctttgacgaatgggcctggagaggagtatgagagaccatctgggttcctgatgtgttctgcttcttcatctaggtactgatgactagaatgtccagtttatgaaattcagcaagctattaacttaagacatctgaaactttttacgtgattactatacttgaattgaaagtctaagttacatagtggttttaaaagaatgcagttcatttccctttccagttacagttccatccatcaggctggtggagctgctcatctcctcaatgttcctcaggacccccgcttccttctttcttgccatgccatcatcttgtcctcatcgagagttgaagctgttgctggcagtctgcattccagctagtggagaggatgcagaggggtagccctggacaagcacattccttgcaagctaataaggtggaagttacacacattacttccactcacaatccactggcaagcactgattctcatggcctgcctagctgggaatgtagtcttagctgggcagcctgtgccaaggatatgtgccaatttcagggaaacaactagcagtctactgcattttttttttaatggagtcttgctctgtcgcccaggctggagtgcagtggtgcgatcatggctcactgcagcctctgtctcctaggttcaagggattctcctgcctcagcttccccagtagctgggatcacaggcatgtaccaccacatctggctaatttttgtacttttagcagagataggaattcaccatgttggtctggctggtctcaaactcctggcctcaagtgatctgcccgcttcggcctcccaaaatgctggaattacaggcatgagccaccgcacctgccacagtctactacattactaataataaagctgctctttaataattatgttttcagaaggccatttggaaatagtttttatctcactgttggattataaaaacaccaagtgacccgagttctacacttttctgtgccaaaatgaagaacattaataataagtatccatttcccctcaagtatatatatttaaatcataaatatgtaagtaaatgtatacatttatttaaattttaaatatgcaattggccaggttccaagggcttatccaccttcctggaaaaaaattgtctttggaaaattccttgatatgattttagagggcagcctctaaaatgaagtgttcaatgaatgttcaaggaatgaatgaattttagcaacctgtatcttaggtgctgagagtatctgattagggcatatcagactaaaaaaagtcctctacaaacactagaatttactaatctattttctacttaaaatgcatagataatttgacatcaagcacatgtacagtttatggaaacaattttattggtaacagaaccctactaactcatcagagccccactattttctcccgtgtactttccttctcctggcagcctgtcccccttccctgggaccccctcccaactcattcccgtgaactttctgacttgctgcctctctcccttctgggaaaaagtgtcagctgctgcactaataatccagcacatgctacgactgtccctgagacagctgtctactgcccctaggcacttgggcaggggatctccttggagccagaaagttaataactggtcttgaagatacaaacaatgtcatggtctatgactttgtgacacgatgcaaaggaaagcgtttgggctttgagtcaggcagacccagattcatacctcagctcttcttaatatgtgtgtgactttgggcaaagtactgcatgtttctagccctcagcttcctcatctgtgaaatggaaatcacaatacagagaatattgggaataacaaatgagaataaatatatttagccctctgtagatgctcagtgaccgggcttcctctcccactatctctttgtctttccagagttgaaagacccataacaaggaatcaaaggagagtgaaacgatgactaaaggtttagaggataagatctaagaatggatgaaggaggccgggcgcagtggctcacgcctgtaatcccagcacttaggcgggcggatcacgaggtcaggagattgagaccatcctggctaacacggtgaaatcccgtctctactaaaaacacaaaaaaattagccgggcgtgatggcgggcgcctgtagtcccagctattcgggaggctgaggcaggagaatggcgtcaacccgggaggcggagcttgcagcgagccgagattgcaccactgcactccagcctgggcgacagagcaagattccatctcaaaaaaaaaaaaaaaaaaaaggatcaaggaatggtaaacgtttattttattttattttattttattttattttgagatagagtctctctctgttgcctaggctggagtgcaatggcacaatctcagctcactgcaacctctgcctccccggttgaagcgattctcctgcctcagcctcctgagtagctgggactacaggcgggcaccaccacacccagctaatttttgtatttttagtagagacggggtttcaccatattggccaggatggtctcgatctcttgaccttgtgatctgcccgcctaggcctcacaaagtgctgggattacaggcatgagccaacgcgtccggcagaatggtaaatgtttaatatggaaaagggaacatttagtctggacagagaggacaataaataattatggctaccatttgtcaccacctttcctggcatttacttatttatttatttattgagatggagtttcgctcttgttgcccaggctggagtgcaatggcacaatctcggctcaccgcaacctccgcctcctgggttcaagcgattctcccgcctcaggctccccaggtagctgggattacaggcatgcaccaccacgcctggctaatttttgtatttttagtagagacggggtttctccatgttggtcaggctggtctcaaactcctgacctcaggtgatcctcctgcctcggcctcccaaagtgctgggattacaggtttgagccactgcgcctggcctttcctggcatttaaaatagctatgtccagtcttcagaacagccctgtggcgaggtatgatcatgaaacccacgttataaagtgaagaggaaacagattttataacttgcccaagatcatccagctaaatggagaagtggagattcaaagtcgggtctgactctttgtactagcttaagaacagactctcagctggatgtggtggctcatacctgtaatctcaacacttaaggaggccgaggcagatggatcacttgagcccaggagttttagaccacacaaacacacaaaaaattagccaggtgtggtggtgcatgcctgcagtcccagctactcaggaggctaaggagggaggattgattgagccctggtgattgaggctgcagttagccatgatcacaccaagagagggaagaaggaaggtggctgtcagtcactggtatcagagacaagcagaggacagagaagacaaatgcaaaatctttctttggctgggacttgtcagaaagggaatctccagtgttggtgatggtgtcaccaacagcctcatgtgccttatgtgtgggcatctctgaaggcagaaagaactccattttccctggaggaaaatggaccagtgagcatgaggctgaggtctgactcctgggggccacacaggcaggcctgagcaccttgcccctcctcactgaagggggcttaatgtctggggcacagttgactccatccctctcttttttcctgtatgtggttttttgtttttttttttttcaagacaaggtctcattctgtcacacagactggagtgcagtggcacaatctcagctcactgcaaactctgcctcccaggttcaagtgattctcccatctcagcctcccgagtagctgggactacaggcacgcacgtacaggctggtcttgaactcctgacctaaagtgatctgcctgcctcgtttttcctgtatgttctaatgttatttcagggatcccctttgcctcactctggccattccaaaacatatatatgtttcatttatataaatccaaatgaaaatattaaaattgcaagtgagatatttttggccttaatctttgaatttcaatgttttcttatctgtagagctggtgtgctaactcctgtaattctgggcaatgcccatgtggttcttggctgcttcaagccatctcaggtctgattttcacacaagctcagcagcactgggctagaagggtaccgccctcccactctgctgccactttgaatagaagtccaagctttcgctttcttgccctgactttgattcttcacattgctgaggagcagtgattgaagcttaatctcattgtctacagtccgtctcctctatggagctgcactattctttcccatctcaattatttctgatgtaaccaaaacactctctctccccactgccttttttcttttgtaaagacttgcaaagggtcagttccagaggctcgagccctgtgttctgactttcacagacagaggcctgccactcttacatttacaggtcatcattctgagcaatacactttttttgaagagtagtcctaaaagctcactaaaaagttgcatttgtatttaacttaaatagagaaccttatgtgtagtccatgtttctggactctatacctgattttgaatcactggacttaaattattggacttacaacactgatacatcttgtaaatgaacctaagcaaagaataccagccctacatcccactcccctcaagataactgggaaagacacaaagccatgctgaggaggagccatggtttgatattgtccagtgagtgtctcttggcctcagaatgctgccacttcctgcagttccagcccttggctgtggtccattctgagtaagtgaattcctctgttaaaacttgcacacaataaggagatggcgtcaccaacagccagagaagtcaagggtcctgatccatccagagacaaggtgaaaaggcaggctgggggggaaagggggaccagcagattaggccaagagtgtagcatcatgaaatgtgatgtcttcatgagaaatgcaaggaaataaagcatttgctgtacatatctaacccgtatgagagagaccccacttcttcagaggaaagcataccagggaggtcagaacttgggccaactccatgacttcaatggtagagaatggcacacgggccaaacaggatgcataccatcaccaagaagtgtcggggtctcaccggctaaagacatgttacaaaggtgccctcagtcacctgcccagagaataaagcagggcccaggcagggaaaaacacacaaggatactgatctttagctgctggcttcctggggtcttgatgccttggagatggaggataatgggagagcccgaaaggcagtctttgggggtttcagctgacccatctccctccatctgcatcttagaggccactcttctaaaaactacaggcgcatacctggtgggcagggaatctgtgccacttggtcaggtcaacatttccagatctcgttctccctggtcagatttatgatcattaagtctaaaacatctgctctttttcctcaagcaacagttacacctgagtggctggagaagccactccaggtaacagtacagcaggctgtccttactatggaagtttggcttgtggccacagctgtttgcagaatgcccacaagacatggtcctgcctctattctctgagggaactaccctgtctcccttgagaggagctgagttctagaagactgttgtaggacagatttggtttaaagttctttaaggcaatgctgtttctgtctgtggcagaaccctgtgtccaggacagaatagatggaggcagtggggtgctggtaaaccagctttctggaagagaaaacaccaccaccaccgattcatagcacttgttaattttcatcatgtaaatacctccatcatgatcagatttcaggctaccaaaggtttaaaaaccagttcacaaaaaatcctgaatatttaacaatcggccagcaggggctggctccatccagcagatccaggactctggggagctgggttgcataagacatcttttttctctgatgctttgaaatgttatgagcttactgtgttcttaaacttcagctacagaatcaaaacagggcagagactttctgaaagtatccttactcccccttaccctcaccaagagctggggctttcattttagtccttgaaagaagacttgaaaagtcacaattcttgttctcttttccaaatattttgagtgtcacaagttagaatctgatgaagaacttcaggtagaaagaatgtaagagccaaatctacgtgagttctcaggaatgagtctatacaacatggtaccaggggatacaggggatagcatcttgacatcacctcttaagcatgagactggacagtggcagaagatgggtggctttgtaatgctgagcaatgggaagaaggagttttaaagaaggttttaggacttcatgtatcttttgaggagaactaacagcaggctgcttacctccagtatcttggttccaaatcttcaccttgcaatcatgtgatgaggtagcaattaaaggcatcaaggccaatgctcttggtagaaagacgcaggatgcgacagtctggaaatgccccttatactcacatattctgtttcgagtctgtcttaggtcccacaactgcaaagtaatgacatggaccagctcatagtcacttgtctagcttcatccatgaatatctatctccccctacccccatgatgcacctattccctccacttacctgctcacgtagctaccccttatcttcatccatccacagacccaacaacccatccatccacagacccaatgacccatccatccagtgattattttaagcctcaactatgtctcaaacaaccctggttaagaatgtgtcatatgagtttttgcctttttagtggttagggaagtaaaagctcccagtcctacagcatgatggtgttccatcatggggaacccatggggagccccaaacaacagtatggggttgtttgctttcatggcaactcaagagctgccttatttcaacctcttggcatctgtgggccctgtggggaccccgtagttagaagtaccccatagatataagtacatctaggtgcagacattctgatttaatgcctagatgctgaaccttgatgtgtgaagactagcgtctacaagagggaagtgccagtcagtgctgccagtcccactctcattgatacagatcagatcacagctggagaataatgttcagggaggagagcaaattgaattatgtccaaaaagataatgaagttattggacagcatgttatccagggaatagctgtaggagctggaaatgtttcacttagaaaagagatgctacattcaaaggctgcaacaccccaatctaccatttactagggatgtggtcttgtgcaagagatgtcaacttgccatgcctctatttccttgtctgtgaaatgggaattataatagtacctaactcatggggttgtttttaaggattaaatgagatattacatgtaatgtgctcatcccagtgcccagcacacaagaaatgttcaataaaataggaggcataattgttctgtttgaatactagataacccttttaatggatattctacaattatgaatctaaggtgctttggaggagcctaggcaatctattccaaaattaaatgtaaggaaggtacatgagtaagggatggagtaggccctggaccaacactagagctccaaatttcctaaaaagcttgagcttcttttactgtggccacgcctataatgggaataaatctggttcttcaaacagtccctcccctctctaagctctgctgggagtagagacatcagcaggctggttctgtgtttagctcctccccatcttgactctcatcccattcctctttcctactaccaattcagagagccctaagttgatgaatgtttcttttattttctttctttatttttttgagatggggtctcccttgttgcccaggctggcctcaaactcctaggctcagttgatcctcccacctcagcctctgaatagcttggactacaggcacatgccaccatgcccagctaactttttatttttttatagagacagggtcttgctctgttgcccaagctagtctcaaactcctgggctcaattaatcctcccgccttggcctcccctatgaatgtttcttaaatgaagcaactggaatgcaaaggatcactcacagtatgcttttgaaagaggcctgagccattagcaaagcccgcctgtgtagcacagctacaggcatgaggccagagtaagtgatctgttcatcagcaaccagatacctggacctcacacagtctcctaccgtggcttcacagccttctcctccaaagccattgctgcaggagatacacttgtgtccatccacactgacttcacagtaggtctgaatgtgctgctttgcaggaaacatatgagctacctgcagcccccgactgtcccataatctgaaagagattagggcaggaaattagcttgtagtaaatgtggctgaaatacacccgtattgtcccactaccaaaaaagtcttggctctttgctgcataggccagtcagattggaatggcatgatttacctaaaaacggcagcatgaaccagatcaatctctgagactctaaagttggcaggaagtaaccaaattgaatgacatctgagttctttctattttgagatcagttaatagaaattgagaccaagcatcttaattgtacaagttaatttgttaatttggtcctttgagacactgctttccgtggacaaaaggatatttctgtgcctgtgacttaaatttttaaaaagatacttattatgatatgggaaatcagtcatcattcagaattagttacaaaagatttacatacaggtcatggccagccttggctatggggtccactggggagtgttttgttttgcttcttatttcatttttacctctttaccccattcctaccattttctaaggagaatctcttctgagatccaaagtttctagttatcctctccggtctaagaactattggctttactgactcccctgatgctgatttcaaccctgcttccccagggagggcttcagctgaaggctgggtgactgagaacaccaggagccatgcaggggtagcaaggagagccaggcagcccaacagggtgggacaagcaagtgactgattctggggttaatctgaacaccttcacacagcaggagctggctgaatcagatgctttggaaccatccaaaacaggggcttttacttggcctgatctcatgacacacaacctctaccttaatgatccatggggccaaagcagagaggccccagcaccagtgaagggcagaggaacagaaggctctgggaagggcagagcaatgtggagaatcagagtgggaatggagccatgtatgcatgggagccacaaacctcacaagaaacactttcacagctgctcagtaagcccacctgagggttttatcttcagaggtctgtagtatgtatggttctctggggacccagcacaggtgagtgacctagaaaaagcaaaatgttcagaacttctccacaccaagtcattcctctgctgtaattcctgtcaaatgtgctaactagcatcactgtgcctcttctcaaggattctgaactagcaaattcatttacaggcatcttaggttttgcagatacctatcagtcatgctctacctgcatctcctaggttatcagcagcaagataacagctgggccagttgtgagcaccaaaatacatgcaggcaccctaagagtgcctgaaaccccagctgtgtggcagatagaacagctcctgttgtaaggtgggttcactgaaactctagccccaacacctcatggggatcaggaagagcattcatgtttctctttatccctgcaggtccctgctggataggcataaaatagtttccaaaataacccgaaataacaggattttcttttcttccagtaacctccaccaatatagagggcatggggcaagcatatctgaccattggcagtcatcttcaaaattagaaaagatgactgggactgaaatttgacaaccactaaaagaacatctagtatgggtcagacacaatgtcaggtatttcacatctagtatctgaattcatcctctgaagaaccttagcaggtgatagaattctccccattttataaatgaagacacagacactctaagagcttaagtaacttccttgagataacataactggtaagtaatagatccatgattttaacctgagtataactgactccaaaggctctccaatttataccagtctgctactagaaaacaactggtccttcaaaagcaatgcaaattctacataaagcaaaaggtaatgcttatttctccacatgatgttacacatatgaacatacaataagcataagctgtgaggtcctggaagacaggaactatgttcttggtcactaaccctgttcctagcacagtgtctggcccacagaagaaacagaataatgaaagaaataatgaagacaccattttaaattccaatataagtgagtaaaatcattgtctggagcagaagactcaagggaacatctaatctaataaccctgagaggccagggtctcacagcaggttaggggacagcaattgggacccaggctctaatttctgctcatgggcctcctgatttatctcccgagcctttccttcaccccatgctcctttctgctgccctgttctgtaccaagtttgagttcataccacgttcctggagacagatgctctttccacactctgtcctgtcaccacatcccacagaagcagggtgttgtcccgagagccagtgcacagctgtgatgagtctttggaaacaatggtgagaagacagcctgtgagtggggacctgaacggggcttttcagaaagcacaaaggcattgggaagaggtccgctttgttttacctggactcacagccaatccggtgaccaccatggcatggccacacaattgctgccttggttgtgaggaaccgtgcaagtcccacatcatgaccatcctgtcacgagaggcactgaagaactggctggatttgggaatacaggctacctgctcagggaaaaaacaacaacactgaaatagctctggtatgctagttggactggactttaaattgggggaaagatgagtctgcataactccctccccacacacacttcttttctttttttttgagacggagtctcactttgtcacccaggctggagggcagtggtgtgatctcagctcactgcaacctccacctcctgggttcaagcgattctcctgcctcagcctcccgggtggctgggattacaggcaccagccaccacgcccagctaatttttgcatttttagtagagacagggtttcaccatgttggccaggctggtctccaactcgtgacctcaggtgagccacccacctcggcctcccaaagtactgggattacaggcatgagccactgtgcccggcccccacacacacttctcaaaagagtaatacctaagcttgaaatctatgaatgcacagcatgggccagtctgaatttccacctttatcaatgttgtgctacctttcctttatgtagcagatttcctcctgtccttcagggtaaggttaaaaatctcacctcctcagatcatgtcaccttggtgaggatgtatcccctcttgggcttcctatagaacttcctcctgtgggattccttttgcacttgatcatcaccacaccccaaaaatggatgctgtactgttatgacaggtgattctgttatacttacgaagaatttgaagtgaatctctgttccattttatgctttttaccttgaatacaactttgcttgatattattatcatcccaactcctgctctgtttgtttacatttgcctgatatatctttgctgacctactcttcctgttctgatctcttccatcgtgtttctttttttttggaattgtggtaaatatacataaaacttaccattttaaccatttttaagtgtacaactcagtggcaacaagtacattcattgttgtgtaaccatcaccactatcatctctagaactttttcatcatcccaaactgaaactctacaacctttaaacaattactctccattttcctctccccgcagccgctggcacccaccattattctactttctgtctctatggacttgactattctaggtacctcaaataagcagaatcataccatatttgtccttttgtgtccggctcttacttagcataatgttttcagggttcagccatgttgtaacatgtatcagaatttcattccttttttttttttttttttgagacagggtcttgctctgtcacccagactgcagtgcagggacctggtctcggttcactgcaaccttcccttcccgggctcaagcaatccacttgcctcagcctcctgaatagctgggactataagtgtgcgccaccatacctgactaatttttgtattttctgtagagacagggttttgccatgttgctcaggctggcctcgaactcccgggctcaagtgatctacctgcctgggcctcccacaatgctgggtttacaagcacgagccactgtgcttggcctatttcattcctttttaaggctgaaaaatagcccactgtatgtatattaccgcattttgtttatccatgaatctgtcaaaggacatttgggttgtttccagcttttggctattataaacaatgctgctatatatatatatgtgtgtgtgtgtgtgtgtgtgtgtgtgtgtgtgtgtgtgtgtgtacaaatatctgttctatatttactaactgttttactttcaatcttaaagctgttttgcattagatatgtcttattttttatttatttattgagacacagtctcactctgtcgcccaggctggagtgcaatggtgtgatctctgctcactgcaacctctgcctcccaggttcaagcgattctcctgtctcagcctcctgcatagctgggattacaggtgtgtgccaccatgcctggctaattcttttttttttttaatttttagtagacatggagttttgccatgttggccaggctggtcttgaactcctgacctcaagtgatccacccgccttggcctcctaaactgctgggattacaggcatgagccatcgtgcccagcctagatatgtctcttttaaacaatgtacaggtggctttagtttttaactcagtaagagtactgcctttcaataagtgaatttatcccaattacatttactgctatcatatatatgtttgatcttgttccttccatcttttctgttggtttttgaaaaacactttgtcatattttcattgtcttctttttctataaaattgtatatttgtttttagagttatttttccctttatatttttaatttaaataatatggaacttaagttcttctcatgatacctctgtatatgtattaatatccttaaactcatattctcaatgtattaatttcagaaagaaaacagaatctcctgtaaggaaaattttttttttctttaattagcacaattatattacttctggctcgttcccacttttgtaagtactctcttggatttttatctagtctattatcatattattaatattttgtattttatacatataaatttttaaaagaattaaaacaattacatttcttctcatagccctcgttttgacaattctttagacataattctgtgtttaattggattgaaggctcatacagtgaattcagtttggaacttctttaatattcattggctttattattcatcattcattcacattctttattttttattttttattttttgagatggagtttccctcttgttgcccaggctggagtgcaatggtgtgatctcagctcaccacaacctctgcctcctgggttcaagtgattctcctgcctcagcctctcgagtagctgggtttacaggcatgcgccaccacacctggctaattttttatttttagtagagacggggtttctccatgttggtcaggctggtcttgaattcctgacctcaggtgatctgcccgccttggcctcccaaaatgctgggattacaggcgtgagccaccgcacccggcccattcacattctttaataatataccttcaactatattattgaggaatgctttgcatatggcaagattttacaaatttaagaatgtcttcccattgcctttacacatgaacaacactctccgcacatacagattctttttctttcttcctttcctttcctttctttctttctctttcttttctttctttccttctttccgtccttctttctttctttttctttttctctcttctttctctctctctctctttcctccctccttctttctttctttctgactgggtctcgctatgtcacccaggctggggtgcaatggcacaactatagctcactgcagcctccatctccctggcttaaacgatcctcttgccttagcctcccaagtagctttgactataggtatgcaccactatgaccaccgaatatatttgtatttttatttatagtagagacaggtcttgctatgttgcccaggctggtcttgaactcctgagctcaagcaatcctcctacctcagcttcccaaagtgttgggattttaggaatgagctaccctgcctggccaatttttactttttaataatattttttcctcaaatattttctctcccagataattcttctattgtcttacttttttttttgagactaagatcttgctctgtcgccaaggctggatgcagtgaaatcatcacagctcactatggcttcaacctcatggactcaagtgatccttccacatcagcttcctgagtagctgggactataggtgcgcacaactacatccaactaattttttaattttttgtggagatggggtctcattatgttgcccaggctggtctcaaattcttgggctcaagcaatcctcctgccttgccttgccaaagtgccagcattacaggcatgagccactgcacctggcttgtcttattttttcaatttcttgtttcatagagtacatgttctcttaatttatagagagtaaaaagcattaatcaaattttatctttgcttcttgagtagttcttccttcaaagtgtattttcatctgacattagcttgttatatgtatatttaaaaaaatctaggcatataggcctcactttggatcctttctgcttattaatcttttcatctttgaatgaggataagtccaatttttggcagtaaatccaataaggcttgatacatgctcaagtgttacatgcacacacacacacacacacacacgtgcacacacacacaagtgcatgcacacacactcacacacagtcaattctctctcactttctttccttttagtccaaggtctactataacttgacttgtcatgctgaatattgatggttgattatgtcttgatttgtcatcctgaatattgatggctgattatgtcttgtctaaatagctgagactacaggtgttcaccaccatgcctggctaattttttttatttttggtcaagatggggtcttgctatgtcccaggctggttttaaactcccggcctcgggcgaatcacttgaggtcaggagttggagaccagcctggccaacatagcaaaaccccatctctactataaatataaaaattagccgggtgtggtggcacatgtctgtaatcccacttacttgggtggccaaggcagaagaatagcttgaacctgcgagatggaggttgcagtgagctttgatcacacaacggggagagtgagactctatctcaaaaaacaaaacaaaaaattcctggcctcaaatgatcctcctgcctcagcctcccaaagcactgggattacaggtatgagccaccatgcctggccagtccttcggcattttagggtgaccagaagaaggagaagcaagctggcagcagtctcaattttgttacattgtcttgttttactggtaaacaatctatatctttagtcctcatctttctaaataaagggctgttgggaggaccattcaggaccagctcttttagtgacatctgcactctgccaaatatctggggataagtgcattacagcatggtgttctctatcagtctagttcagaacacaatgtatctggcaagcaaatatcatattctgtgctatgggattgtggctgatgcctagtttcattataaatgaagtgtgtatcttaatttttggttcatttaggcggacttcagagcggggaattatataaattggcattctctatcatttttgctggaagctcactctggtctgtaatgctatctaacaaataaatttttatttcattgttattgaatgttcattaaatgtccccaactagactagaaggttgctgagcacagggattttgtcactttcctagctatggtaagcacagggtaagcccaagccttcagtacagtacttgttgagtcaggataggtcaagagttgttatcagctgtgttctgtttactacctgtgctattaagggcttaatgacaaaagaaaaattgtgttcgatatgcctgtaacaacaactaagtgaatggtttgctctgtttctcctgaagtaggatttcacagcatcaaacaaacctttgcatttttccttaagaccaaagattcaatcactcttaatatctagaactattagctatcctttattcagttccagattgccttcataataatcatttgaaaattaccttggtgatctcatgttcatgtcctttgaaccttttcaccacatttccagttttccaattataggccacaactgtctgaagagagtgaagattgtagtttcattactcaattcttgttaaagtgacactagcctctactgcattctcaccttactttctccctcctcactcactccctctctgctcaggaacttgctcaaagcattcggggttccctgttgtggccgtccctcctcacgtgcccctcctttgagtttcttttctttcctcctggttgttctctgtctccctccgacactggaccactgctctaaacttactgatgggtttgggctaacattccccaaggagaactgattcccctggaggttctgactgtagatggtgaaggagaattccacataaggttagatttgttttccctatagtactgtatttttttgttgtggtgtttttttttttttaatctaccatttcaagctgggcgcagtggctcatgcctgtaatcccagcactttgggaggccaaggcgggcagatcacctgaggtcgggagtttgagaccagactgaccaacatggagaaaccccatctctactaaaaatacaaaataagccaggtgtggtggcacatgcctgtaatcccagctactaaggaggctgagacaggagaattgcttgaacctgggaggtggagattgcagtgagccaccctgcctggcctagattttaagacaaaatactgccaattaaactatgatacttcgatgcatcctgatttcagaagtgttaaaatgtgaaaagtgaaaacagggccaggcacagtggcgcacgcctgtaatcccagcactttgggaggctgaggcgggcggatcacctgaggtcgggagttcgagagcagcctgaccaacatggagaaaccccatctctactaaaaaaaataaaatacaaaattagccgagtgtggtggcacatgcctgtaatcccagctacttgggaagctgaggctggagaatcgcttgaacccaggaggcggaggttgtggtgagccgagatggcgccactgcactccagcctgggcaacaagagcaaaactctgtctcaaataataataatataataaaaataaaataaaatgtgaaaacatgcatcttagaaccagtggaatgcagtatgcaaatggaatttgaagattctaaaaggctattgaaaatgagagacattattattattattttttgagacagagtcttgctctgtcacccaggctggaggacagtggcccgatctcggcttactgcaacctccacttcccaggttctagcaattcttgagcctcagcctcccaagtagctgggattacaggcaagcgccatcatgcccagctaatttttgtatttttagtagagatggggcttcgccatgttgtccaggctggtctttagctcctgtcctcaagtgatccgcctgccttggcctcccaaagtgctgggattataggtgtgagccaccacacccggcccattattagtattattcactacaaaaagaattagcagttgtactaccagtatcccagctgtgagggctatgatagatcctaatatgaaggagagaaatgtgagaatgggaggaaggaagacaaaaacacagggaggaatcatgatgcataccagtgtagagagcataaaagaagagattagacagttccttttgctgacaattaactcctgtgtctccatgtaggtgtaacatgggattggtggtaagtataatctttgccatttatagaaagcatgtgggtggtcaggcatagtgttaagatctcacctacgttctttgatttaatctttaataaccacctgtgaggtggcattattattcccacttaacagataagactgaaactcaaaaaaatttaaagacttgtccaaacgaatgggaagtggccaagcagggatttaaatccagtctttctaactctaaagccaatatttttacacttgtcaaccctgctccagaaatgcaaatcctagacttcctttcaaaatatcttcctttccctgcaataaagttcatttcccgggaaacactgcaaaccccaccttatctttccctccagagacacaaaggtctgagttcaaagcagccacgacagagacggtatccatgtgagctgggctatactcttgaaaagctttagtttgaattctctcttctataatttcatcaggcctgctaaaaagagtatagaaaatgagagacccaatggcatgggagtggatgggggtggggtggggtggggtagggagaagaatgtgggttaagaaggcaattcaggccagactaaggagaaatatttaaaaaggagaagagaagggagacccatttacattgtcagcaatggtattatttactctgaaaatgtgcagaatgactgaaggactggaatctgataaagggggatcctgaagccaagaagccaggagtctttctttgctcacactagcaattaatcctgaagatttagggcccctctgtgtatgggtgcagacactagctaataaacttgactgtttctttcttttgagacagagtctcactctgttgcccagactggagtgcagtggcacacatggctcactgcagccttgacttcctgggctcaagcaatcctcccacctcagcctcccaagtagctgggactacaggctcatgccattatgcccagctaatttttgtattttttgtagagatggggtttcgccatgttgccaaggctggtctcaaactactgagctcaagcaatctgtccccctcgggcttccaaagcgctgggattacaggtgtgagacagcacacccagccctgactgtttcttatccaaaagaaaacacactaaactattcagggaaggccaactattcagggaaggccatcaacattcgccctgggccttctctttcttcagtggagagttttaatggggcatgataaaacctgggctcccaggggaggattgcagtacccgtatttataagtgctgtgtttgagtttgctttgctgtttccccatcacgacacaaaacctaaacgaaaccttctgtggaggagcttgtttcagttggcacctgagtagcagcatcccttgtggctgctggaagttgtgttccctgtttaataaaaagaagaatacatgttgttaattttgttaggcacaatagtatgatgttgaaaataaatccttttttagactaattaattgtatgcttttgcttttcctcctcaccctgcttcacacttacagccctgaggttgcagacacacaaaaacaaaactgattttaaaaaagactaagaagtcctgtaataagtaaaacacagaattgccatacggtccagccattctaatcctgggtttaaggccaaaaacacagaaacagatgttcaaacaaaaatttgtgcacaaatgttcacagcagcactgttcacagcagccaaaaagtgaaaacaactcaaatattcatcaacagatgagtggagaaacatcatgtggtcaatccacacaatgaaatattactcggccattaaaaggaatgaagtactcgtacatactacaacatgggtgaatcttgagaacatcatgctaagcaaaagaagccagacatgaaaggctacacagttcatattctatgtatgcgaaatatccatagttggcaaatctatagagacaaaaagcagattagtggttggcaagagctggaataaggaagagactggggagtgactacttaatagatacagatagaatgtaatacagagtatcttaataggctagatatagtttggatatgtgtcccctccaaatctcatgttgaaatttgatccccaatgttggaggtagggcttagttggaggtgtttcggtcatgtgaccagatccctcatgaatacttggtgacatctccctggtaattagtgagttctcactctattagttcccacaagaacgaattgttttaaaaaagcctggcacctccctcctcacctggttccttcctctcttgccaagggatgcctgctctcctttgcctactgccacggtggaagcttcctgagccctcaccagaaacagaagcctgcgtcacacttttcatacagcctgcagaaccatgagccaaataaactgcttttctttataaactacttagcctcagttatttttttatagcaacacaaacaaacaaagaggcagagtttccttttggagtgatgaaaatgttctagaactagatagtgatgatggttgcacaacaatgtctctatatactaaatgtcactaatcataaattttatgttatgtgcactctgccacaataaaataaatactaagaagatgtaatcaaaaataaaaaataatttacactactgaagcttcttgaaaaagaaaagcctcagttattctaaaaggttataaccttccttggttgttggattttttttttttttttttttttgagacggagtctcgctctgtcgcccaggccggactgcggactgcagtggcgcaatctcggctcactgcaagctccgcctcccaggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggatttttttttttttaataatttcactatggcacctctcagtgtgccagaatcatgaaatagatgttctgagatgctagaaataatgccactaaatgagacaatgtaggtaatgacctagactagcagttcttaaagtgtgatccatggaacatgggggattcctgagagcctttcagggagtttgggaggacttctgttttccaaccacatctctcagtgaggcccttcgctccctccctcccttccttcctctccttttctctcctccttcttccttcttccttctcctccttctccttcttctttctttctttttccttctccttctcctttctttttttttgagacagggtctcactctatcacccaggctggagtgcagtggtgtgatctcactgtaccctcaacctcctaggcttaggtgatcctcccacttcagcctcccagggagctgggactacaggcttgcaccatcatgcccagctaatttttctgtgttttttgtagagacggggtttcgccaactcctgggctcaagcaatccacgtgccttggcctcccaaagtggggccttcttttcttttaatacctcaacataaacaatagattataatagactgaatgcagaagcagatatcagagtccaattgtctcctttttaaggcaaacattagaaatttgcaaaaacataaagcaataccacttcttccaattaaatattttggttttggaaagtatatttatttttcataaaatgatgttttatgttaatatgcaataggtttattgctatttcaaaattaataagtaaatgtctttaaaatttgttttttaaaattaattaattaatttacttatttattttatttttttgagacggagtttcactcttgtcacccaggctggagtgcaatggcgtgatctcagcccactgcaacctccgtctcctgggttcaagcgattctcctgtctcagcctccagagtagctgggactacaggcatgcgccactacatcaggctttttttttttttttttttttttttgtatttttagtagagacagggtttcaccattttttggcaaggctagtctcaaacccctgacctcaggtgatccacccaccttgacttcccaaagtgctaggattacaggcatgagccaccgcacctggcctcatttatttatttttaaatttaacaaaccctgcatgtggcattcaatctcagttttaatgtcaaatgatggtagcagagcaggattcgaactcaatctataacctacataaacaaaacctctttgggggttcttaattttgaggagtgaaaagaagttctgagaccaaaaagtttgagagccagtgacttagaatttaaataatgttaatattggattatatattagaattaaaagaataatgaaacattttccagatttacttgtatcatccccctcaactaacgaggctagaactgaaaagaaagagaatgaattatgcattcaaaggtgctcctccactcattcagggaacacctcctaagcaccttatttgtgtaggtcctataccagttgctggtgaaactgaaaaaaagagaaacctgaagatgtgaccagcatgaacatttgctgggaccgaaggaacctaacgaaggaccagtctcaactactccatgtcatgtgtcccctgcgactggctgtgatatcagatagctgagggaagtatggggggcagtgggagcacccagtccccatttcttctgaggttctgcctaaaagttctaggaaataagtttcttatgggcatgaccaacctaattctaggaagaactgtctacaggaagaactgtttacagaagagaacagcagctaaaacgcaccaacttaatattctcattcataccattagcattaaaaaaatggagttttccagaagaatttcagcctacattttgagaagttgctagaattgacttcctgacgagaataggtaaccaatacagaaaagcacaatgcaatggaaacaatgtgagtggcatcaagaggcctaggatctaccccagccctgcctcatcccattatgtgtccttgagtagctccattccccactctggcctcagcctccccagctagaaaattaggacactatacgaaatgatttttagtagactatgtgtataatgagagaaggtctctcgttattcatctttgtaccccaagtggcttgcacagtactgtacaacaaaaatacttgtgaagtggcaaatctaaggtcccttccacttcagatattccaggattttctataagaggccacaagatgtgctgagaggcaaaattcaggatagttttcaaaaagtttgggatgtggtattgtttacagatagagggtgcagggcttcttatctgccagcctaacctatttttcaacattgtcatcaaaccaatgacagatgccattcatagatctaggtcactggaaattgcagatgctataaatggattagctctgctcaaaactgattggtatagtcagagagccatacttcccaagtaaaccatattcatgggacattctaaggaaaagataacttttagaattacttacccccaaaccaataggatcttcttggttagctgccctattcaataatttgtaatgtgtatcctttggaaaatagttcaggcagccacttcttaatctctgtaattagtgggaagccactgaagttaatctcttctctgtctaagcatgtttgcactgaaaagagatttacaaggtaaataaagaccttgtttattaaagagatggttaggtgtagttttccctcacaaagaaagaaatattttacaaaattccaagattatctctctcacatttccacaattcaggaaagtatactatagtgttaattatatatctatttttaaatatgcaaaatatatttaaatacattgttaaacattttgattttgctcataacatagtacttctattcatcaaaaatcttgagttgactgcttatttcagagtttactgcttttgtgaaaaaggcaatttctcctgttttaaataattctcctagaatttgagatgggagagcttttcaaaatcaccatatataaaccatttatttatttcaagatctgcagagtaagggtagaaatattatttgctcaaaattataactaagaccatttattgaaagatctgcagaataaggatagaaatattatttgctcaaaattataactaagtaaatctcttgacttctagtccagaatttccattataaatgtctacaaagaataaacagctttattgcattttaataactcaattttaagaattcaattaaattctaaatattgattgacagtgcagcttattctgagaattaagggcagcacagaatagtcagaacaacatttcattaaatgcattagtgtctgcattagataggactagttgtgaattatagctcaactgtggccttgggcaagttgctgaacctctctaagtctcactttcctatgtgtaaaataggataataactctatcattgacttctgtgaagattaaaaatagcacttaaaaggtaccaggaactgctctatgttttatatttattaactcattttatctattccacaagcctctgagatactgttactacaggttgagcatctaatccaaaaatccaaaatccaaaatgatccaaaatctaaaactttttgagcactgacatgacattcgaaggaaatattcattggagcattttggattttttttttttttttttttagacagaatcttactatattgcccagactggagtgcagtggtgcaacctgggctcactgcaacctccacctcccaggttcaagcaattctcctgcctcagcctcctgagtagctgcgattacaggtgtgtgcctccatgcccagctaagttttgtatttttagtagagatggggtttcaccatgttggccaggctggtctcaaactcctgacttcaagtgatctgtccacctaggcttcccaaagtgctgggattacaggcatgagccaccgtgcccagccacatcggagcattttggatttcaggttttccattagggatgctcaacccttaagtatataatgcaaatattctaaaatctgaaatttgaaacacttctggtcccaaacatttcagataagggatactcaacctgtatggccattttgcagatgtgaaaagtgaggcacagagatatcaaatagtttgctcaagtttatactgcaaataagtggcagagctgaaacttgaatccaggcagtccaactccagaggccctgttcttgaccagcatattatactgcatctctacaaaagctggtgcatataaagcttttggttcaatctggcaagttgttaacaataaattatggttactagcatgattgcaagattaacagtgatcatactggaagcagcattttcacccttgttaatactgttcataatgcacaaatattaatgcacaaatatacacagagaacacatacaaacggatatatgaatctagaggatattaaagctgaagcaaattatggcctctgatcagagtgattggacccaataaagctaagaattcattatgttacatagcaaggcaattaaaaagtctcaagaacaaagtatatgaatttgggttatatctacgttgttgtaatttatcatgagtagaataagaaataaaagtactactaagttatcttccactatttttattaggaacatgtaatatacttgagaggaggtataatttctggttcatttttgtatctatgatttgaccttagcctaggagaatgaacgcaaggcaaataaatacctgttgaatgagtgaatggaatactaagatgaagagtcggcttggtggtacgctattttttttttttttttctgagatggagtttctctcttgttgcccaggctggagtgcaatggcaccatctcagctcatcacaacctccacctcccaggttcaagcgattctccagcctcagcttcctgagtagctgggattacaggcgcctgccaccacgcccagctaattttgtgtttttagtagagacaggatttctccatattagtcaggctggtctcgaactcccgatctcagttgatccgcccaccttggcctcccaaaatgctgggattacaggtgtgagccaccgtgcccggcccagtggtacactttttagggacccaacaacataagcgcccttttaacctgcccaacaacatatcccttagagagcagtcaccctgtttcatcccaggctccagacccagaaaggctggagaggacatgggaaaatctacagattcagttatggctctggatgtccctgttggttccagttggaaccaggcctcggtctgaatcccatcacttctttctattccaatctgctttccaaaggccttgggatatccagtagtcactctaaaccaccctaaacagaaagcagagaattctcttttaactctccagtgcaatattccttgatatacaccagtacctatccgactgttctattccatgaagaaactgggactcagagggctgtgacttgctgaaggtcacaggggcagagccgggtggactggaccttatttccctggtcccgttaatgcaaatgctgatatcttatctccctccgtctccccaaatctccctctgcacacttctgtcttacactctgggagaccaaggcatctttagtcgccaaaacaatgctcaaagaaagaaaagtatgagtagaaacacctggaagctggtctggttcgaccctctaatggtacagataggggaaaccgaggcccagggaataagagggtcttgcctagagtcacacagggagccagttctaggccaccactctcacggttgcctcaaattttggggacgacttgtgtgcagtttttcctttctgtcgcttcagatggcaaatgctcctctccctgcccattatatgaacaactaaagcttaatttgtttttgtttttgttttcaagagacggagtctcgagtctcgctctgtcacccaggctggagtgcagtggcgcgatctcggctcactgcaacctccgcctcccgggttctagcagttctcctgcttcagcttcccaagtagctacaggcgcacggcaccactcccggctaattttttgtattttagtagagacagggtttcactgtgttgcccaggatggtctcgaactcctgagctcaggcaatccacccgcctcggcctcccacagtgctaggattccaggcgtgagccaccgcgcccggcctaaagcttattttttatgtgtatgtggaaagcggggagaagagtccccgaagatgggaacctagcgccacccagcccaaggttggccctcataaccgctctccgcttcgaccaaagggcgagggttgcccgctcctagtctgccgctatgcccctttctcccacctcaggctcagtacccaccggtgggctgcggggctggagctggggccggcgggaacgcggagcctgggggtgggaacagcctccgagccctcccgcgcctccgcccctagcagcaggcgcacgttgctagggcgggagtgctggagaaaagcctccgggcaccctcgcaggccgccgaaccgcagttccgttcgcctaaagctgggacgggaactgagcgcccggcgctactctcttcgtgatcaggtccagaggagaggacgcttgtgcccaggactccgctgccagaagaatctagacaatccaagcaaaacgggtacctttgtaatagctatggagaaagcacttaataaaggtcatcttttaaattattggtcgctcagacatacgtgttgccgtatttctttggagtttccctgatttcgactagaaattcctcctttggacactcccccagctccccactcctctattcctttcgttttttttttttcattgaaccattacagcctagtaccatagcaagaagagacccctcagtaccttcttgagatccaaatgggaagacagttgtagaaacacagtttttacagctgcggtcgcattgctaccagactagagtctattcatctccgtattcctggtgcacagtatggggcttggtatatagtaggggcttgttgaatgtttgttgaatgaatcaatggcagggatcctagccaacatttatttatttttaagacggagtcttgctctgtcgtccaggctgaagtgcagtcgcgcgatctcggctcactgcaacctctgcctcccaggttcaagcgattctcctgcctcagcctcccaagtagctgggactacaagtgcgcgcctccatgcccggctaattcttgtatttttagtagagatggggtttcatcatgttggccaggctggtctcgaactcctgatctcaggtgatccacctgccacagcctccaaaagtgctgggattacaggcatgagcctccgcgcccggccccaacatttattttgaaccctagtaggtgcctctgcagtgttgatctggcaaaacagccttcaatgaagatttgtggagtttctgaaaattgggtgcctttgagggggtgggaatggtgagagaagtttgcctccacatactggctattgggtctgttttccagtccagggaagggatcccctccatggcatccctgatgaagtatctgtagccctagttgatgctcactctgtaatgatgggctgattactttctaagctagtgacctattgttgggagatttccttctggcaggagaaagtatctacccgtatgccacttgaaactctgatcttcgctcagaaccaatggctctccttacagacttaatccctttcccccacaacagcctggcaagctacaaccaggatagactcactgctttgtcctgggacactgggctaggctcagtgcagctacagaggtgagttactagatctctgcacccaagatgttcctgctctggggatgtttttccctctgagagagaggctttaggcttcaggcacgaaagactcccaaactggtacctgtagccaggcctctccctgagtcggacctgtatatccacctgccacccgcccatctgcaactggcagtttaaaagacacctcattcttgacatgactcatactggaaacatcatcttcccctcaaacctgttccccctcttttccctgtaagtgctgggcactaccattcaccaatcacccaagccaaggatctaggagtcatttgtaactttacccttgcttcctcgttcaagaacaatccccgagacttctcaattctgcctcccaaacattataaaaataaaaaccttctctctacctaccagctggattcaggccaacatcagggtgtgatagattaaaaacgaccacaacttctttgtagctcttcccatcaaggctggctttgtaacttgttttgaccaatagaatgcagcaggagtgacatcgtgggacttctgagtttaagcttcaaaaggccttgcagtttctgctcccatcctcttggcacactgccagcatgggaagaggaccaggctagtctgtttcagagacatggcccatccaatagctagcaccaaatgccagccatgtgagtgactgttgcccatgctggagtgcagtggtgcgatctcggctcactgcaacctccgcctccttggttcaagcgattctcctgcctcagcctcctaagtagctgggattacaggtgcgtgcccccacatcccggctgattctcgtatttttagtagagacggggtttcaccatgttggtcaggctggtctcgaactcctgacctcatgatccgcccgcctcagcctcccaaagtgctgggattacaggtgtgagccactgcgcccgcctcagtgttataatcttatgggaccaccaggtacatgcagtccatcattgatcaaaatgttattatgcagcatacgactttatcctcagcttagaggccatctccctctctgcccccaagtcttccctacccattcctccccttctccagactgggttaactattcttcttctgtgcttccaaagcccccacactttacaccacatagtataacttttcatttacttctctctctcactcaactgcaagcaacagaggcagtgactgagtctcatttacacttgtattgttggtgtctaacccagggtctggcacagcactgcaacagaactttcaacaattatggaaatgttctatacctgcattgtctaatacatcagccactagccctactagctattgagcacttgaaatgtagctagtgcaactgaagaactgaattttacatgttatttattttaattaatttaaatttaaatagccacatgggcctagtggctatggtattgaacagtgtagggctagcacagagtagatggccattgaatatttttgaacaaagattacaagggaaagacagtcatgacagaccgttaggacatgatagaatgctatgggtataagcaacataatttcatatcgacctctcctggctcctcacttcacatcccctcaactttacactaccagtgcctttgtcttagtccattttgtgctgctgtaacagaatactacagactgggtaatttattatgaacagaaatgtatttggctcatggttctggagactgggaagtccaagatcgagaggctgcatctggtgagagccttcttgctgcattatgacatggtggaagacatcacatggtgagaatgcaggagtagtgagggaaggggacaaacctatccttctatcaggaacccactcccacaataacatcattaatccatgcacgagatcagagccctcatgatctaatcacctcttaaaggtcccatctctcaacactgttacaaggggaattcagtttccagcacatgaactttgggggacatgttcaaaccacggcagcctgtggctctgccttatttaaatataatcctagtttttggctctttatggcctgagttggttgttctctcctggacttgcccagattgataacaccccttctgtgacatgggctggtctgaagagccctctggagaagagagctgttctcatctagtttagtctggcctgagcagagagcactctgtcattgggaggcttggacttcatcatagaggacccatgtgatctgaatttgtctgcatggcaggctgccaaatccctcttaaaagtgacagttaaagctggctgtactgtgaaaacaccccaggaggaaaagaagccacagtattggtagtcttattgctgttcctggaaaccatgcaaaccccagtcagatgacttccagccctggcaccagagatattggatcagtgtctgagaaggaaggaggaatggacacaggcccaggcagaagggggctgggctgggccaggccagggccccaccaggcaggcagaaaaggctgggcctgacaccgaggagcaggcctgagggaaagtaaaggctagggaagaatagtcctttccaaaagactttccaaaatgttcattaaaataaaaagtttaggccaggcctggtggctcacacctgtaatctcaacaatttgggaggttaaggtgggaggatcacttgaggccaggaatttgagaccggtctgggcaacataaaaagactcaggtctctacagaagttttttttgttttatttttatttttatttttttttgagacggagtctcgctctatcgcccaggctggagtgcagtggtgcaatctcgtctcactgcaagctctgcctcccggattgatgccattctcctgcctcagactcccgagtagctgggactacaggcatctgccaccacacccagctaatttctttcttttttttgtatttttagtagagacagagtttcactgtgttagccagggtggtctcgatctcctgaccttgcgatccacccacctcgacctcccaaagtgctgggattacaggtgtgagccaccacacctggcccagaagttattttttttttaaagttttttaaaaaagatccaagccaaatgttataaatgagcaagtgaaagggcaggttagagagcaggttgtacacataatcccaattttgtaaaataaatatgttccagcttgtatcatatagtgggagctaatgaatgctttaacctatgtgtgaggacctgtaagtatatttgtagcagtttttcacacattgtaaatcgtgtgaggttctttgaagattggggagcagagttcatggtacagaaagacatcttgcacttgctagtcctctgtctggaaatctcctccccagatgttttcatgccttgcttcttccagtgccacttacctgagaggacttctacaccatcctttctacaccagcacctccatcatgctctttttcttgtaatacttgaatctttttcatagcccttatcattactgacattatattacatatccatttgttgcattttatttgtgcatgaaagtagactttgttcttcttgactgttgtatccccagtgtctaaggcctggcacattggcaggggctcaataaatctgttgaatgactaaaatgtaacaatggtgtccattcttctctccctagctcagagtgcctgaagttcaagtacagccctgcctatgcccatgaagcctccagaggtcccctaagagctctaagcagctttcaaatttttttgacctcataaagaagtacattcattctccacggtgcatatgtacgtatatataggccaaagacaaaattacaacaaatgtagttgagtgatcttattggcttttattagcacttctagaatcaggcaacacctaattctataaaacagaatgttccaatgagctgaacagaggacatgggctttataggtagaaaagagctggaaaaaaaaagaggattactcatttcaaagttactttccttttagggttaaaacagagaggacttccttatcatgccagctaattctgtactgtttggggattttaatatgctctctctttctctttttctctcccaatttcttggaagttcagataaactacttagttttggtttggtgaagtggcagtttagcatgagtaactccattttgttttggtttggtatggtggggcctagtgtggaagcccagtccaaaacaacgaccttccatccattttgtttacctatatatatgtaattgaaacaacaaaaaccttactaagagcatgttttctgttctttattcttttctttttttctcttttggagacagagcctcactctgtcacccaccacccaggctggagtgcagtggtatagtctctgctcactgcaacttctgcctcccgggttcaagtgattcttctgcctcagcctcccaagtagctgggactacaggcatgtgccatcacgcctggttagtttttgtatctttagtagagacggagtttcaccatgttggccaagctggtctcgaactcctgacctcaggtgatccaccttcctcagcctcccaaaatgctgagattacaggcgtgagccattgtgcccagccttttctttctttttataaaagatgctgatctccaccccttgaatttcttgatatgccacctaataaagggttgccactgccttagggcagtgtttctagaaacagtcaaggggctcctttgcatcctagtcaaggagtgactgccacagatgcagcttcttggcttcatcccagacttaatggatgaaaatcttaccggaaagtctgcgtgttttacaactcctcctctttcccctcctgaccatcccctgtcctccaacgattccgaagcctgataaagcttaagagctataaccggggagtttatgagtatcccagatgtgtcctgcagggcttgatgaacagatagggaaagggcgattctccagttccagtccaacttggctcataagtggtgaaacagaggaacccgacttgataaaagtaaatctactcctaccttagccctttgcatttgctgatgccactacctgaaagtaattctggtgatttaggggctgttttccagatcctggacctggtagggccaatgactgctctagggccacacccagtgaaggcccccctcccccccccccacctttccctaaggattttaacccttgttcctccccctgccctccacaacctcttttctttcttttcttttcttttctttctttctttctttttttttttttttgaaacagagtgttgctctgttgtccaggctggagtgcagtggcgcgatctcagctcactgcaacctccacctcctgggttcaagcgattctcatgcctcagcctccccagcagctaggattacaggtgtgcaccaccatgcccggctaatttttgtgcttttagtagagacggggtttcaccatgatggccagactggtctcgaactcctcaagtgatccgcctgcctcagccttccaaagtgctgggattacaggcatgagccactgctcctggccacacaacctcttttctttttagccttcacacaaaaagcacctcctattttctttgttttcaccatagggtttaataattccccatccccagtccttagaaggaaaaaattctaaccacaatctctaattaccatggcctatttccctccccacccccagaggagtgtagatgctgttatgaggccatcaccctcccactgggatgcactggaaacttctttagatgccaggaaagcagcacccctgtcgccaaagaacctcacacaatttacattctgaaacctgctacaactgtatttacagatcctcacacatataataaaaccttttattatcccctactgtatatcagacacccaaagtaaatactttgtagacaagatctcatttcattcttgaagtagccctctaaggtagatgatagtattattatcacctctgttgtagagataagaaaacagacacagaagctgtgagtaacctgaccaagatcccatagctgtaagctgcatagctgggatgaaaccaatgactatatttcactcagtgttctctctaatcatatggtgtaatattgtctatctggggtgacaatgtgtccccattggatgatgacaccactgtgtaccgctctgggtagctctggggctgttagctgcccttacccctcaggtgctaaagcagtagtggctgagaaggaaagggttctatctcctttgtgtggccattgcttagagaagcttcagagtagaggtgctagagcccctgtgagctatgggatgtaatgtttctctttcggtttagctcccgcctgtgttcagttctgatgcactcagagtactctctgacacctgaaggcctgggcccttccccttttgagagagtgcccagctttctgccaagactcctaagaaagaatttggggttggtggccgggcgcggtggctcacacctgtaatcccagcactttgggaggctgaaggggggagatggcttgagcccaggagtttgagatcagcctgggcaacatggcaaaaccctgtctctacgaaaaatacaaaacttagctgggcacggtggcatgtgcctgtagtcccagctactcaggaggctgaggtgggaggatcacttgagctggggaggtcgaggctgcagtgagctatgattacaccactgcactccagccagggtgacacagtgagaccctatctcaaaaaaataaaaaaaaataaaaaaaaaaaagaagaagaagaatttagagctggagagcagcgttctccttgtatgcccagacagactagactggatccccagcagagggctcaatctgggctcagactaatatataagatcctgagggtgggaaaagccctaaacagctcaggaacatgttagcagtttttctttctggggtgggagtgggtggatttttcttccacatgcttatttgcatattttgttttcttcgaaataaaaaggcattactttttttcaatgctagtttaaaaagaaaactcaaatattcaaattcaaaaagtttggatgtaaatactttgggaaaatcagcctaatacagatatttctcactgggcctcaatgttcaatttaaaaaattattaattatagtaaccttaagtcacactgcctaggttccaatctcatagctaccaattagtaactgtgacccttggcaagccacttaacttccataaaaatgggatcctaatagtactttcctcgcactgttagtagacacttagcgattgcagctgctatgttccagatattgttttacgtatttagcgtatttactcctcagacgtctgggaggcaggtactctcaccccattttacagctggagttcccacccagtgagcagccaaacgggatttgaaccaggcagtttctcagcagagccttgcttgaagctaggcatctaaagctgcctctcaaaaagggcagtggtcgggattacataacagaacgcttgcaaagctctcagcgaaagcctggcacttaataagtgctcaataaagtttcctacggtcacagtaatatttggagttttatgtttgttgtagaacaaatacgcatacaatcgcgatttcattcaacaaggaatttaaagagacctgctgccccgggcgggatgggagcgcgggttgggtgggaggaggcgcagctgcggggcgcgctggcgcaccgggagggccgggggcggggtcagccaggccccgcccgccgccacctgcgacaggtggagcgcacggggcgggcgcacggccatgtccgccgagggcgcggagccggggccggggtccgggtccgggcccgggccggggccactctgccccgaacacggccaggctctgagctggttctgcggctccgagcgacggcccgtgtgcgccgcctgcgcggggttgggcggtcgctgccgggggcaccgcatccgccgggcggaggagcgcgccgaggagctgcgggtgagcgggtgtgggcgccggaaggcgagggctccggagaccccgggcgcgcctggcgggacccggcagggactggggagcctggggctgggcggactcgacacccggccccggagcctaggctcctcggtggctttggctgtaggactaggcggttaagggtgtggcctctgaagtcaggctggcctgagttcgaatctactccctgtgagtcacgtaactctgagcctcagtgtcttcatctgtagtttggggacaacaacaataataatagcgcgtatttattagagttgtgagaaataaataagatagtgggtaaaatgcttagcgataaggggatccaggctccccaggccccttccattgctctgttgaggaagctggggctggcatgaaaggctcagctgctccagttctcagcgcagggtgtgccccagctcccgcccctgtggaaactgacactgataaaatccagcgcgaccgtatcccttaacccctggactcaaa

SEQ ID NO: 313 - DNA, 132003 bp, Homo sapiens
catatcatttgtacttcttgtgaaatcactgttcttctgtagggaagctggaaaatacaacaaaataatctgttatctaattgaaagcattctttgctgtaaaaaataaaaattatttctaagagtcttgctttctccatttctttggctgtagtgtgaagaatggattaagaaaggcaagacttgagaaaggaaaaacagaaaaaggctgtttcaataatttagatatgatggtggcctaaactaaggccatggaagagagataggacacatgtgtattcaaaatatagaagggcttggtactgactgggtatcaggggcaatggagagaaagatgtcaaatatgatacctcgatttctggcttgttcaactgggaggtagggcggtcatttgctaagaaagggaccaaagaagcagaaatggttctgtcatcagagaaagctactccatctttggatgggtcaaaatcagcatctttcatcaactccagagggacgtctgtattaccatgcttagcacatccacaacataacagctattgagccatgtattaccaaacttcttcccttctttggagatttatagtgcatatcttgacaatgccagttttaacatagcactgcagtagatctatcatcagtggctatggattgggcttctgcacaaccccagggatattcagccaagggacgatccctaccttggatgtcagatggactctggcatgatcctgctatcaccacacttgatgcccctaggtgcaaagtagtcccctcttctaccagctcttaatacctcattagggctcatttagtttgggatggaaggctggcaatacttgagctcattctgtgacctaatggaggcaagttagacagccaagtagctacccagatgaaaaagctcatgacaataataaaagccctagatgtgaagcctgaaattttggggcttattttccccatttgtatattgagagggttggatttaattgttaaaagtcttctctgcacttgaaattatcagtcttgctataattgtctgattatgttactcccacctcacaaaccttcagtggctcaccattacctccagaagacaatccaaacaatatcacatttaatgctttccactcaggtacccaaacatcacttttttcacatacctcaaggtccatgaaaggctaaccaactgaaaaggaatctttccatcttttgagtaaccacagtttcttttttgcacctctcacaggagcacttaatccctttcatttggagatggacgtgatttttcttcctcattctggtctgtaactcagtttactatctatgtggcaattattatgtgtcttatttcaggtttccttcggatagctctaacaaaataccagagactgggtagcttataacaacagaaatttatttctcacggttctggagcctgggaagtccaagatgaaggtgacagcatggtccggattctaggacctctctctgtgtcctttcacagaagatggggcaagctggctctctggggtctctaaggtcatcaatcccattcatgagggtcctgccttcatgacctattcacctcccaaagaccccatctcctaatttcatcaccttgggggttaggatttcaacataggagacacaatatgtaattttccgctctgagttttaatttctccatctatgaggagataataatctgtgttttataatgttattgtgaagcaaaatgagttaacacaagtacagcacctagaataatatataattcaataaataataaattaacaatgtcatgaacaagggattagaaaatattatttttggttgggactagctactatggatgactcttctgtataactcttaatctcaaaaccatccataaatttgcactgctgtcgtctttttctttcctcccttccttcatcctttccttgccttcttctttcctttcatccttccacaaacaagttctaataaagaaaggtcttatggtactgtttcttaaagtgttttcttcagaacatgagtctttgcagatggtctttgaatattttttaaaaaggattccatgatagtagtctctttctttgagattaataatgcctactaatatagtagagcccagagaagacttatagttatgaaatttctttaactttgtttaattcaatgttttcacaacttatttgatgttggaaataactccattgtgaaattgattaacatctgggattgctgtgaatttctagagtagacgtatctctagttctcctctgtcctgacacatggtagggttgtatttctctgctctttaaaattgggcaacaccatgtggcatattttggcaaataaaatgtgagtggatgtgacatatgtcacttctgcctgaaatttaaggatcggtgtatgatcctccagttctccctcttcctggctgtggttaccaacaacattcctgatgtgggaacctaatcactgagtcagaacaatatggagcataactgcccactgatctgtaatgaatatgtaatatgaatggaaaagaaaccagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaactaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccggaatctacaatgaactcaaacaaatttacaagaaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaatcacaatgagataccatctcacaccagttagaatggcaatcattaaaaagtcaggaaacaacaggtgctggagaggatgtggagaaataggaacacttttacactgttggtgggactgtaaactagttcaaccattgtagaagtcagtgtggcaattcctcagggatctagaactagaaataccatttgacccagccatcccattactgggtatatacccaaaggactataagtcatgctgctataaagacacatgcacacgtatgtttactgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattgtcactcgtaggtgggaactgaacaatgagaacacatggacacaggaaggggaacatcacactctggggactgttgtggggtggggggaggggggagggatagcattgggagatatacctaatgctagatgacgagttggtgggtgcagcgcaccagcatggcacatgtatacatatgtaactaacctgcacaatgtgcacatgtaccctaaaacttaaagtataataataataataaaaaaaagaaaaaaaaagaaacctttatcatttgaagtcactgagatttggagattgctcgctataacaacataacctggcttatcctgactattataattatcttacagttatttacatgttacagatggagagaacgtttataatgattcaagtttctagatcaaagcaaaataagttatttggccttaacaactggaataaattaccacattttcaatatgattgattatatgaaggcctaccattaatgtgtaccaaaacccaaattaacaaccaaacaatgaattcagtaaatatatcactcacttatttaccatttataaaggaactatgacgacagtatacttaacagatggtgtttggaataggttggcatgagttgtatatactgtttgtggcattggattttggaaatcagatatcagttcttccatttaatatttatgtgaccttaatactttagattttaagacatacttaaaatctctgaatctcagtttcttcatttgtaaaatagagataataatacaaactttattaggctaattgtaaggattaaatgatccaaagagtgctgatcagagtctctagcacaaggaaactttcaatagactgatcattgatggaaattataatggtgggaatgccaccaaatagaaccttggtattagaatgttaaacttttaggattgctactctagttcccagctaagagaccttgaggatgtatttaacctgtaatttggttttctgatttgttacattgaaaaatatcacaggatcaattgcggtaatgttaattatagctctgataaattataaagcatatcacatataattatttgatgataattatgattatgatatcactatatataaattcattagcaaatactaatttatttttgttattttctgacacagatagtagctgctcatcgttggctaatacttatttttaatgcttctagacagagtcttcattaagatgcgacgattcttccagcttttcctagaagtcattcacaactcctcattttctctcacactccattgactaaaccttttccatacacaaacatccactaaatcaccaagtctctttggttctaccttctaaatttctctatgatccacccactgctctctatcccctctaccatgacctcaggtttcattggcattgctgcaatggcctctcagttggccctgtcatcaatccattttccatactgctgccagaatgatctttctgaaactcatgattatcacccatctctaaaaccccccaacagtttccctgaagaaaatttccaaatttctctaatatggcctgcaagacatttcatgatttggcctctctctacttgttcaggttttagatatcctcgaactctaaatggtccagttatatcaaatgccttacagatattgaagttccatattctctttttccccatctgaaactcctttcccttgactttttaactctggttaacttatgaagaatgtgtgtggaagggatactgaaataacattatctagaaaagtttttgcatgattttatagattaaacttttttaccactcattacagtgatgtttttaattccctatcagtaaggattaaaatgaccagctgacatacaacttaatagcaataataataataacctgaataaaaaataggcaaaggacctgaatagacatttttttcaaagaaagcataaaatagccaacaggtatatgaaatgttgaacatcactaatcatcaggaaaatgcaaatcaataccaaaatattacctcacacttattaggatggctattatcaaaaagagaagagactaatgttggtaaggatatagataaaagggaacccttgcacacagttgatagaaatgtaaactggtacagctaatatggaaaatagtatagagagtcctcaaaaatttaaaaacagaactactatgcaatccagcaattctacttatgggtatatacccaaaagaaataaaatcagtatgtcgaagagatatctgcactcccatgttcattaacacattattcacaatagccaagatatggaatcaacctaaatgtccactggtggatgaatggatgaagaaaatgtgatacacacagacacagataaatattattcagccataagaaaaggaggatattctgccacttctgacagcatggataaatctggaggacattgtgctaagttaaagaagtcagacacagagagacaaacactgtattatctcacatatgtggaatcttttttaaaaagtcaaatttataaaagtgtagggtagaacagtggttgcaagggactggaagatggtggaaatggggagatggtcaaagggtgaaaactttcacttagaagatgaataggttctagggatctaatatgcagtatgatgactatagttaatactgtattgtttacttgaaatttacaaagagatcagattttaagtgttctcaccacacacacacacacacacatacacgcatacatgcacaaaaaggtaactaagggtgatgatggatgttaatttaattgtggtaatcatttcacaatgtacaattggaatatatacaatttttatttgtaaattaattatactttaaataaagctgggagaaaatccaaaacaaatacacctaaaataaaataaaatgagcaactaaaaatgttttttaaaaatgtatcttaaaaataataatttatatttaaagctttattttgtatgaacagagcagcagctttcttatgtttttgttgtcattttaggcttttagaaataaagactcaataaataattggaaaattcaataaaattattatcagtgagttctgatttaaaaccgccagaacatcctggaatcctctgttctcctagtataatggcaccatgtcttttaatagttgacttatttgaggaaaatacagacatggtgaaagtacatttttcattagttgttctggatgttgcataaatgtctcacccatttagaaaatgcagtgttccttttttgtaagattcataacaatgttttatatgttccaagttaagggatacattatgctttctatttaacccaggaattcatttaatgtaaactgtcagccttttagttttatcactaaatggatatgtcaacctaaagaaatgaagactaatagcctagtaaatgttctatggatttgagggtggatttgacattgtacaaaatcctaaacaaacaagaaaaaaaagcctaaatattgtgtgaaggaacaaatgaggtcatcaacatagtctgcaggaggagtggagccttggcaaagactcagtcaaccacaaagggcaaagaggttctcagaccaggacatggggatgtggttctggaataatcagaatgagagctgccgtttttgagtgcctatcatgtaccaggcattttgctagtgcttttacatcagagataaattgttccccaaatggctggcaggaacacagccttacaaagtagcagcaatactcgctctttaaaagaaagggatcataggttagtttttgtcttaaagggaaaaactgattttatattgctgtagaaccaaagacaactacgactgtgttaaccaactttccaggctgattttatgttttatatgttttccacacttaaaatgttttcttttccttctgtgatggtcaagatattttgttaggatttttagaaaatttaatttaaaatattatgccatcttgtgataaagggcaagcatgaacctatcatttccccattaatttgataattcatttattcaataaatacttgttgcattactactctgtgagccactgctctaggtgttgtaaatatagtgcagtgagtgaaacacatagttcctaccctcaaggaacttacagtctaggaaagagacaggcactaagcaaattattgtacaaataaacatttagcacagctggtacaaatcttcatttagaaactcagttatccaagaaatatatttgctagaattctgttcaatttttgactccaagtttccataccactcagctggcagaaataaacaacatccaaacaagttgatgtcagtccaacttgggcttggtttccttcctcttccctggacataactagagcatcttactctggtgtgccaaggcccttctgtcatcaaagagttggtgcctcctcagttgtctggcttcttcggttctagtggttctttgctgctgctgttgcacatcactcatggcataaggaatagttttcagagttcctgtggtccctcacgggtcttactacttcctggacaatggtttttagaagtagggcatggatcttctctgctctaaggatccacaggcctccctctttttctcatccccctaccctttccatccctgaggaaacttcacatttctctttatgtttaagatacttggtctatgtctcaaataccttttctaagtcctatgcttttatagaagaaaaatggatgtatttgatttactgtcgttttatatgtctccttcaacttataaacatagagctactaacttgagaagggaaaggtaatgaagaaaaataaggattaaaaatatatctcttaatattatccctcaataatttctgaaataatgctataagggaaatccacggtgacttgagaacagttaacaaaggaaccaaatttaatttgattgggtggtaggtcctatgagagggagcttagagagggttcttctgaggagatgagataggaactgggatctgaaagccatgtagagttaatgttttgaaggagagtgaggagtggggaggagggtgttctcaacagaaaggatacacgtgccaaggcctctcagcaggagaacatggaaaaaaaaaacaaatctacaagcattatcatttatggataaaatcttaattatagattatacgcacttgcattttggtgtatgaggcctcagcaaactatataaggcatcaaccatttattatgccaaaatggaaagtgtataagaactggtcagagctttggacttgagttcaagcttgaccagttataagttgtatggtctatggcatattgtatcacctcttcaaggcttaattataacatctggaaaatagagattatgataatattacaactacatgccccattagtctcataggattgctgtgatgatatattgggaaaatggatgtgaaagtgtttggcaaacggtaaagaactttcatgtgcataattagtatgttaataactaaatctattcagagtaaaattcaatattttcttttaaagagactcctcctgagataaaatggcaaatactaagtgttccattttctcacttataattatatgtaactacatagaggtgaaccaagtgaacacactaaatatgatacacaattatatagtagtgaatacaatcttccttttctgcctcaactggaagagcagctaacaatttactatcagacaacaataatgtaagttctagatgaaagatgcctggtagaaaatgaccaaatgaagtaatgaatacctagcacaaaatagaagcctaaagttagcacagtcaccactctctccttagatccctaaccagcacactagggtgtgtgtgtgtgtgtgtctgtgtgtgtgtgtgtgtgtgtgtgtgtgtgtgtgtgtgtgtgtttaaggataacataagatggctaatggcaggacagaattcttacccaattcttaaaaatgtgtggtaaacagagtttactagtaaagattcaaagccagtctataaagcaagcaaaataattccttctgaagtccccaggaggaaagatcttagactaaaaatttgatgctaacctattaagtatgggaaaatcacttaaggctgcagaagcagggatgagaagggtagaataaaataggttcagtgctttaggatcagtttcccaggatccaaaaaaaatagctttattttatacgcaggcttgaagaacaatggggaaaatatgtgaataatttgtaaagatcaaaagtacataataaaaaggaacacattttttcagttagatcaagttttttattttcttacacaaggtgttatagaaaatccaatctttcagaaagacaaaaacaaagataatcacaatgacataccagtggaaaatttataatcctaataacctgacctaggctctaaatccatgtaaaatttgccttgcttttgtttaagggattggtccaaacaaatggagtttatgaagcaatggatacttgtaaaaggtagttcccactgttgcactgattccagtcttggtttttaatatatacatattttttttccagagagtttagtgaatttcatatgccctatcgtctcctctccacttagaatgctttatagaacagcccatcatgtcctgtggcctcagtttaacccaggatttgttaaaacaaactgcatagaatggcctgttagcaatgaatatttggaggagtcactgctccccatctccaccccgatttccgcaaccttgctctagaactcttcataaaataacatcctgatgtggcctatagatcagagactttatattttctatctgggtccactgaagtctgggcttaaaatccagagctgattctgggcaaacagagaagagtaccctgttgtgtcccagatgaatttttctcactgaattgggaatgtgataagcgctggtcaaaccataaaattctgatatttactgtcatatattttgcttgccaaatagtctaacaaagttctatagcttcggctcttagatctaagaggataaaatgttaggtacaagaatccattattttcatctactaaaaactacgtaattataaactctggaaaacagagcctggaaagcagaagctttaaaatcaatagaattgtgtcttataaagattttggtttaagtgattctattaatttccaagtttcgcttctataggtataataattttctaacccatttagacattgtataagaatgtacatgtactcatatgtacttagaatatgatcaagagagtaggaatatctttagaaaaattaagaaaattccactgaaactcttaagaataactcttagattgtaaactaatcaaatatctctgaaataaaagtttattaaatttaaattaagtggaagttatacatcaaatattgttttctgaaatcaaaatctggtgtacagtatgtaatacagaatattggatgttaattccttttttaaaacaactacaagaaaaatattaggaatgatgaattatgctgattggtttgacttggatccaagcaaagtatccattatatctccctgaaaaaaaaaagtcacacaattacaatgcaataaaatgcaaattaaaaggtaaagtagtctttaaaatgccatttaaaatttataagttagtgatacacatatccaataagattgtaaaagggaaacaagcaaaggtaagtttaaacagtaatggttatttcctagtataaacctactctttccatgaaaggctcttttttttttgagacagagtcttgctctgtcgccaggctggagtgcagtggtgcaatctcggctcactgtaacctccgcctcctgggttcaagcaattctcctgcctcagcctcctgagtggctgggactacaggcacgtgccaccacgcccagctaattttttgtatttttagtagagatacggtttcactgtgttagctaggatggtctcgatctcctgacctcatgattcgcccaccttggcctcccaaagtgctgggattacatgcgtgagccaccgcgcctggccaaaagactcttttaatgaattccgataaacgattttataaagattcagtaagaagaaaattttggcagctcctatttaaccttaatgcttaagcctaaactttcttatttataaaatacctgttaaacttactgatatcttaaattctttcctgatctattaatgtttgacttagagagtagaacttctcaatttccatgtgggttttgttatttttcatttaatggtactgatatttgcactaaaatgggtaaaatgatcatatataagaggatgaaaatcaaagatgggaggtgagtttttaagcaagacagtatagtgaaaagataggagctggaagcagaagagtttctctatcacatagtaaatgtaatcttgagaaaatcattgaaatctttagataatgtgacataagtcagttcctattttttagcctgtactatgctatctttggcacttccccatcattcaagccatgcacaccaaatcagttgccaggtccatcaattctaaccttaatatgtttctcaaactcatctctttctacttcagtttctcacttgggcaaatgtaagaggtcactataaaaatttgttcaatgttgtatccttagaccgtgtcacatagtaaatattcagtaaatactaatacttgttgaaatttgttcaatgttgtatcctgagaccccgtcacatagtaaatactcagtaaatattaatacttgttgaataataaatcaatggtttattttttctgccttcagtgtctatcagcattaatttcttacatatattacagattcgtgtttctaaaactcttttttgaatatttcagttatctttttatttttccttcaatttggaaaaatgtaaacagcaagaacacagagaaaaacatggtaaacatttgtataatgaaccataatagtaaaaatagtatccaggagtgattctctacaggctgcctgcagaaaaggagttgcttctgtaactctccattgaaactgacttctcccaagggcttaaaccataattctctacagctcaagacatagaccaccagcaatcctcatcatgccagtagaagagctggtgcctccccagtcatgaatgttaatgcagtggtaactcctgccaacagttagctacatcataaagttacaattggaagccttggatcccagtctcctgttcatgccagacgttaggctggtgttacccctaaccatgaaccctaagctggtaggacagggctggagccaacctttggccatatcctaccacaaaagtattctggtccttgctgtcatcgggaaggggccagagtttcagaaatcatgtcacttaatacctccagagggccaggcatggtggctcacacctgtaacaccagtgctttggaaggccaagatatgaagattacttgaggccaggggtttatgaccagcccgggcaacattaacaagtccctgtctgtacaaaaaattaaaataaattttaaagattaaaagttaaaaaaattaaaagtagcaattagaaaaagtgatactaaccagagtcctgaaaggcactgataaaagatagtttcctttgtatacctcctaatactgttcttccctttccctcacgtcccgggggcagcctttatcataaatttggtgcacatctttcatatagaatgaaatcataaggcttccaaaattttgattcactcttggttaaaattaatgaaaaaattataggtcataatgttacttgacaagatatcttggtaggaaataatgtttttgacattactttgaaacttcaaattattattatgactataattctccataagcgaagaaagaaaaggtatatcattaacatttggctgtaagtaacaaaaaaactaattaatggttttttgttgttgtttaatctcccaaaaaatataaccctaagcctttcaaatatagtgaccaaaaacatgaaaaacatatttgtatccaaaaattatatttatttactaacaatatgaaattgatttgttaagaaaattattcttaccagccttgaaatcacacacacacacacacacacacacacacacacacacacacacacacaggtttgccaaaaatgttcagattctctaagcttagctttctgcttgtagagcatactgttcaaattaaaagattgcataaccaattcaaatccaaacacaaaaattaagtatttttcttctatattccagtctatattttatacttttaccaactataaatgtgtctactaaaaatatgtttttatttttgtgtttaaataatacttacatatattataacatattgtacttactttgtggaaatttgcttttatcactcaacactgttttttaaatgtattcaaaatttgtcatattaacacattaagatataggtcatttaaatctctgtactgtaattacacatgtgaaaatgtcatattttatctatccagtcttccactgatcatcatttgggttgttttcaatttgtcagtatacaaacaaggctactataaacattgttttctcattagcatgtttttcacaccattacccatgagttgaacaaagccctaaagatgtacagaatctgggctaggcctggtggctcatgcctgtaatcccagcacttgaggacgcttaggtgggcaaatcacttgagtccaggagttcgagatgagtctggataacacggcaaaaccccatctctacaaaatatacaaaaattagttgggcattatggtatgcacctgtagtcccagctacttgggaggctgaggtgggacaattgcttgatcccaagagtttgaggctgcagtgagccaagatcaggccactacactccagcctaggcaaaagagtgagaccttttctaaaagaaaaaaagaaaaaaaaaaacggatagaatctcatctaatcagatggcatttaaacatctacaaaagttgtaatcctactgcataggaaaactgtaataatttagaatttaatgatacagtaaatcaatgaattgaagtcaatcaagtgatccagcaacatgggcaaggttgcagacttctgtgagatgatggaggacttaggtaatgtgtaactacaatttaggagacatggactgggagacaaatgcactggagcattgacaaatcaacagtaaaacagggctcaggctggcagctaaggtaattaggtaaatccccttaaatgttcacaatgtcaggcttcattccctggctaaaatcttaagtcaagatgcatcttggctagttgtgaaaataatcttcaaaactacttataatgttaatcttttttaccctgagaagaataaacactgtgtaaaaaatgatgcagcaaatgaaacagataactttagtatttttggcattaaggaatgtatatatttttaatattttaaatattcattatatatatgagaatttgccatattggaatgtctaacagaaacatttgcttcttatataaatgtgtaattttggtaattgatttagacttacaatcatggattgaaatcttactaatttgtaaacagcattggaatatttaagaaaatatagtattcatcacatttaaaatttttaatttatgaaattactaagaattccttaagtatctgagacttgtttgtccataagaaaattgaagtacttaaaagtccaatatattaaatttataaatgagatttaaaatatttaagaaaatttaattaaattgcaaaaactcacttagcatgtattaaaatctgctagacttaaaaagagaataacaaaatatataatctaaatgtaagaacttaagatgaactgttcgttttttgtaaatcttatatcatttgaatatgaatttttaaaatcaaagtagactgagtaatcttttgtacatataaaggctactgtagagaacattagaaataagaaataaattggccaggtgcggtggctcacgcctgtaatcccagcactttgggaggccgaggtgggcggatcacctgaggtcaggagttcgagaccagccatggcgaaaccctgtctctactaaaaaagtacaaaaattagccaggcgtggtggtgggtgcctgtaatcacagctactgaggaggctgaggcagtagaattgcttgaacctgggaggcagaggttgcagtgagccaagatcgtgccactgcattccagcctgggcgacaagagtgagactccatctcaaaaaaagaaataagaaataaattgttaaaaacacctcacattgatacttccttatacatgtctcctattgtacatgtgtaagatgtgattctctatggcttgcatggtatttgaattttccattttatttcattgctttctgaagaggctattttaatttctattaccagtatataaattattaaattactcttatactggcccctttgccacttttctctcaagcaacttccttaccagtcaaaaaagtcaacttattagttccttaagatgacatgagcctttccaattccttatctttgctcgagattttccctcagtcaggaataacaattccaatttttccttatctgcaaggaaaaatcctaaacctccaagcatagctgaaatttaatctcctttgtgaaaaccttcacaaaagcattctcttattttccttttcctcttcccattcaccttccaaaagtcaattattctcctgctctgtgattctatagtagttcattatttctgttctttatgacttgattatagtttcttgaatatctattgtccctttcttagaaaccatgtcttttgcttgtgtgtttgttcattcagatagtcattcagtattcactgaatgcccattatgtgctagtactgcgctagacacttacatatatgtttccaaggggctcatactagtaagaaaaataagtgtacgaaatactgcaacttatattgatagattattgtcacacttgacaggttttatatatatatataatatacacacacaaatacgtatatacatttgatgaaaagaaaagaatcaacatgtcaatactcacagatttctcttccaccactatctccaacacacaataacaaaaattttcaaacaactcaaaccactcaattcccactcccaaccaccgcaaattcagagtttgtgggcaagttcttagagctcatgtgagatggactaagagaatcatagagactttttttttaaaaaagatgaatttaggctttgaggctacatttagaattggaggcttatggacaaaagaagaaaaaaagattactataaactatgtatttggattcacttaaacattttaagacatttgaataagaatggaattttcttttaatttcttttggtcattgagttgtgtatcttaggcaagtttcaatgtggagataaatatcccagttcctgttaaaatatctgatactcaataaatgtgtgagaaatgaaaacatgtttaatatcatgaaaaagccattaggattacattcctcagagtagactaaaattactatgtaagaaaaccaatgcattttgcaaaaaaaaatacagatgatatggaaaacaggtaagtaaaaagaaaaactaaaatttatccatgactccaccactaataactaataattgtaatacaaagcatgttaattttttctctagtttttcaatgcatatttattcaacaagcatttattgaataactactataagccagacactatactagcccatggcaatacaacccagaaaaaagagacaaaaaacactgttttcatagagttaacattctaggtgtgggacacaggcaattaacaaaatatataaataaattatgttataatgcatacataaatttatatataaataaatataaaatgcataagcaagtttatgtatattcaaaggtggtaaatgttatttaaacaataagtcatgaaagagtattgaatagggaatgtgaaagatagtagaggttgcaattttaaataagatgatcagtaaagacttcactgagaaagtgacacttgagcaaagatttgaagtaagtaaagaaataagccctgtgaattttaggctggggaaatgataagcattttattattttatttatttacttatttaacatttgtagtctgtatggttgggacagaactctacctcctacatgtgacccagatctaatcaatcatctgatttccctggccacatttccttcttgttggatatttatgttgttctgttttccttttccttttcttttcttatcatctcatgagtaatgctatagttaatttattttattaaatttataaacatttctataggctagtctcagaagtggaattactagttaaaaggaatcaatattctctaaacatttctctttttttttttttttttttttttttgagtcagaagtttgctctgttgcccaggctggagtgcagtggcgccatctcagcttactgcaacctccctctcccaggttcaaacgattctcgtgcctcagcctcctgagtacctgggactacaggcacccgccactacacccagctaatttttgtatttttagtagagacagagtttcaccatattggccaggctgctcttgaactcctgacctcaagtgatgcacctgcctcggtctccaaaagtgctgggattacaggtataagccaccgtgcccagccttctctaaacatttctaacagtcttgattcagattgtcaaattgcttccaaaaagttataccgatttctattccaaccaccagtatgagaggactcatcaaatgtttgccagtacagagtagtcttattaaaaaattatttttaaataaaccttgtaaatctgatatgtgagaatgctattagaatttaataatattttatcttttaaattattagtgaggttggattttaaaacatatttactagtcattttttgtgaatgacctgttcctgaccattgcccatttttttatttaagtcttggtgttttttcatattgatttgtgcatatttttaatattttaacatatttatcatatttgtgctaatatttaccagattattgtttataataacaatctaaacataagaaatagagaaaaaatgaaaattttaaattgaaaactttttttaaataataggcatctattgacactgagttgtctgtcaaagttcgacacaaaacttgggtatttgaagaacgtggaataagagaatatgataatgctaatccaacagaaataaatgcccatttcaggaacattggaaaatatctaaaaatagaattattttatgtaacaatcttttaatacatgatgtaaacttctttgaatatctttaagaattattaagtcccaattacatactaggcacaattttaggttatcccatataatatttacaattattttgctcaccaacattattattctcattatcttttacagataaataagacgaggctgaaaaaaaaaaaataaccctagtaggcaccatgtatagaagttagcaactcctggaatttatgttcttttattatattacacctaagatattgagaaatgtaaatcctttgcatgctacaaaagtataactgaatagactaataaaatgacacaaatttttttactcttgagtcttacccggccagtttccaaaacagtaggcatatttctcagttcatacacagaaacctgtccatcactgtctcctaccagaaggcaatctgtttgtttggcaaagagaatggttgtgaacttgattccagggttagcagtattcacaatcagagggtccaaactgtaatgaaatattttatttgtaaattcaattgttatattaatatggtcttttaaatagacaaagaaaaatttgacattttttaaattaaatgtaacaaaaaccataagcctatttaagtgtttccaaactcaaaataactgctcctcactccttactcaatcaaaaccttcatttcttcaatgaactaatttcaaccaggtaaattaaagtacttcacaattaagatgtgaactcataaatttaaacttctgtgatggttaattttgtgtgtccacttagctaggctatggtacccagaggtttggtcaaacatcagtctattgtaaagatatttttttcaaatacaataacatttaattcactagaatttgttttttttgttatttatttatttattattattatattttaagttttagggtacatgtgcacaatgtgcaggtttgttacataggtatacctgtgccatgctggtgcgctgcacccactaactcgtcatctagcattaagtgtatctcccaatgctatccctccccactccccccaccccacaacagtccccagagtgtgatgttccccttcccgtgtccatgtgttctcattgttcagttcccacctacgagtgacaatatgcggtgtttggttttttgttcttgcgatagtttgctgagaatgatgatttccaatttcatccatgtccctacaaaggacatgaactcatcattttttatggctgcatagtattccatggtgtatatgtgccacattttcttaatccagtctatcgtcgttggacatttgggttggttccaagtctttgctattgtgaataatgccgcaataaacatgcgtgtgcatgtgtctttatagcaacatgatttatagtcctttaggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattccggatattagccctttgtcagatgagtaggttgtgaaaattttctcccattttgtaggttgtctgttcactctgatggtagtttcttttgctgtgcagaagctctttagtttaattagatcccatttgtcaattttgtctttagttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtagcagtaccatgctgttttggttactgtagccttgtagtatagtttgaagtcaagtagtgtgatgcctccagctttgttcttttggcttaggattgacttggcgatgcgggctcttttttggttccatacgaactttaaagtagtttttccaattctgtgaagaaagtcattggtagcttgatggggatggcattgaatctgtaaattaccttgggcagtatggccattttctcgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggaattcactcatgatttggctctctgtttgtctgttgttggtgtataagaatgcttgtgatttttgtacattgattttgtatcctgagagtttgctgaagttgcttatcagcttaaggataattcactagaatttgaataaagctgattaccctccataatgtgggtaggcttcatacaattagttgaaggccttaaaagaaaagaatgatatccaccaaagtggaataaaattctacctgcagaatgcctttctactcaagattgcaacatgactcctgctggaaattccagcccgccagcctgcactgcagatttcatacttgataggacccactccttaaaataaatgtctctctcaagagatagatataaagataggaatatatagagacagagacaacaatagatctaagtagatacatacatcttattggttctgtttctctggagatccctaacacaacttcttaaataataactgtcttttttttttttttttttttttttgagacggagtctcgctctgtcgcccaggcgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcacggcctaataactgtcttttaacagaataatgtttttatccaaatgaacctctggaacgtacaagtacattttgaacaagaagttttcctagtcttcgtcatctaaagcaatctacctagtgtcctcaaaagaagacaagtagcaagtttgcatacttcttttaaaaatgtgttgtcctgggaattacagtttttccagaaaaattacaatcagaggtgggattatttaagaagccactttatacattagtcacctcatacttgtaatccttgatttgtaatccttggttcatactgttttgtaaaacaaaccaggacaaaattttaaagttactgaattatcaattcctagcaaaaaattttctcataaagaataaatccattgaatttgacatcatttctttcaaacaagaatttattttcttgcttttgctaaaaactagcataaagatatattataatttccaactgaaaaagcagaaccattaacgtttttatttcaacattgtattaagttttcatattaggaagaataaattaatttagacaatcctctaataactttggtgtaatatcttaaatcaaaaattttaattaagttcatacccctctgaatatttttgaaacaaggtaagagcataagtaaatgttgcaaaaataattactttgtcccttttttctactgtagaaaatttttagttaaaaatgtaaaaatgcctgtgtatgtttctctaaaccaggcaatgaataagaactcaagatagctattatatcctatatcgtcctataaaagtttgaggagatgagtaaggtaaaccactttctttagtcttttttttttgagacagagtctcactgtgttgcccaggttggagtacactggcgcaatcttggctcactgcaacctctgcctcttgggttgaaatgattctcctgtttcaggcttccaagtagctggaactacaggtgcatgccaccacacctggctagtttttgtattttggtagagatggggttttgccatgttggccaggctggtcttgaactcttgacctcaagtgatcctcccgcctcagcctcccaaagtaccaggattacaggtgtgagccactgcgcccagccaaggtaaactactttcattcaaatacttttaaaaccacatatggtataaataattgacattaatatagcatcctggcattatctttattcataaaggactctcataaactattacttcttttaaagtaactacaataccctctaactggtgtcaaaactatcaggtatcacttagtttgaactgcttctactaaaatttatgcaagaaaaatagtaacttacgtgctgatatgaaggtcccaaatctccaccctgttctcatttgcagctgcaaatatataggatgattttggagaccaggcaacgtcgtaaacaacagaagtagctggataaaaactcaaagatggcttgacattctcctgttgccatataataacaccccaatctgcagaacagcttaaaaatacatcatgacaaaatggattccatgtcactttatacactggaccctagaaataaaaaaaaaatacataggtaaataatatttaacatcttttattttaaacttgaccagcaaattaaaaatgctaagatttctagattttcacactattcattattgtgtgggcattattttagttgagaataagatcacagattgaatcttccctaaattattacatttagaaacataaaaatatagttgctacaatattcactaaatttaacacatattatgcatactttgaaaaaataaagagtattaagaaaaaaaagaaatgagggagaaaatgaagaaaatgtggctgaaacaatcatgacaagatatatagccaggtgcagtggtgtttgcctgtagtcccagctgctttagaggctaaagtgggaagatcaagtggaagataaagtggaagttcaaggtcagcctgggtaacagtgagacccatctcttaaaaaaaacattaaaaaaaataagctatagagactaggtatgggtgaaagacaattttactttaggatcagcatgttatcataagcaaagtcttttagaaacaaaacttccaaactttcaagaagaaatcaaggatatctagaagtcaaataaaatgccccgtacattattggtggtttccatagaagaaaacacttaattcaagatggtatttttaactctgaagttgtaaatttattgcatattacatattctgtatataatggtactgttttttcagaaatacaaaataaatgttccaacctactataattaaactaaccttatgtcctctgtaggtatctaagtattgttcattatatgaacaagaacatttgtgaatatgaccttcttcagtgccagccaaatagatatttgtgtcctacaacacaaaacatcgaaatgcattggcttgtgatacattagtaagtgtgataaatagaagattagatatttctggatctattaaaatcaattcaagaacccaaaataaaaacactatcttgaatataccaatcttgtctttttcttttgtcatgattttgtaataatcaaactacctgagagactactgtgcaaaagaaaatataaattggtcctttgctggaatcggggtagcatttaatatcctgtatggaaattacatagaaaaacactggcttaaaataaataagaaactttctaacatttagagctacctgacaatggaactagcagtccagggaaatagtaagtgctctttcattacaactattccaagaaaagacagatatacactttcaaactacatgatattgaaaaaagaaaaaaataaattatatgataaagtataatttctcccaaattggtattaccaatacatattcccagacagtcgtatataaaagtgatctgactcacattctcttcaacagttagttacatcagaaatattaaatgttgccattctattagatgtaaaattatatcacctgtttttaattcctaattatgtgaatatcaataaggtggagcactttacgttccttggccacttgtgtttcctcttattttgtgtcccgataattttagtaataatacgtcttgttatttttcatttgtataagttctttatatattctagaatctattgctttgtctataacatgttataaatatcttctctcagtgtatgatttacctttttattttctttttactgtcttcgatgaacataagttttcattttctgttatatttagcattttttgtgctttaagaaatctttccctaccttaaggtcctagagatattttcctacattttcttctgaaaggtttttgtgtatgataggatagaaatcgaattccttttttaatatggatacttattattctaacaccatttataagtggtcatttttcgctagcgatcttcaaggtcactgttgaaagttgggtttcccagcaaataaactctgagatttcatgccagagtgttagggagtgctctcaggaacaacctctatgtgggaaacaggaatgggcagatatttcagttgagccgtgacgcagttgcaatcaagggcttagtccaaagtataagaagctctggagagaagatggcccttcagagtcctgtctcaagataaggaggccagatattttatatatgcccccttcaagcaagatgttagactcaaacctaaccatactaataatcaaactaaatgtaaatgatcttagcagcataattaaaaggcagtgattttaagattgtataaaaaggtgagacccaattatatgctacctacaaaaaaatttaagtataaagagacaaataggttaaaagaaaaagcataaaaaatgacaaaccaggctaacaccagttaaaagtaagctgaagtggctatactaatatcatgctaagtagatttcagagtaaaaaaaatcacaagttataaatagggccatttcatagtgataaaggagttaattgatcaataggacataataatgctaaatatatgtatgtacctaataagaaagcatcaagatacacaaagcaaaactgatagaattacaaggaaaaatagacaaatctacaattatggttggagactttattacctctttctcaataattgaaagaagtaggaagaaaatcagcaaagagaagtaatcttgaacaacattatcagccaatttaacctgaatgacatttatagaatattctaaccaagaaaagcataatacatatttttctcaagtatacagggaatatttaccaatatagaccacatactgggctttataacaaatcttaataaattcacggagttcagtttataaaaagtattttctctaattatggtgggattgaattagaaattggtaacagaaagaactttggaaaatccccaaatatctggaaactaaataacatgcttctaaataacccacccatcaaagaagaaatcaagggtgaaactggtaatttgaacagaatgaaaatgaaaatgtaacatatcagaatttttgggatgctgctaaagcaatacttagggaaaaattacagcagaaataactacattagaaaagaaaaaagtcataaatcaatgacctccactttcattctaaaaaattagaaaaacaagaacaaattaaaaccaaagtaaagaaaagaaataataaggatcaaagtggaaattgatgataaagaaaacaaaaaaaaaatagtgaaaaccaattaagtcaaaagccatctctttgagttcaatagaattgataaacataagtcagactaatcaggaaaaaagagaagacacaaattactaatattaggaatcacagagtggtgtcatggtttatgcctataaccccagcactttgggaggccagggcaggaggatcacttgagcccaggagtttgacaccagcctggacaccatagcaagactacatcactacaaaaataaaaataaattaggccaggcgcggtggccgaagcctgtaatcccagcattttgggaggccaaggcagaaggatcacttgaggtcaggagtttgagaccagcctggccaatatggtgaaaccctgtccctactaaaaaaaattcaaaaaagtagctgggtgtggtggtgcacacccgtaatcccaactactcaggagactgaggtgggagaattgcttgaacccaggaggcggaggttgcagtgagccaagatcactccactgcactccaacctggactatagggtgagaccctgtctcaaaaaaaaataaataaataaataaaataaaataaataaaataataaattagctaggcatggtggtgtgtggctgtaatcccagttgtttaggaggctgacgtgggaggatagcttgagcccaggagttcagagttacagtgagctataatcataccactgcactccagcctagatgacagagtgagactctgtcacaaaaaaaaaaaaaaaaaaattagaggtgagattactatatattccacaactgttaaaggatgctaagggagtattatgtcaatagattccacaacttcaataaaatagacaaattccttaaaagacagaaattaccaaagctcactcaagaagcaatagataaccataataaccctatatatattaaaatttgattttgtagttaaaaattaaaaatctccccacaaagaaaactccaggcccagatggctaattctattaagtatataatgaagaaatcatactaattttatgaaaattctttctaaaaggaattctacgcaggcatgattaccctgatagtaaagtcaaagatgtcacaagaaaactatagatcaatctctcttctaaccaaagattcaaaaattctaaacaaaatttcagtatatcaaatgtattcgtatattaaaagggtagtaaacaacaatcaaataaagtttattccagggataaacattcaaaaaatcaatctacttcaccagattaacaaacttgaaaagaaaaactatatgatcatctttatacatacggaaaagtgtttaacaaaatccaacatccattccaaataagaaccacccaacaaactaggaatgtaatggaactccctcaatctgattaattctgtctacaaaaagccttcatctgacaccatacctaatagtaaaaggctaaatacttttcctctaagatcaggaacaatacaggaatgcatgctttcatcatctttactcatcactgtactggaggttgtaaccagtgcaatcgtacaagaaagagaaataaaggcaagcaggttagaaagaaagaagtaaaactgtttttatttacagaccatatgatcatcttgaattccttatgcaaaggacacctcaggacactagactaggttgtctcaaccaagcattattgacattttgggccagataattctctgctggggactgatgtgcactgggagggtggtggctgcctgtacattgaaggatatttagcaacatctctggcatcttcccagagatactggtagcccttccccaccctcacctcaattcctgacagctgcaacagccacaaatatctccaatcattgccaaatgttccctaacgggaaaattctcccctccctgcccacattgagaactagagtcaaagttaaggtgaattaaaggaatttgagaatgaaggaagttagaagatggctgtagtagtaaaagtaaaaaataagacagatctgaactacattagcaatagcaggcttgggctggaagggatgggacaatcaaattttaagtatcatttagatgatagggtagaatagaggagctcaagttttggtttgcataatgaggtagatgatggtgtcaccaaagagatgatcatattacatgtaacagaaaacatggaacacatgttctgaaaaagcctatcatagtggctgaatattctgattccaaagtatctccagactgatagagagtacaaggatggttaccagaggctgggaaaggtagttgggggtagggcagtggtggggatggttaatgggtacaaagaaatagaatgaatgaataatatctagtattttatagcacaacagagtgactatagtcaataataatttaattgtacactttaagagaactaaaagagtataattggattgtttgtaacacaaaggataaatgcttgaagggatggataccccatattctatgatgtgattattactcattgcatgcctgtatcaaaacatcacatgtaccccataaatatatataccttctgtgtactcataaaaattaaaaataaaaaacaaagtatctccagataaaagaaaaaggaggacttcattaactgtgctctgatttgatgcttggtaaacatgaaattaagtagtctttctaatccccaaatcctgagagtcaccacgtgaattgaaatgtagaagactatatacaagtggattaggtttctgtaagtatgatagagcagcagagtggccaaggggggcagggagaggcacttgagttaagcacaaagttgtaaagagaatttttccatagttactcagaaatatatacctctcatctatctatctgcaaaagcagataaagatcatagtatagccaactagaatgtaccattccaccttaggttagcagctaaatctgtcattttttcacttacaaagcacaattttaaaaaaaagctttattggaatataattcacatatcatataattcacacatgtcaagtatataatccaatagtttctagtttgttcatagagttgtgcaatcatcaccacaatcaattttagaacagtttcatcatcccccaaaaaactctattatcattagtaagtcattccctatttttccctccctcctcacctattcttccacctgcatcccctagcccaggcaatcatttatctactttctgtctctaatatattaggcacagtattcattaacaggctaatatttggtcttgttttatgacttaatacacttcaatttttggaaattgttatgtccagtggtaaataagagtgaaataatttaccttgggatgaaaagcaaaacacattccaggagcctgtcgagatatcaaagcttcatctttcttttccttttcccctccttttttgttactggcagctgtagttctctttaatcgcatcaaatctgtatttaaagaaaaacatatataacttgttatttaccacatgaaagagtaccgcaaatatcatgtgtgtttctcctgcaaataataatattagttctgccaacttttgcatgtaattaggctaaaattagcacacaccagaactagctgcttagaaaaaccatgaccaacccaatttttttcttattggccaaaccaaaatttgtcatctttcacacatggttaactagaaaattttaattcagcacgtaacaagaaaaatataacttgatttttcttttaccataacagtctagtccttttcgtataacccatttggagattcttccatctgctgatatagaaactagtatttctcttttgccatctcctgttgttcctcgatcttgttctatccactgtagttgccatacaggtcccaaatgtttttgaggtgattcactaaaacagtaaaaaaaatactaaacatataatcattataataatttcttaaaggccttggagtataagtgataaggtcagctttctagaagatcatgacctatttatataatccttttattgttcaaaaatagacttttattttaaatatttttaaaaaagaaaagacaaccacttttctacttaatactcactgttattttttgtacttcttacaaaagaaaaattgtactggtctttaactatattagctatcataacaggaatacaaaagcaaaaatgttctttcttttcagaatctacttttcttactctattcattaattctttctgacttttactttattttagacacatggaatataagtattttcatctttatgatgtttctatgaattaagttgttaatcatttaaatcttatccaggtaaacaattcttctttctatatttcactcttcctcctatgcttcaagattgcccattggtttgactctctctatggattagagttaaaatttttctgaaaaattaaactcacttctcagattactgactcttttcctatcagattaatgtgatgttcttttcgtggtactgactaccttgatttttaatacaaaccctccaatgaaatcaattctgaacatttttaaaatcatacatatctttgattttttggtgaaaattatggaccctcttcccagaaacaagcacaaaggcctatgcttacaaaactgcaaataatttgaaagttaagtttaggaacctctgctttaatggttatttctagttctagctaagtttattcaaacacttttacaaacatgccccattggtatcttgtctattacaaaaacctagcctttttaatatctttcacctctaactttttggctttcctcatatgactcatttattcatcaattactcatcaaacacttactggactcctgttacatgtcccatgttatatgacatgctgatgacagaaaggtatgtaagattcaatccttgctctcaaggaacttataccctccttagacagatagatagatagatagatagatagatagatagatagatagatagataagatagatttacatatatacacataaataatttttatatacaatgtgataagcactatgataaaggtatgtataggttgcacaaaagaaaggaatgggaacattttctggaagaagtgaaacccaaagcaatagtttaagaataagcataaactgtcaagtcagaggaagttcgttagtgagatgggcagagaagaagttgaaggagctattaggacagaccattccagctggagagacaatatgagggattatgaaatgtttcaaaaataatggtatcactctcagtaacaacaaaaatatttactcaaaactaaataacattagagtaaatcctcctgaaaaagcatgtattatacatttatctaattctcggattcttacctactatccagaactggaacattactgttgctccgtacattgtaaattgcaattgtgccattgtgatagccaacggctaaaaggttaggtgctccaattgaaaaatccacagcagtaactccatatggactctgataaatacgttctggccactaaattttaaaaaattacattttcaatttgtttttgtagaccacagtaaggcagaatataatggtggctgagatttagtttggtggcagtgggtatgtgagcagagttagcccacattcagttacttctgtcttcctaatttccagtatagaaaataataaaacctcacttggtcatttcctttgatacaagtatgaatcttcagcactcaatggctttaagaaatagagtgttgggcatgggggctcactcctggaatcctagctactagggaggctgaggtgggaggatcacttgagaccagcagtttgggaccagcctgggcaacataacaagaccctcatctcagaaagaaagaaagaaaagaaagaaagaaagaaagaaagaaagaaagaaagaaagaaagaaagaaagaaagaaagaaagaaagagagagagagagagagagagagagagaaagaaagaaagagagagagagaaagaaagaaagaaagaaagaaagaaagaaagaaagaaagaaagaaagaaagaaagaaagaaagaaagaaggaaagagggaaggaagggaggaaagtaggaagggaagtacagcacagccttctacaataattatattttggtaatctttcagcaggattagtatcaccatcacctgtctaccttcttatgggaacaaaaaactaatcatctagcatataattcctgtcttctagtatttgtttcagatgcttggattatctaaagaatgaacagaaaaagttccaaaactccccaagttactgtgttctacaaccccatgaagagtttgttttgtttgaatgtctaatttaaatcctttcctgcttttaaccacctacataaaaaagaagacagactactgatgatgaatccaatgtcaatccctccacatttaaaattgcttcttcttttcttttgtgctatataaacccagatctatatgacatatcgctaagtttattcaaacactgttacagctattacagactagagctatttataaaaattttagtcatttttatatgctcttctgacccttctctaagttttccactttgcatttcagttgtgaatttaaactaaatgtaaaactttaaagtaacagattgactagggctctttagcaaaattactactatgattctttatattcattctctttgaaaaatgtatgacagtaagaaggtcagataaatctatttcatatctgttcagaataacagtcaggtgataaggaggtattcatatattaagaaacaaccaggtatttaaaaaacataattttcagctgggtgccggtggctcacgcccgtaatcccagcactttgggaagccaaggcggctggatcatgaggtcaagagatcgagaccatcctggccaacattgtgaaaccccgtctctattaaaaatacgaaaattagctgggtatggtggtgtgcacctgtagtcccagctactcgggaggctgaggcaggagaatcacttaaaccccgggaggcagagtttgcagtgagtcgagattgcgccactgcactccagcctgggcgacaatgtaagactctgtctcaaaaaaaaaaaaaaaaaaaacataattttcaaaggattttcatttaagattcattttttctttataattagctgtgaaaatcaataatggttcaactcttcatcatcatatataacagcatatagtacacattcaataaatatttactgaatgaattaataaatgaattatctttaccctatgtcaacaagaacaaattttaattgctatgaagttaaaccaaagaaaatagtcttgattgataaaattttctagactttatttaattattacatgtaattatatattttatgagaattttgtcaacagccagataaaaatgcttcttattcttgtttgggttaccatgggattctttattgaccagcagcaagccagtcctcttttttgctctttaaatccaaagtgcccatagccaacagccaaaagatcctgaaaaccagaaaaatacatttaaaaataagagaagatagcattaaaatattggtaaatgtataaagatatatattaatgagctgtgttaaaaatagtagtaagacatttcatctgagaggaaaaaatgccagtacaccatctgtttttactctatacctccatattcctaagcaaaaaagttaatgagtataatgcttctcatttgcaggctgaaagataagcacctaaaaataaccaattgctaacaagttcttttacatattgaggtagtcttctgagattgtattaataggttataatatattctgagtttttgaggatgacttaattatttcaaatgtaaaataaaggacacttaagttaaaggtagctgccatagactgaattgtgtccccttaaaatttatatgttgaaggcctaacctccaatatgattgtatgtggagataggggttttagaaggaatcgcaggttaaataagattataaggatggggtcctaatgtgacaggactggtgactttataaaaagagaaaaacacaccagaggtctctctctgccatgtgaggacacagtgaaaaggcagccactgcaaaccaggaagagagctctcactgaaactgaatcagcagcccttggatcttagactttccagcctccagatttatgagaaaataaattgctgttctttaagacacccagtctataatatattgttacggcagcatgagctacctaatacaggaggtcatttcaagaaatgcatatgtaaatacaaataggcaaaagcttaataactgaacaaatccagcctctgctgtgtaaccagaatacctttaattttagaatattatattttcttatcaccaccttactttcaggccaacgtaatctctccataattccctctgtcttaaaaacagtcttcactactatatcctttcaccctgacattgacatatccctatttatctcttctagacgctgcagaggcattactttctctaagaaacattcaagagcttcttgtatgtgtccccacagcactgtttattttcctcatcatagcacatttgaaattattatataggcagggtctatgtataacttcattattactgtatctctagcgccttaacagtgtgccaggcacagagttaacgttcaacaaatatttatacaatgaattaataaacatagactccatctgtaatatgtttgtatttaggctcattcaaaattatttaatttaatctccatagcaatgcattaatttttaaaatgctagtatattcagtttctaaaaatgtttcatatatctttattacagatctattaaatcctatttacaggacaggaatggtagctcacacctgtaatcccagcactttgggaggccaaggcgggaggatcactagaaaccaggagtccaagaccagccttggcaacaaaacaagacccccatctccccaaaaaattaattaattaaaattaattccactaatccacaagacagtcccaaatatagttttataaagataaattcattataaaagtactttacttcgttacaaaataatacacataattaaaataatgtgttatttaggtttcaatggaaatgattatagactttctgttttttaataactatgacaactgtcttgtttgcacatagcacctgataaggtgtggcaataaaataataaggctaattcttaaacatacaaaatataatataatttaaataaattggttttgactgcttcaacaatataaatatttatatcaaagatactgccattgcctgaaaaattgttggaattgttaactgggaaatatcttcagaaccagtttataaaccccagaagaaaattagtctaattactctataattatctcttttttacaaccaaacatataattctccaacttgacaattcatcttatttgcctcaagatgacttttgtcagtgcagtagttaagagcaagaactatggagccagatgtttgcatttgaattctggctgtttcacctaccagttgtgtgactttgggcaaattatttatgctttttgtgcttcagtttcctttcaacataatgagaaaaataatagtacctaattcatagggttgttgtgttagtacggttaaaacacaatagtgcctgctatatactaagtgctgtttaagctcttgctaatatcggtggtaacagtattttaaagaatctcaaaattattttgcacacttgtaaggtcactagattaagtatacacttccaaatatgactactttgaagctaatataaatttgggctcatcagttttggtatacgttgaataaatataccaatcgtatagtttacttattcatatctaacatgaattcagagaatgccatgtctcaagtatatcccctaaaataaaaatggtaatgttttacatattaaatgtttactatattaaaggggaaaaacattattttgtaactatttgcatttccccctttttaaactggaacttgttttaggggcattctaaaactcaaagttatggtcaatttaaattccttgtgccatatctaaggaaaacaattcttcattattcgaacttgataatttcccttcaatgctagaaacagaattgttcaaatgtttgataacttactggatttgttttattccaggcaaggctgctcacattgaggcctttggttaagtcacaggaaaaagaccaaagtcgttccaagttggcgggtattgttgattcttctgcatgtatttcttcttcctcctccttcttagattcttcctctacctcttcatgttttgcactttctaaaacatcttcaggctcttcaggttcaggttctaaagtttaaacaaataaaaagatcattgtcctctacatctatagggacctgccaaaggctccaaacagcatatctacccaccactgacacttcaagcaccatcagatctgctggatcatatggtgcaagtggcagggcaccatgaagggcagcctggacctgtggcagagtcttctgctgttctgggttccaactcaaagccagcagcttttctgtttactcagtaaatgggccagtgtagcacatccaaatgacaaatgtgtggtctctaaaatgtaaagagactcactaggcattgtgcttcttttctgttgtaaaaggtgccaggtacaacttatccttcaccttagaagatacagctcaacatatcccacaccacacacacaggacacccagaaacttcactgaggtagaagcccctgaaattttgtcagatttacttcccacactctgacaggaaaatgtcttactgaagcctacttcctgtttactaagttcaaccagcatatcatccatttaatgtgctagtgtgttatcttgttgaagggaaagagctctgcagactaaattatgatacagggctaaagaattgatatacccctgaagtaagacagtgaaggtatattgctggcctgaccagctaaaagtaaatggcttctggttgttttttaccaatagacattgctggaaaaaaaagcatttgccttgtcaatagctatgcaccaggtacaagagagatgtcttaatttccttaatgaatgtcttacggaacaacagttgcaattggagtcaccaactggttaagtttataataataatccactgtcattctccaagatccatctgtttttaaatttatttatttttattttttagagatgggggcgggggtcttactctatttcccaggctggtcttgaactcctggcctaagcaatcctcatgtctcagcctcccaaagtgctgtgattacagacatgagccactgcacttggccaagatccatctcttttctacatatgccacatatgtgagttgaatgagaaatgtggtgggtatcaacatccctccatatttcaagtccttgacagtggcagtaatctctgaagtccctccaagaatgtgctacggcttctggtttactatcattatcattcaaagtccatagttttacattttaaattttagggttcacgcacagtattgtatattctataagctttgacaaacgtgtataatgacatgtatctgccattgtagtaccatatggaatagtttcactgacctaaaaatcttctgtgttcttcctgttcatccctctctggtccctcgtccctggaaactactgactattttactgtctccatattttgccttttcccaaaacgttatatagtcggaatcacacagtatgtggcctttcaaattggcttcatttgcagagtaataggcattcaaatttcctccaggtctgcttctggcttgataacttagtgatgaataatattccattgtctggatgtatcatagttcatttatccattcacctactgaagggcatcttggttgcttccaagttggggcaattatgagtaaaactgctataaatacccatgtgcaggtttggtgtggacacagttttcagctcatttagttaatcaacaggagtgattactaaatcatacggtaagagtatgtttgggtttttttgtttgtttgttttgttttgtttttgaagacagagtctcactctgttgtcctggttggagtgcagcggcaccatctcgactcactgcaacctctgcctcctgggttcaagcaattctcatgcttcagcctaataagtagctgggactacaggcgcctgccaccatactcggctaaattttttgtatttttagtaagtagagccagggtttcactatgttggccaggcttgtcttgaactcctttcctcaagtggcctgcccacctcagcctcccaaagtgctgggattacaggtgtgagctaccacacccagacaagagtatgtttagctttataagaaactgccaaacaatcttccaaagtggatataccattgtgcattcccatcagcatgaataagacttcttgttgctccacatctccaccagctttgagtgctgtcagtgttttggatttgcccattctaattaagtgtgtagtgctacctcattgttgttttaatttgcaattccctaatgaaatctgatattgaaaggtcaggtgtagtggctcacacctgtaatcccagcactttgggaggccaaggtgggagggtagcttgagttcaggagtttaagaccagcctgggcaacaaagcgagacctcatctctacagaacattttaaaaaattagctgggtgtggtggtgcacgcctgtggtcttagctacccgggaggctgaggcaggaggatcgcttgagccagggaagctgaggctacaatgagccgtgattgtgccactgtactccagcctgggtgacaaagcaagactctgtctcaaaaaaaaaaaaaggtggggggtgggggggaggaggaggaggaggaggaggatgaagaagaacaagaagaagagaatataataatatgatgttgagtatctttttgtatgctactttggcatgtgtatattttcttcagtgaggtatctcttcaggtcttttgcccattttaatcatgttgtttattttcttattgttgggttttaagagttctttgtatattttggataatagtaatgtatcagaaatgtcttttgaaaatattatcttcagtatgtgacttgtcttcttattctcttgacagtgtcttttgcagagcagaagtttttaatcttaatgaggcccagcttatcaattatgtctctcaatggatcatgcatttggtgttgtattttaaaagtcattgtaagatccaaggtcatctagtgtttctcctatgttatcttctaggagttttatagttttgcattttacattcaggtctatgatccatttgagttaatttttgtgacaggtgtaaagtctgtgtctaggttcgtatttagtaccatttgttgaaagactatcttttttctattgcctttcttcttttgtcaaagatcagctgactatattttggcagatctattactaggctctctattctgttctattctatatatttgtttattctcttgccaatagcatgctgtcttgaccacgatagctttatactaagtcttgaaatattaaatacctatattagacaagaaaaaaatgtgaaatcaatgatccaattttccattttaagaaactagaaaaggagccaggaacagtggctcatgtctataatcccagagtgggaacaactcttatttaaaatggtgctgaaacaactggagattcaaaaaaaaaaaaaaaaaaaaaaactttaaaccttaccttagtccattcataaaaaaaattaattcaaaataaataacatgatagatatgttaacgtgcttcactataatgatctttttactatatatatttatcttaaaacatcatgttgtataccttaaatatacacaataaatatattaaaaataaaaataggcctgggcgcagtggctcacacctgtaatcccagcactttgggaggctgaggcgggtggatcatttgaggtcaggagttcaagactagcctggccaacaatggcaaaaccccgtctctactaacaatacaaaaattagccaggtagtagtggcgtgcacctataatcccagctactagggaggctgaggtgggagaatcccttgagcccgggaggcggaggttgtggtgagctgagatagagccattgcactccagtctgggacagagagtaagactctgtctcaaaaaatgaataaataaataaataaataatccaatatagatagtagacctaaacataaaggctaaaactatacagcttctataagaaaactgagaagtacaaatttgcaaacttggggcaggcaaagatttgttagagagctcatggaaagaattaattacaaaagaaaaaaattggcagattagatttcgcaaaaataaaaaacttctgttcatcaaaaaaattttaagaaaataaattggcaagccatagatttaaatatttgcaaaatatgtaactgacaaagggtttgtatccagaatatataaaaataagctcttacaacttgattttttaaaagacaattcaggctgggcacggtggctcatgccctgtaatcccagcactctgggaggctgaggagggcggatcacctgaggtcaagagttcgagaccagcctgaccaacacggtgaaacccggtctctactaaactacaaaaattagccgggtgtggtggtgggcgcctgtaatcccagctacttgggaggctgaggcaggaatcactggaacccaggaggtggaggttgcagtgagccaagatcgtgcctttgcactccagcctgggtgacagagcgaaactccatctcaaaaaaaaaaaaaaaaaaagaaaaattaaaaaaaaaaaaaaaaaggcaactcaattttaaaattggtaagagacttgaccaaacagtaaacagaagatattcaagtgaccaaaataaaccacataaacaagaactcagtttttagaacaacactaaaaggattgccagcatcaggtgttataaagaatgtggagcaactgagactcttatacattgttgtgggagtataagatggtataaccactttggaaaagtatttcactgtttcttaaaaagttaaacatattcccaataatccaataatcccatttgtaggtattttcacaagaaaaattaaaatatccatttaccaaaagtctcacacaaaaatgtttgtaccagctttactcttaatatccccagactgaaaatatgcaagtgtccctcagtgtgtgaatggacaaacaaatcattatggtatattcatctactagagcattactaggaaaaaaatgaactacttatacatgcatcaacctaggaaatctcaaaaacattaatattgaatgcaagaagccagactcaaaagaatacttactttatgaacccacttatatgacataccagaatagggaaagttaatctatattgacagaaatcagagcaatgcgtgtgtgtgtgtgtgtggtgggggttggggggtggggttaaggtttacttggaaaacagcacaaggtaactcttagggttaatagatatgtcctctgtcttgattagggtattggtaactctggtttatacattttcaaaatgtatttttatatacaatttaaaatatatatttcattgtatataaatcttacctcaataaaacatttgctatggtatttttatttcttagatgtgttgaaagaagtgatgtgccaacagtaacatttacattgttacatttacattttgttttgtaaatgtcaatatatacagtactatgtgaattgcaaccttacaactctttaaatataggatgaaaaatctatatatataagtgataaaaatctttaaatatcaacctaatatgagagaaggaacacagtttttcaatattcttctagatgcatgcaggcaaaaagatttacaaccatttgtcacacatactattctgtaaactttttctttttaaatgtaaccatatagattaattttgacttgaagaatcaagataaatttcataaaggaagtttccttaatccatctttgaaagctggaaatacaataggcaaacatggggtggggataagggtagactgtcaagcaaattccaactaaaagtactaaggcaggaaaatgtaggttctatttgaggattaccagataagtctaaatatagctaacttttagagtctccaaagcaatatgataatacaaagtaatctgtggccatattgcagatatcttttgaatgatacactttgagctttgtaatttattctaggcaatgtgaaggcattgaaggttttttgagtggtttaggatacatcagcaaagtgggctgataaagtagaaagagaactggaacttgagatcaaaagaccttggttgaatgcctagcttttccacttactattaacctcacaaagtttctatagccttcagtttcttcattcatgtattttttaatacatgattaaaggttgattaagataatctctaaaatcctttaaaatattctgtgatcatatgagatgcgatttgtagcaatgagaacaggaagaatgcttctgcaatagatttgggagtagtaataaaagtaagaacttagaaagtaacaatgacaatggaaaagaagaggttgaatatgagagatactataaaaatgactaagtaattgaatgcaggaataagggagaagaaagagctatagatgcttaggaagttttgaatctaagacaatctgcttctgtgggcatcctagtctggactctagtgctactcacgcatttagtgctgaaagctttagaaacatgtcctctgataatgataactcaatctggagattacatttagaaatatatactaaaacccttacattttaaaaattatttgagtttgtctaaacatgatatcttctttttctttttttaagagacaaggtcttgctctgtcacccaggctggagtgcagtggcatgatcatagcttgctacaaccttgaactcctgggcccaagcaatcctcttcctcagcctcccaaagtactgggattataagcataagcaactgcacccagcctaaacatgtttattttttttaaataccttttaaaacaggaagctgacgataagctgcaagtttgggctgaaatatattttccatcagaacccgttccataaaaaataagtcctgatgaaatttgtcagattttaatattgcatctgagtggtcttcctcatcttcatggatttttgccagaattacattttctatgtccattagagaactagtttcactatctacaaaatacaaacatgatacaatgataaaatattcaaatggatggttcatacattctaaagattttaaaaatgacatttcatcatttgtatttattttcctccagtttccaacaactttaatagacatttattgaatatcttacgtaccaagcacatgaaagatgcacatatctcattttggaattcttaaccatcaaaaactgtactatttttcagaagataggcaatgataacctccagaggtaatttttgtctttattcttttaaaattcaagttgaaataagatgatcagccttcagaaaaaggtctgatttgattattgctatacagaaatactatactattgtattaagttttctcttgctgctgtaacaaatcacagtggcttaaaacaatgcaaatttatcttacagttcagtagattagaggcctaacagatgtcactgagctaaaaccaagaagttgatagggctttgttcctttctgaaggttttaaaggagaatttgtttccttgattttttcagtttctgggggccaccacaacctttccttcatcttcaaagacagcaacattgattgcattcccgctgaccttcttctgtcatcacgtctctctcccagaccacagctggaaaagatcttttactttttagtaccccatgtgattagactgggcccaataagattatccaggataatctctccatctgaaaatccccattgtaatcacatctggaaaatctcttttgccatgttaggtaacacattcacaggttccagggattggggtgtgcacaaatttctgggactattgttctgcctactgcactacttagtaaactcttattttaaaaacagaatgaaggaaactcttgcttctttatctttatagatagagggagcacacttttccctattcttcctgctaaattcaactaaaaacactggaaattttagaaaacaacaaacataagcagtctttgaaaggtgaagagaaggaatgggtatatatatatattccagatatggagctgaagaagtcagcaacctgggaacactgatgggcacaggcaagaaaaaaatccccaaaagaagcctcctctctttagccaaatgaccaggaaaagcatagccttgaaagaaagaaagcttttagatggcagccattctactccagccaagcacagaaaaaattgtagccccacccatgtgacgaaggcctagagggagcctagtcttacaccctcactaggctgtaacaaggtgtcccaaatccctgacctttcactgtgtatggtgtcagagaaggcccagcaggcaggcaggactttcatccctaccaaacataatgatagtggtccccttcctacagtgtcagtggagaccagctggggatcctggaattccaacctatccagtagtaacaaagtatacctccctcttcccactggagtagtcagagttggactggtgaagagtcaaaacttttatcactccccagcagtaatgagaacaacctccactctgttgtgtcagtgtaggccacatgtgtagcactaatgaagcattcttatatctcctagccatggtgttgtcaatggaaaccagagctcctatcactgccccatggtaatgaagacacaacttcccctgatgtcattggaggtcaagtggcaaatatagacttctactcccgcctggaaataatcaggcagtgactcccactttcccctgccagaacagtgtcaaacaaagcctgctaaaatggaagtttagaaaagatccagactcttacaataccccaaatgtccaggtttcaattgaaagtcactcataataccaagaaccacgaaaatgttaacttgaatggaaaaaagcccctatacaccaacatcaatgttagaattatctgacaaagagtttaaagcaaacatcataaaaatcattcaacaagtatttatgaacacacttgaaacaaatgaaaaaatagaaagtatcatcaaaggaatagaaagtcttagctaatgaatagaaagtcttagcaaatgaaaagaaaaaccaaatggaaattttaggagtgaaaaacataactaaaatttaaaactcaatggatgggctcaacagcagaatggaagaaaaataaatcagtaaactggaagagagaacaatggaaataacccaatctttaaaacagacagaaaagtctgaaaaaaatgaagactctcaaaaacctctgcaaccataacaacatatgtaccattcatatcattatcatccgaggattggaggaacggggtgagcctgaaaaagtacttaaagaaataatagctgaaaacttccaaaatttggcaaaggacaatagcaaacatattcaagaaatgaataaatcacaatgatgataaactcaaagaaatgcacaccaagacacaccatactaaaatttctaaaaacagaagaccaaaaaaaaaaaaaaaaaatctagaaagcagcaagagagaaatgacaccttatctttagggggaaaatactttgaatagcagcagatttctcattagaaaccctagaggccagaaaaaagtggcacacattctctgggttctgagtggaaagaatggtcaatgcagaattctatacccagtgaattttcctatgggaataattctatacccagtgaattatcctataggaataaagaggaaattaagatgtagtattctcagatgaaggaatactaagaatttgtctcaaaaaaaaaaagtcttccctaaagaatggctaaaggcagttctctaaacaggaagaaaatgagaaaggaattttagaacatctgaaaggaaaaaagaacaatgggaagagagaaaataaagataaatagaatatacttcttattcttttgagttttcttcattacgattgacagttaaagcaaaaattattacattgtctgatatagttttaaatgtctaaatattaaatgtttatatatctaaatatctttctaaatacttagaaaaaatatttaaggcaaatataaatgggggtggaatctaaagggaggtaaggtttctacgctttacttgaactggtaaaatgtcaacatctatggactattgtgtatgcataatggaatatgtaaattaaataataaaaaagctgcacataaactcaaaacactacaggtaaattaaagcagaatggtaaaaaaaatgtttggaaaagcagcaagaaagcaggaagaagataagagtgaaatataagatagataagatagaataagcagaaaagaacagcagacttaagggctaacatgcgaataaaaaattaaatacaaatggtctacatataccaatttagagataaagactgacaaaaaaaattggattaaaaaacatgactcaaacatatgatgtctacaataaatttatttcaaatatacaatgtagataggttgaaagtaaacaaataaaaaaagatatagcaggcaaacattaaccaaaagaaagcaggaggggctatatcaatatcatataaagttgacttcagaacaaagaaaattaccagggatatatagcaacattatgtcatgattgtaccaagaagacatagcaataattaatgtttatgcaaaaaaacaaggctataaaatatgtaaagtaaaaattattagaattgaaaagagaaataatggttatataaaattttgatggaataaagagacagaaaatcagcaagggtatatatgaactcaacaacatcatcaactaaaaagatgtaactaatatttatataatattccacctaataacagcagaatacacatcccaggccatacaacaaaccttgacaaatttaaaagaagagaaatcatagtgtgttaaaagaagagaaatcatagtgtcttctccaattacagtggaatcaagctagaaatcaataatggaaagacaacaggaagatctccaaacacttagaatcttaaaaaaacaaaatgctgtaaataatctgtgtcaaagaggaagtctcaagggaaataaaaaatgtatttaataatgaaaacaaaacacaacatatcaaaatttgtgggatacagataaagcagcactgagaggaaaatttacagcattaaatgtatacattagaaaagaaggaaagtcaagtcaataatctaagttcccaaattgagaatatagaagagaaaaaagagcaaaataaacttaaagcaatgagaaggaagaaaatagaagagaagtaaatgaagttagaaacaagtcagtgatataaagaatttcttccttgacaagattaacaaaattgacaatcttccagcagactgacaaagacaaaaagagagaaaaaataaattatcaaaatcaggagtaaaatagtagttactacagatcctacagacgtcaaagtgataataacaaacaactctacataacataaatctcacaacttagataaaataaaccaattacttaaaaacaactattaaaaattatattatgctattaataatataatttgaatattaagaaaattaaatgtgtaatttaaaaaactcacccacaaaaaatcaccaagcatggatggtttcactaaagaattcaaccagaaacttaaagaagaattgtcactaattctacataaccttttccaaaaatagaaaaggaaagaatacttgctcattcattttatgaaactattataataaagtgaaacaaagtgcaaaaaagaaagctacaaatcaatatctctcatcaacatcaacataaaaatccttagcaaaatattacaacacagaattcagcaatatataaaaagaattattatacacaatgaccaattgaagtttattctaggataaaagagttcttcaatattaaaaaatcaatcaaagtaatccatacgtttaggccaatgaaaaaaaatcacatgatcatatcaatcaatgcagaaaaatcacttgacaaatcaaccatttattaaaaaaaaaatctctcagaaaaatagaaacaagcagggtgttacggacagaatgattgtgtccctataaactcatgtgttgaaattctaacccccaatgtaatggtgattaggaggtaggacctttggcagataattaactcatgagagtggagccctcatgaatgagattagtgtcctgaaaaagatacctccagagagctcttttgctctgtgtctgccatgtaaggatacaagaagttagcaatctgcaacatggaagagggctgttatgatttttattgttataacttctttctaatttggtcttgagctctctcagtcaagtagctaaagccaagatagctactctctagaagggccctgaccaggaggaatggtaaattcaggtgtgttggttaggtgagacaccatgaggaagtgaaaccaaaatgcacaaaacagcaaaaacgtattactcacaggtctcagagaaattattggttattattctcctaacaagaagctgatgagaagcacagaggaggcaaagaattcaatcaccaggaagggcgtgagaaagagagaagacatgcagaactatgcctcatgggcattaccccttgggctttcccacaggtttatggattgacgagcttaaagaaaacacggctgagtcagggaacttacatgattctagtgttgaccattaggttttatcatggtcagcagctgtagggtatattgagttttaggcctgtgagatgaggaacaagtgggctctatggcacacaaccacatagcaaagggaagttttaaccaggctaaaggtgatgggggtacaacacagtttcaaacaacttatgtcagacctaacagtgaatgccaaggcagcaactatgttaaacaaatttccaacaagtgtcccacaccagaacccaaccattctggcactctgatctcgaacttctagcctctaaaccatgaaaaataaatttctgttatttataaacccccaggcctagggtactttgttgcagcagcccaaactgactaagacaaggatgtccctcaacttgataaaaatcatctacaaaaaaactactggtaacattatacctcatgcagaaagactgaattgtttcttacaatcaagaacaaaggcaagaatgtctgctgtcaccactcttactcaatatagtgatagaagttctagcagagcaataaagccaaaaaaaggaaataaaaggcatgtagatcagatagaaaaaaaatgatactgtccctaaatgcagttgacatgattgtgtatgttgaaaatcccaaggaacacaaaaatactcttagaactgatgtgtgtattcagcaaggtcaccacatacaagaaaaacatagaagaatctactgtatttctaaatactaccaataaacaggtggacaccaaattaaaaacacaatactgtctgggagcagttgctcatgcctgtaaccccagcactttgtaaggccaaggcaggaggattagttgacctcaggagtttgagaacagtctgggcaacatagtgagacctcatgtctacaaaaatttttaaattagctgagtctggtggtaaacacctgtagtcccagctacttgggaggctgaggtgggagaattgcttgagcctgggaggttgaggttgcagtgagccatgattgtgctgctgcattccagcctgagtgacacaccaagaccctatctcaaaacaaaacaaacaaaatactatatacaattgcttaaaaaaaaacttaggtgtaaatctatcaaaacatgtacagggcttgaatgctgaaaactacaaaatgctgattttaaaaggttgaagaagatcttggccgggtgcagtggctcacacctgtaatcccagcactgggaggcggaggcaggcagatcacctgagatcaggagttcgagaccagcctggccagcatggtgaaaccccgtcactattaagaatacaaaaattagccaggcttggtggtgtgcacctgtaatcccagctattcgggagctgaggcaggagaatggcttgaacccgggaggaggcagagattgcattgagccaagatcatgccactgtactccagcctgggtggcagagcaagactctgtctcaaaataaatatgtaaataaaaataaaaattaaaaaagttcaaagatctaaataaatgagatctaaataaatggagagacattccatgttcacagattgaaagacttaacacagtaaagatatcaattctttttgcacttaatgctttgatatcctagggccttgctaaccctggaggaactgcccccactagcattagccaattcctaaagatagtaaaggattcacctgatagcataccttccatatgcaaaccaatcaaccagagaccataacccaactgcctccttaacaaagctttcccactcagtcactagtttcccttgccctaattacccagggccagctaccagacaagtaggaatatctgctaaaccccagaacccactgaaattactcagactagccaatcctaaacttgcctaccttgcctcaccattcctttccctagtaaccacaataaaggctcttgcccatgttttccccatcactctctctgccttctgaccaactctgatacttacatatgtagttcatggcatgaaatgcctccttctgagatctgtgagtataataataagctatctttgcaatggcaatcatctcctgatctgttggttttgccatacctcaataagaacaaaacctacattttaaaacaatgttgtctgctttcaatataaagatacaaatacaataaaattaaagaaatggagaaagatatactatctacacactaatcaaagaagctggagtagctatatttaattacaggtgaagcaggcttcagagcaaagaaaattatccgagataaagaggggcattacatatgaaaaatgggtcaattctccaagaagacataataatcttaaatgcttatggtgcaaaaaacaagactacaaaatatgtaaagcccactgatagagttgaaagcacaagtccattattacagatggagacttaacactcctctatatcagtaattaacagatcaacagacagaaaatcagtaaagatataggtttgttgcagttgttgttgttgttttgagacagagtttcactcttggttgcccaggctggagtgtgatggcgcaatctgggctcactgctgtctccaccttccaggttcaagcgattctcctgcctcagcctcccaagtagctgggactaagggcacccaccaccacacccggctaatttttgtattttttagtagagatggggttttgctatgttgaccagactggtcttgaactcctgacctcaggtgatccgcctgtctcggcctcccaaagtgctgggattacagggtaaaccaccacacctggcaaaagatacacttgaatatcaccagcaatcaactggatctaaataacacttataggcggggcacagtggctcaagcctgtaatcccagcactttgggaggccgaggtgggcagatcacgaggtcaggagatccaaaccatcctggctaatatggtgaaaccccgtctctactaaaaatacaaaaaaaaaaatagccaggcatggtggcgggcgcctgtagtcccagctactcgggaggctgaggcagaagaatggcgtgaacccaggaggcagagcttgtagtgagccgagatcgtgccactgcactccagcctgggcgacagagcgagactccgtctcaaaaaaataaaataaaaataaaaaaaaattcttataaaatagttaatcgattatcaacaaataaacatttttctcaagctcacatggcacattcaccaagatagactatattctgggtcataaaacacatttgaaaaatttaaaagaatagaaatcatatacagtctcagaacacaaaggaattaaattagaattaaataaaagaaagatagttggacaatcccaaaatatttgagattaaacaaaacatttataaataacaaataggtcaaagaagaagtctcaaatgaaattttgaaatattttgaactaaatgaaaaggaaaatacaacttatcaaaatttgtgtggcacagcaaaaacagttcttagagaaaaattttaacattgaacacatatattggaaaagaagaaagatctaaaatcagtaatataagcttccaccttaggacactagagaaagaaaataaacataaacctaaagcaagcagaaaaaaagaaaagtttgaaatcaatgacatcaaaaacaaaacatcattagagaaaattaataaaatcaaaagttagttctttgaaaatatcagtgaaattcataatttttagccaggctaaccaagaaaaaaagaaagaacatttaaaattgccagtatgagaaatggaagaagtgtcatcactactgattccatggacctaagagaattcatgtcctttgtagggacatggatgaagctggaaaccatcattcacagcaaactatcacaaggagaaaaaaccaaacaccacatgttctcactcataggtgggaactgaacaatgaaaacacttggacacaggaaggggaacatcatacactggggcctgttgtggggtggggggaggggggagggatagtattaggagatatacctaatgtaaatgatgagttaatgggtgcagcacaccaacttggcacatgtatacatatgtaacaaaactgcacgttgtgcacatgtgccctataacttaaagtataataaaaaagaaaaaaaaagaaaagaaataatgttaaagactctgcccacaaattttttttttttttttgagatagagtttcactctttttgcccaggctggagtacaatgacacgatcttggctccccacaacctctgcctcccaggttcaagcgattctcctgcctcagcctcccgaatagctgggattacaggcatgaaccacaacgcccggctgattttgaatttttagtacagacggagtttctccgtctgttggtcaggctggtcttgaactcatgttggtcatgttggtcttgatcatgttggtcaggctggtcttgaactcccgacctcaggtgatctgcccacctcagcttcccaaagtgctgggattacaggcgtgagccaccgcacccggccttctgcccacaaaatgtataacttagattgaaatggaacaattccttaaaaggcacaaactaccaaaactcactcaaggaaaaatggataatctgaattggcctatatctattaaagaagctgagtcaataattaataaccttccaaaatagaaagcatcatgctttcactggtgaattctaccaaatactaaaggtaaaaatatcatttttatacaatctatttcagaaaataggtgaagagaaaatactttccaactcattttattaggctagcattaccctaactccaaaaccagatgaagacattataagaaaggaaaattacagaacaatatctcacatgaaagtaatgcaaaaattggccgggcgcggtggctcacgcctgtaatcccagcactttgggaggccgaggccggcagatcttgaagtcaggagaccgagaccatcccagctaacatagtgaaaccccgtctctactaaaaaaaatacaaaaaaattagccgggcgtggtggcgggcacctgtagtcccagctactcgggacgctgaggcaggagaatggcgtgaacccaggaggccgggcttgcagtgagccgagatcaggccacagcattccagcctgggcaacagagcaagactccgtctcaaaaaaaaaaaaaaaaaatgcaaaaatcctcaacaaaatattagcaaatagaatccaccaatgtataaaaagaattatacaacataatcaaatggcgttttttcaaggtatgcaaagctggttcaacattcaggatccaattaatgtaatccatcacatcaacaagctaaaaaagaaaaatacatcaatagacacagaaaaagtacttgacgaaattcattgcacattcatgataaaaactcccagcaaattaggaagagaaggggaacttcctgaacttgataaggtacagctatataaaacctacaattaacatcatacataatggtgagaaactgaaaactttcccctaagatcagtaataaggttaggatatcccttctcacacaggagaaaatggtgataagtttttagatatagcatcaaaaacacaatgtaaaaaagaaaaaaattgataaattagactttatttaaattaaaaatgtatcatctatgaaaaaccctgctaataaaaatgaagagagaagccatagactaggagaaagtacatacatatatccgataaagaactaaattgtacataggacccttaaaactcaataagaaaacaaacagccaaatttttaaaagggcaaaacatccacatagatatctcaccaaaaaagatataaagatgctcaatatcacattagggggttgtaaattaaaacaataatgagctaccactacatacatatttgagtggctacaatccaaaaaaactaaaaataccaaatgctggcaagaatgagaaacaggaatgctcactcattgctaatggatgcaaaatagtacaaccactttggaagacagttggtagtttcgtaaaaggctagggatactcttactgtatgatccaaaaatcgggctcctagatattgactcagatgagttgaaaacttatgtccacacaaaaacctgcacatgaatgtttataaccgttttattcgaaattacaaaaaatttgaagcagccaagatgtccttcaataagtgaatatataaccaaactgtggtacactcatccaatggaatattattcagtgacaaaaataaatgagctgttaagccatgaaaaaacatagaggaggcttaagtgcatatcgtttagtaaaaggagccagtctcagaaggttacacatattgtatgactccaactatatgacaatgtggaaaagacgaaactataaagacaataaaaataaaaatatcagtgactatcaagggtacaagagaaaggagaaatgatgaataggtggtccacaggggatatttaggacagtgaaactattaattttttgctgtataaaactgtaatggtagaaacatgccgttatgcatttgttaaaatacaaagaactatataacacaaagaatggaacttaatgtaagctatggattttaattaataataatgtatcaacattggttcaccaattgtaacaaatataccacattaatgcaaaatattaataataggggccactgtgcacagaaagtagagagatgaagggattttatggagctcttggtactatatgctcaatttttctgtaaatctaaaactgtactagaaaattccattaatcaattttctaaacctacagcactatttcagaataaaaaataatttttctctatcaactgagatatggtcttcattcaaaggcaaatattattggacgttttccccccttgagtatgataaatagaaggttaaatgcaacttgtataatacattcaaagtttaaatggaataaaaatattttttaaatcaaatatggaccatatttaacttttttttcctttctgtttctactataaaaacctcagagtcaaaaggaccttagaggtaactagtcctagttttgatctgaatttcctttacattttcaataaatctgattattcagctttgttacctatttttttctattttttaactttcttttcctagttctagtttcccctactcccttgactggctataatagtaaaataaagtatatctttattttctattgcagttattgaatatggttttattgtcccttttggtttttaaaagcacacccatacacacatgaaatactctgaaagattcacaaattgagatttattttttgtgggggactttgcactcgcacatttttgtaggtcaatggccttaatggtgtggaaaagatcgatctaatataaagtcccagtgtaatttccagtctaagattggattgttctgagcagtttttgatagcttctacaagcaaacctattgtatagacattcatgcttaacaaaaacaatgtttctttagtgataacgaatattaaataatttattcttccccttcattgttctcttagaaaattaactattcctcattataaacaaccttcagtaaaacatagctctagtttacatgaccataaacatagctaaagaactatggaatataggccacttattgaaagttaagattcaaagagactagaaaatgagattttaaaaaaggaacaagtcgaaaggtctttgggatctatagtctcctaaggaaatgtagtcagttataaataagggaattgttttccagaaattattctctttaaacttgttatttcgaaatacttatacttactgatttactgaacttgaaaatattccatttgtctttgggtcaaaattagtgaaagtaggaacatttccatttaattttaaaaatttgccaaaacttaaaaaaatgtatcaggttttagttattctaaaatgaggaccatcacctaaatgcagtaatataattttgtaagaaaaagatacaacatttcagaataggaaaagtaaaagtagataaccataaactattcagaagtggaattgaacaaacttctcataactagacttagtaaaggttcttccacattgcaaagtttatttggaaagctacaactttgtattgattttaattataacatttcatcttaaaaattaaaatactagaagctaaagttgtaatgtagggtttctcaaccatggcagtacacgtactgacattttgggttgaaaattctttgttgcagggactgtcctgtgtactgaaagattttttgcagtatccccggtagatgccctcatagtcatgaaaaacaagaatgtctccagacatccaaatgtccccaggggaagtaaaatagccccaaattaagagccactgttgttaatgtataaatccattttaagttgtcatagagctagtatacatcctttttctcataagtaatctaattgaacaaaagggagatagaaaatgatggaactcacatgtaggaaagagagcttaagagcaagtaaaggtgcactagagaaagagacaaactgaaaattcttgacagatatccaagaaaaatgtaaatttttcagttaagtccaagaccatgtgatagagtaatagtgctatttctgagtaaaagttgtacttttcatggtccattagaaagaaaacattgttaactgccaaaaaagaatttattaaaaatgccatgttaaagtcattcaaaaaaactaaaataaatgaaatcttacttttttctgtagtgctccctggcaatctttggtcctgatctttaggaagtacatttgctttactacttgactcaaccacagattgttttactgataaagatacaagttccatagcattgtaagaatcatacaaatcccaggcagtggacattatgcctagataaagacacagaaaggtaaaaattgttttaaaccaaattccaacattttagctttatacataactagtcacagaaaaagctaagataagaatatctactattgcctgatgcagttgcccgtgccagctacttggtccacctgaggcaggaggatcacttgaggccaggagttagaggcagtagtgtgctatgatgacacctgagaataaatagccactgcactctagcctagacaacatggtaagaccctctctttaaagaaattaaaaattaaaaaagaatctactgtttatttttaaaaacactattgttttacaatataactggaagtggatagaaatgacaaagaaatacatcatgaggatacctcaagagatccttagtcatcacactattagtatctacaaacactttaatgctttaaggataactccaaattatcttcacaatattttctgaccatcacacctcccttcccactaccccacacctctacagcataatctcattggtctgtcattgtagggctgccttggtgatatgcatctgggcaaatatgttataaaaagacttttatgttcctttacttatgattaatacataatatattgtcaacaggtatttgcaagcatctgattccatttttatcaagtaaaatttcctatacacttattatgtgaaaagattgcccctgctgggaaaattgatagactctgatctcaagaagcttgtatagtagtacggttattatcgtctcttttaaaattatagtttaggttaaatttattcaaatcatcaaaaatataacaatggtttgcaaacaaatattggcaatgttatttatctttaaataataacttaaaaactccaagtctcttccactgctgatttatgtttatgcagcaattattttatcagcgatcatgtaacaatatatttgtacatgctaaatttaccaatttttcagttaaaggatggtgatttaataaataatttttttccttaaaaatcaaaacagaatgtggatctaataaatgcagcctcttaattgctacaactattattttcctaatacaaaatggaggagctctagtaaagcaatgttttcaatcggtaataatcgggttttttgtttttttgtttgtttatttgtttgttttgtttcatttttttaagagttttgctctgttgcccaggctggagtgcagtggtgcaatctcagttcactgcaacctatgtgtcccgggttcaagtgattctcctgcctcagcctccccaagtagctgggattacaggcacccacaccacgcctggctaatttttgtatttttagtagagatggggttcaccatgttggccaggctggtcttgatctcctgaccttaagtgatccacctgccttagcctcccaaagtgctgggattacaggtgtgagccaccatgcctggcctcaatggtaagaatgttaactcaaatttcttaatgatatttatatcttaatgaacttatcataaggccatctaacaaagtcatgcacagaatacctagtatattttgctcagttgaaaaaagtacattttccatgttcatgaagagaacttagaaattacatctttgaacactgaattactcaactttctttttcttttgtttaactgaaagtttagtaagtttagcatataggaacatactgttacatggtcattaataactgttacataaataaatacgcctattataaataagcaatacaatatgtttggataattaaaagttgactcttatttgtagataacaaattactgctcattttagtttgggtactatagttacatttgttcatttgaacaagtttaattaacctaagaaacaaactttcaaacctgtcaaattgtatacattaataagtgcagttttgtatataattctaactcaataaagctgttaaaaaagtctcaaaattcatgccctaatgttatgtaaaagatgggtaataatgaataattgtgacttcccaattttataattatatgctattaaagaaagcttattttaactggtatcagaaaagaagcattccaaactatgcctttttttttaagcatttctcagtgtaatacatgtttaaatagttgctaaaaggcaaagaaacgcaggtgtcaacagatggagactggctagcaagaggtaatgcagaggtgatatgggcagttcagttacagcatctgctataaaagaaaaaacatttaaaagagcaaggtaggccaggcgcggtggctcacgcctgtaatcccagcactttgggaggctgaggcgggcagatcacgaggtcaagagatcgagaccatcctggccaacatggtgaaaccctgtctctactaaaaatagctgtgcatggtggcggacacctatagacccagctactccggaggctgaggcaggagaatcgcttgaacccaggaggagacagttgcagtgagccgagatcgtgccactgcactccagcctgggcaacaaagcgagactctgtctcaaaaaagagcaaggtaatgatcaacccaaaagttaggagagtggatacttctgttagaggtggctagaagaaagagggttgtgataggacagtgtacagggggcttctaatcaactggggatgttctatttcttatcctggctggtgagtacatggtattgattttttctttacactacacatgtatgtgttgtatgctcttctgtttgcggtatatatttcataataaagtttttaaataatgaaagtttacactaaagaatttagatgcaaattaagtaaatattaagattttatggatgccagccgtgatggctcacgcctgtaatcccagcactttgggagaatgaggcaggcagatcacttgaggtcaggagtttgagaccagcctggccaacatggtgaaaaccccatctctactaaaaatgcaaaaattagcccagcatggtggcatgtgcctgtaatcgcagctacttgggaggctgaggcacgagaatcacttgaacctgggaggcagaggttgcagtgagccaagattgcgccattgcccttcaacctgggtgtcagagcaagaccccatctcaaaacaacaacaacaacaaaaagattttatggatcaataaaagtgtaccttttccctgcctgattttggatgaaactggaagagatacaagaatcagagaaatggaggtcaaaatattacctttattactgataagtctaattgaaaaatgtagccttaaatctgcaactaaatggacttgctaattcttccttccagaatatagggaagaattactaaccagtaactgtcacagctagacaagcacagacttcctccacaggggtaagaacagcccagattgcatgttttctgcaagtggacagacttaacaaaaagtgcctcagccagaaatgaccgagcttcattccttctcctaaattctcttatggaattagtcacttctcttttcctgggaatgagtaaataatgtatagagagaggccagaagtgttaatttagcagaagttatttctgtaaaggttcacaaaaagggaggagtaagttttccctgacagtatacatacagtcacttatggaaaggtggcatttcaaataattgagcttcagcttaactatggaggcctactgaaaaggaaagcgggaactggattaagaatggtaaaggcagtgtggtggctcatgtctcatcccagcactttgggaggctgaggacagtggatcacttgaggtcaggagtttgagatcagcctggccaaaacggtgaaatcccatctctagtaaaaatacaaaaataagccaggtgtgacggcaggcacttgtagtcccagctacttgggagggtgaggcaggagaatcactcgaatccaggaggcgatggttgcagtgagctgagattgcaccatggcactccagcctgggcgacagaatgagactctgtctcaaaaaaaaaagaaaaaaaaaagaatggtaaatgcaagctagatgcagaaaagaattcagaccgataatgtacctaagtattctgtcctcaggttaaagagattgtataatgttagcaagcatctaggttatggtagtgatcaatatgtcaatctcaagttttaatgtaaataggttgccttctatgtttggtgaacagctgaaatcctaggctatctagtcatcatccttctgggaactactatcacctcactcctatgtcagatctcctgttcaatgtattttattgtcttcttcttttttgtttcacagttggttttggttgagcacatccttgacttcttgaaaaaatatacaggaggggtaaattattttgatactttgcatatatgaaaatgtctttattctaccatcatacttgacatttggttggatgtagtatctagactggaaattatttaccttctaaattttgaaggcagttgtattagtccattttcatgtggctatgaggacatacccaagggtaattataaattaaaattaaaaattaccaagggtaatttataaagaattttaattgactcacagttccacatggcaagggaggcttcacagtcatggtggaaggtatgtcttgcatggcagcaggtgagaaaagcgagtgacgagcgaagggggaagccccttataaaaccatcagatctcatgagaactcactcactatcaagaataacatgaaggtaaccacccccgtgattcaattatctccacctcttccctctcacaacatgtaggaattatggggattaaaattcaagatgagatttgggtgggaacacagccaagcatatcagcagtgttccattacattcttgtttccaaccagtctgatgtcttgttctctacactgacctatttatttttctctctggtagtttgtggacattttctgtcccccacattttaaaatttcatttattggtaatatgctggcacttgttgttccccttcaatcttccaacttttgactttcaagtctgagaggttttactgaattatctcctcccctccattttctattttaggaaccattattgactattgaactttctggattggtcctctaattttattgtttctcttagattttccatctctttgtttttcttctctacttcttggaattttttttttgttatcttccaaacattttattaagctatcaagatctttttattctttggatttttttttaaagaacattctgttcttgttccatgaatgcaacagattctgacagcgtttgctcaattttaggagcatttctgtggagggacacgtcagaactacctactctgccatttttgttgcatcatcctggaactattttttttagttgatattcctgaggtagctaagtagacactaatgtcacctacaaataatgactatttgtttttgaatccttataaatattagtatcttatatctgttgctgtgttactgcaatagttggaactgccaaaacaaacttgaagagttactgtgataagtgacactatgttctggttcttatatttaatagatcacagcaattattatctctagtggttcacctgaaagcaaaaattttgctttttattttaaatattttatcaagaagatccataccattcctgtacagataatttcatcaggaatgaagtctgaattgcatcaactgctctttttggcatttaccgttcttgttttacattaaacctataaatatgattttgtaatgatgaatcatagctttcctgatatttaataatctttatactcctagaataagttgttgctatagggattcctaatgccttgagggttcaaatttatactactatatttttaatttttccacatatctatgagattagtctatattttctttgtaatgttttgttaaccttgttttaaaaactacaaaatatcctcatattttatatgacttggagcaatttaaataacatggtgtgatggttaactttatatgtcaacctgactgggcacaggatgcctagctagctggttaaacgttgtatctgggtgtatctgtgagggtgtattcacaagagattaacatttgaattggtggactgagtaaagcagatggctctctccaatgtggtgggcatcatccaatacactgagggctgaatagaattagaaggtggaggaaggttgaattcactctctgcctgattacttcagtaggggcatcaatcccctgccctcagtgctcctggttctcaggtgttcagaggtagactggaatcgatactgttggctcttcaactctcagggcttcaaactaccacattagctttcctgtgtccccagtttgcacatggcagattatggtacttctcagcctccataattacataagccaatgccctgtaataaatcgctttataaataaatactagatataaactataaattggccaggcacagtggctcatgcccgtaatcccagcactttgggaggccgaggtgggcagatcatggggtcaggagatcgagaccatcctggccaacacagtaaaatcccgtctctactaaaaatacaaaaattagctgggtgtgttggtgcgcctgtagtcccagatacttgggaggctgaggcaggaaaatcacttgaaccaaggaggcggaggttgcagtgagccgagattataccactgcactccagcctggcgacagagtgagactctgtctcaaaataaataaataaataaataaataaataaatcctagatatgaatatatatatatatatacatattctattggttctgtttttctgaagaatcctaatacacatgaatattataaagtattctcacatttacagaataaacctctaaagtaatttgaccttgatctaggccattttaaaatggtatttttgataaaattttcccatttctttgagttaatgtataattctattacttcttggggagtgttgataattttgagttccataaagaatcattctttttttattttcaaatattttagcataaagttacatacagtaatccatttaaaatatttaaaccctttacttttggaaaaaaatatgaataggtttcctaatatgaattggaaacctaaagttacatacagtaatccatttaaaaatatttaaaccctttactacatattaatatttggaaaaaatatgaataggtttcttaatatgaattggttaaggactagaaaaagttactaaatatcatctaggaattcacttttctgggtccatccaagtttgcaccaattaagaaactgacaaggaataaaacagagatcaaaattacctttattactgataatgtttagattggctgatacagtttagatgtgcagcaacaatgagcttgataaccacaggcctaacaatgttgagtcctccccctataaaatttatagcatggagaaaccaatcagaatttgtattcctttctgccagcaggctactagaagagggaaagcaggggaataaccgtacatccccatgtatggttatttaccaatcaagtaagtcatacctccactcctaagtaggaatgagtgagagaatagaaagagatggagataaagatatccactcatgttcttccacataaaagaaaacattaggagtaaggaataaatgctctcaccaataagatgtatgtatgttctttgattaaaagcaatgattaatttttttgctaggggtttgttctgttaatcttttgtaaaaactagcttatagttttgctgcataataaaggcaattaagaataaaaccggccatggccaggcgcggtggctcatgcctggaatcccagcactctgggaggtcgagatgggaggatcacctgaggtcaggagtttgagaccagccttcaacatggtgaaaccccatctctactaaaaatacaaaaattagctggccatggtggtgggcacctgtaatcccagctactcgggaggctgaggcaggagaattgcttgaacccgggaggcggaggttgcagtgagccaagattgcgccatcgcactccagcctgggtgacaagagcgaaactgtgcctcaaaaaaaaaaaaaaaagaatataaccagctgggcacagtggctcatgcctgtaatcccagcactttgggaggctgaggtgggcggatcgcctgagttcaggagttcaagaccatcctggccaacatggtgaaaacccatctctataaaaatacaaaaattcgccgggcatgatggcaggtgcctgtaatcccagctgcttgggaggctgagggggagaattgcttgaacccaggaggcagaggttgcagtgagccaagattgtgctattgcattccagcctgggtgacaaggtgagactctgacgcaaaaaaaaaaaaaaaaaaaaaaaaaaaaaggaaaaatataactttgcttgtaattacttctttggctacaccctacagattttggctatgcaatgtgctcagggttgttaatttgtacacagtgagaggtggtaagtatagtagttaagtgcacaagctctagaaccagaacagttagcaaacttctctttgcctgtttcctcatctataaaatggggaagcataatagtatctacctcatagggttgctgtaaaaattaaaccagttaatacatgtgaaggacatagtgtctgacacatttaaaatgttaatagttatggctgatattctttgtgacatagtaaataatcagtttatataaacgtttaaagagtataaagttctatgatatagtatgcataaaaaccaagatgaataattatgttattcaaatctatatatttattacttaacatgtcaaattctgaaagctatagaacacagtgtccaactactgttgtggtttggccaaattatttttatttttgctttatacatttcaatattcacttgtcgattgacagactcaaaaaatgtatattagaacattatagtttatcaagcagaatgatagaaattacctttatcttccattatgattttatcacattgaacatctttattctttggtgctccattgaaagtctgcatcatcctttcaacatataggtcattgcctaatctgtttctacaaaggacttcataattcttgtttctctgactgtaaaaaataaagtgtatccaactcattaataagaatcatcaccacacgtattatctctttatattattcttttccctaaaattactttccttaatgtggcttgcaccaaaaagtgaagtgagacttcaaaaaaagccttaggaaaagactgcactaaatgacctccagaggactcttttatactgtgtctatttcccaacatccctactactatcggtaccttatcaataacatgctagtactaactccatgtaggttttagttctgaatatttttaaattttccattacttctttgatgacccatgaggaatttagaaatgtgtttttgaacttccaaatgtgtatgtaaatgtgtctgttttagttgagatttatgttattaactttattgcactgtggccagaaattttcatttgtataattctattctgaaatttttgagaccttgcttcatagccttatgaataattttttataaatgctgcatgtgtgctgaaagagaatgtgttctctaattgttgagtgcagaagtctgtatctgaccattaagtttttattcaaattttctatatccatactaatgtgttctctggttgacctaccaataattaagagaggtgtgtttaaatctcctactttaacaggatatgtatcaagtttccaatttttgcttcacatattttcaggttattttatttatttattatttatttatttatttatttatttattgagacggagtcttgctctgtcacccaggctggagtgcagtggcgtgacctcagctcactgcaacctccgcctctcaggttcaagtgattctcctgcctcggcctcccgagaagctggtactactggcataagccaccacgcccagctaatttttgtatttttagtagacacgaggttttaccatgttgaccaggctgctcatgaactcctgacctcaggtgatccaaaccacctcatcctcccaaagcgctgggattacaggtgtgagccaccgtgcctggcccatgttattttattaggaatattcaagttcaggattactataccttcctatcattatgaagtacactttatccctaataatgctgtcagtttaattgttcctctgtaggtgacgtgtttttaaaaaatattttttctatttttattttttaatgaaattacttttatattccaatgctcttatttatctatttatttatttatacataataataataagagatgtggtctcactgtgttgtccagggtgatctccactcactgcaaccttcccctcctggagaagcaattctcgtgcctcagcctcctgagtagctgggattacaggtgcccaccaccatgcccagctgatttttgtatttttaataaagacaaggtttcatcatgttggccaggctggtctcaaactcctgacctcaagtgatccacccacctcagcctcccaaagtgctgggattaaaggcttgagctaccacacccggcctgacagtttcttaatgttaatcatgttttaactctgtcttttatttgtttaaacatttcacacatattttatattctatatctgataatataattatctatagtcttcaggatctataccaaattcaacctgagggaattcttctccttctccttctccctttccttctccctctccttctccctctccctctccttctccctcctctccctcctcttcttcttccttttttttttttttagacatggtcacatggtctctctcggttgaccaggctggaatgcaatggcatgaacacagctcactgcagccacaacttcccgtgatcaatcaagtgattctcctacctcagcctcccgagcagctgggactacaggtatgtaccaccaagcccggctaatcaaaaaagaaaaaaaaaattgtggagatagggctctcgccatgttgcaggctggtacaaactcctgggctcaagccatcctcctgccttggcctcccagagtgctgggattacaggcatgagccaccacatccaggtgatctgaaggaatcttaagagccaaaatggtggtatgctttgctccagagatttgtgtttgcttctgacagtagggagttgactctactggcctaggatcagttgagataattgagctccttttgagagtcttggcttaacacaagaatctctctttcagctctttcagtgtaagggttgggagaacccaagactcatcactggtctccagatccatatgttaatattaacatttcttcccagcatttctccccttctgatttcaaagcaattatctgtccctttcttttttccctctttcctttttttttttttttttttttttggtcctaggaactttcccttccttcttatgagcttttaaaggtacgctattcatgatctaacatgtactatgttttatagtccaaaccatattataatattttagattttgagaaggaataataccctaaaattattttagtgatggagtttttagtactataaatcctattcaaataatactttaggtaaaataatcagaataactattaataatctacttatagtagctatattaattttagatggaggagagcggaacaagaaaaattattagggataaagagggatagtacaaaatgataaaggggtcaattcttcatgaaaacataacaatccttaaatgtgtatctgcctaacaacagactgtcaaaatacttgagaccaaaactaactctatttatattcattaataaagagaaatggaaaacttctctaatatagtaaattcatttatttacccatattttgccttcctaagttttaaatattaggttggtgcaaaagtaattgcggtttggctattactataaaaatgtcatttctttctttttaaattgaaaatgatttatatatgtataaaagtaaaaataattaaaacctatatagagacttggaagcttattctgttatttggcttagaagttcgcctaattatttaaaaatatggtaaagctatgggctcttcctctagaaaaatttacacacaacataaacatgaacataaaagttcacatggcacttatataactttgtatataattttgtagggaatatacagtctccccccaaaccccatagtgtataccccagaacccccaaggacccttcacagaaacaaggataagaacccttggcttagcatttgaattacagaaacaatgtagacaactgaaccatacatacgttactttctcagcttcttcagattctacagagaccatgactgtgggcaagtcaaaaaatctcagtgtttctgtctctgtgagtattatctctatattcttctccaggtcttcttttgttacaattttttcaggtgctgcccttataacttgcaaatctaaaatacatgacttaattaaaatcatttactaattgctatttttaatttgcatttttccttctagtcaccaatataccataatgggtaatatattgcaggtggtttatatagtcaaggaacaggccaggttgtgagatgtagtatattcaacctttctgaagccaaattggatcttgtaggccataaacagccttcttgctgacataacaagcctaccccagtctaataccaatagtcataactctaagggtattccattataactatcccacaatattaattgggaactggggttagcaactgttggtactactcaagaatatggaggcaagtatatttagggggcataataagcaacacttctttgagccgtgaagttaacttctaattcgttgctttagcaaacttttatccttcatttgccctccttattagctgtcttttaatttagatgtcattccacctctaatcatcttcaccaggggtaaagactctactatattagtcctggttgactatagaaataaaattggaaccaatgtctatgcaaataatagagtgaaaataattggccataaacctttaggacagtcagaacttgatccaaggtccttggaaaattccattgagaattgagtttcacagctgggagagtttggaattggttatgtgggtaacagccatgagaaagtatataagtgagagttcaatgttttctatcaacaacagggtatacagcagacattcatgagcctttgggataggtaaagcttggacagctttaggaaaacttaaaaacgtctcagtctcctcttaaaaaggttcagagctgagaaaaacaccttccttataatctaaaaaaaaacaagttattaattccaaaaaccaatcatcaacatttttaatgactaaataaattatgatataccatctatgactaataaatagtaagtaatgtaataatacaaatttttgaaaatatgttctaaaatgttaaatgacagagcagcccagaacatgatctgtactatggtaataagaatgtaaaatattatgcagataaacaaggtcaggaaacagaaaattttaagttgcaaatcttctttagttttgggtgattcttcttttttaaaaatattctttaatttttttctatttgtgtaataaattttaaaaataagtaaaagattttatttatataagtaaatttgactaagacagacaaaatgagtaaagaagtaaatgagttatccacaagaacaaaatttgaggtacatgtagtccaaactttttgtcaatgaagaaaataaaaaacagaggttaagtgaaaagtccacacaggaatactaacaattttaaggctagcgatttaggctcttgattctctgaggtttcttactgttagaccaccagatcttcctttgcaatttagttatataaacttcaaagtaacattgtggcacagacatgctaattataaaaataaatgatcttatattagataaattacatatatagaacctaatatggtaacatctcagttattacggttgggaaaagtaatagtctagtcaaccttcttgatggcagaggacttaccattcatagacaaagccctaggatggcaaataggatttttgcctggagttctgtatcacccatttcctaaatgttgcttgaatttactatatgttcagaaactacccccaaaccacactctttacctatagaatctgcctatttcatgggtcagatcccctaactttagactggctgtaccacagattttgagtacacctctctctccacctagaaaagaatcacaattctatcaatctgttttgcctgctcctcttgactgccaatgatggagggaacatctacactcctaaaggttcttcccagaggagggagctccagcctagtatgacaatcatggctcctctccacacctttactcatgaatccccttgagagggttaggagagtcctgaagtggtctagaacctttcgtgaatgggtgggtaagtctgtcaaatgtgagggtttaacaggggacttttatccataatgtgatattttggctccaattcatcatatttacccttatcatatttttcaattaattcagaacagggtgaggaaaagggatgcaattgtttggctattctcagagaccccagtagagaacaacctatgaagccttccttggcctctactttagcttcaatgggcccaatacaattacagcataattgagtcacaaaagcagtttattcttcctcccttctcctcacttgtcaaaagtatctattagtgacttatttattaactgagagcatccagagacaacctgtgcatgagatgctgtttggcccctaccttgcaattaaaaccacaaacttttctaagcacaaaactccttctagttatatggtaaagcaatggttctcaaactttaccctgcaacagaatcacccaagggcttagcaataattgcttggacttacctctagactttttttcaacatttggtaaactttgtattttagaatagttttaggtatacagaagagttgtaagaataattagagtttctgtataccctatatccagttttccctattgttaatattactttggtacatttagtacaactacaatattgctattttatcatcatataaagtccatattttattctaatttccttaaatttaactaatgtcatttttctcttccaggatctcatccaagacaccacattacatttagtcatgatgtctccttacggctctctacactgtgacagtttctcagaatttccttgtttttgatgactttgagagttttgaaaagcagcagtcatgtattttgtagaatgtccttcaatttgtgattttctgatgttaaacaagtgttatgggtttctgggaggaagactacagaggtaaagtgtcattctcatcatatcatatcaaagatacatgctaacatcataacttatcattgatggtgttaatcttggccacctgtcaatatcctctgctttaaagttattttcccccctctctcttttacatattgtactgtttagaagaaagtcaacatgcaaagcccatacttgtagaatgggaagttaagatccaccttcttgagggaagaatatctatataattatttggaattctcgtgtaaaaagatttttctattctctcctcttcatttattcaatattagtttgtgttactatgaactcatgcgtatttattttataatttgggttataatccaattctacaatatttattttgttgttgaaattgttctaccttttgccattgtgagctctttctgttggctgctaggttcctctcaaatacccctttttgttgtttgtttattgtagagttttgttctattttgttttgtttgagcacttctttacttgctggctcatcttgtatccatgcaccaactctagaatcaggcatttcttcaaagagccctagttgcttttattagagaatggaattagaaaccaaaatctgagcactgagagtgcttgctgcttctggggtatcattacttctaggctttcttagtggacagagctaagaaatatttgtatgtatactaacttgtatatacaaacatatctatacatctatgttcatctatatctctattaagctaaacatgagtttatattaatgtttttgacacttgttcaataccacataaataattctagcttcccttcttgctttctgtaatctcccactccaacaatggtgagttcctaccatctgccctccaattacttacatgttcaatcccagtatgcatgtacaatgattcagaattattaaccaatacccccatgggaagtgactataaactagagtgtttatttgcagttccttttgtctttaatcttatagcctctactcattttcaatattatttaggtatataccctttcctcccactccttctggagggttatattatacatttgtaaggcagtttgattcttttgttacagtctgtattccattgtaggatcctcgtatttcttaattgtgattttaaaaaacctcccacattttaagtctcactttttgtgttgtaatattctttgggttttagtaaaggcatggtgctatgtatccaccattatagtatctatacagaatagttttaccatcctaaaaatattcattatgcttcacctattcaactctcccttctcttcaaggccctgctaccgaccattgatttgttttctgtttctatagttttgcctttctctagactgtcatataagtagaatcagacaggatatagtcttttcagactggtttatttgacttagcaataagtatttaagattcatcaatcttgttgcatggattcatagctcatttttttattgctgaataatattccattatatggacatgctattgtttatttatctgttcaccacttaaaagacatcttggttgcttctagtcttctgcattgatgattcagctgctagaaacttttgagtggagatttttgtgtgaagataaattttcagttcatttgggtaaataccaaggaacacaactgcttgatgatatggtaagagtatgtttagttttatgcgaaattgtcaaactatattccaaactggatgtaccattgtgcatccccaccagcaaggaatgagagttcctatttctccacatctttgccagcaattggtattatcaggtttttttagccatttaaatgcatatgtagtactatctcatttttaatttgtattttcctaatgacatatgaaactgagcatcatttcatatgcttattatatgccatctgtatatcttttttgatgaagtgtttgttcctatgttttgttcatttttcactgggttggtgatatggtttggctgtgtccccacccaaatctcatcttgaattgtaactcccacagttcccacatgtcatgggaggaacccaatgggaggtgattgaattaagggggtgggtctttcctgcactgttttcttgatagtgaatgagtctcacaaggtctgatggttttaaaagcgggagtttccctgcacaagctctctattttgcatgccaccatccacatgagatatgacttgctcatccttgccttctggcatgatggtgaggcctccccagccatgtggaactgtaagtccattaaacctctttttcttccaagtctcaggtatgtctttatcagcagcatgaaaatggactaatacagtaaattggtaccagtagaatggggtgctgctgtagacacccgaaaatgtggaagcaactttggaactggataacagacagaggttggaagagtttggagggctcagaagaagacaggaaaatgtgggaaagtttggaactccctagagactttttgcatggctttgaccaaaatgctgagagcgatacggacaatacagtctaggctgaggtagtctcagatggaaatgaagggctcgttgggaactggagcaaaggtgactcttgttttagcaaaaagagtggtgacattttgcctctgccttagagattcgtggaacttgaacttgagagagatttagggtatctggcagaagaaatttctaagcaacgaagcattcaagaggtgacttgggtgctgttaaaggcattcagttttataagggaagcagagcataaaagattggaaaatttaccacctgacaatgcaatagaaaagaaaatcccattttctgaaatgaaattcaagctggctgcagaaatgtggataagtaatgagaagccaaatattaatcaccaagacaatggggaaaatgtctacagagcatgtcagaggtcttcatggcagcccctcgcatcacaagcctggaggcctaggaggtgaatgtggttttgtgggctgggcccagggtcccggtgttgtgtgcagtctaggtattttgtgccctgcatcccagccactccagccgtgactaaaagggatgaaggtacagctcaagctatggcttcagagggtggaagccccaagccttggcagcttccatgtggtattgagcctgtgagtgcacagatgtcaagaactgaggtatgagaacctccccctagattttagaggatgtatggtaacgcctggatgcccagccagaagtttgctgcaggggcagggccatcatggagaagctctgctagggcaatgcagaagggaaatgtggggtgggagcccccacacagagtccctactggggcactgcctagtggagccttgagaagaggaccaccatcctccagaccccagaatggtagatccactgacagcttgcaccatgtgccaggaaaagccatagacactcactgccaacccatgaaagcagccaggagggaggctataccctgaaaagccacaggggtggagctgtccaagaccatgggaacccacctcttgcatcagtgtgacccggatgcaagatacggagtgaaaagagatcatttttgagttttaaaatttgactgccctgctggattttggacttgcatggggcctgtagcccctttgttttggccaatttctcccatttggatcaactgtatttacccaatgcctgtacccccattgtatctaggaagtaactaacttgcttttgattttacaggctcataggcagaagggacttgccttgtctcagatgagacattggactgtggacttttgagttaatgctgaaatgacttaagacttgtggggattgttgggaaggcataattggttttgaaatgtgaggacatgagatttagaagagaccaggggtggaatgatatagtttggctgtgtctccacccaaatctcatcttgaattgtaactcccacaattccatgtcatgagaggaacccagtgggaggtgattgacttatgggagcagttctttcctgtgctgttcttgtaatagtgaatgcgtctcaagagatctgatggttttaaaaatgggagtttccctgaacaacctctcttgtttgcgtgctgccatccatgtgagatatgacttgctcatccttgccttccaccatgattgtgaggcctccccagccatgtgaaatgtaagtccattaaacctctttttcttcccagtcttgggtatgtctttatcagcagggtgaaaacagagtaatacagttgggttttttttactgtgaaatttatgaattgtatatgtactttggataaaagtccgttatgatctatttgatttgcaaacaattttctcccagcctgtggtttgtcttatcattcacttaacattttatttcacaaagcaaaaatttttaaaaagtccaattctaccaatttctaattttatggattgtgcttttggtgtatctaaaattccattaccaaagccaagatcacacagattttttcctgatgtttttcaaaaagtttcttacttttgcattttaactttaggcccatgatccattttgagttaatttttgagtaagatgtaaggtctgtgtctatgctctctctctctctctttttttttgcatatggatgttcaatttttccatcaacatttattgaaaagagaattctttcttcattgaattgcctttgtatttttgtaaaaaatcagttgattatattagtgtggttctatttctgagctctgtattccattttatttatcagtgtacttgattgtgatagctctatacttatgcttgaaatcaggtaatgtgagtccttcactttttttttttccagagttgggctggctgttttaaatcctctgttcttcaatataaattatagaataaattagctgatatctacaaaaaagattgctgggattttgattaagattggattgaatctatacatcgaattacaaataactgatatctttacaatactgaatgttccaatgcatgcatatgaaattcatttatttatttttttttacttctttcttccctgttttgaggctttctgtgtatagattctgtaaatattttgttagatttatacttttctgatgctactgtaaatgttttttgttgttgtagtttaatttcaaagtctagtagttcgttgatggcaaacagaaaggcagtttgcttttatatattgaccttgtatcctgcagtgttgcaggatacatgcctattggtgccaggaagttttcttttctttttttttttttttttttttgtagattcttaggaattttctatatagacaatgatgtcatctgtaagtatagacagttttatttcttgccttccaatctgtataaactttttttgagacggagtttcactcttgtcaccagactggagtgcaatggcgcaatctgggctcactgaaacctccacctcctgggttcaagtgactctcctgcttcagcttcccgagtagctgggattacaggtgtgcaccaccacacccagctaatttttggttttttagtatatacggggttttgccatgttggccaggctggtcttgaactcctgacttcaggtgatccgcccatctcggcctcccaaagtgctgggattacaggtgtgagccaccacgcttggcccaatctgcatgaactttattccttttttaaaaagtaagcctagtttcattttgcctgtgacataatttttaaaatatcttttttaggaagatacttttaaatatgttgtattttataggaatatacaatttttaaattgtaaagtgacaacttattattgggtacatttatggggtacaaagtgatggtttatgaatacaatgtagaataattaaatcaagctagttaacatatccatcacctcaaatactcaacatttttgtagtgaaaatatttgaaatttctctttgcaattttgtaatatagaatattctattaactatatttaccacattatgcaatagactttttaaaaaaacatacttctcctaagatttttcaccctttgatcatcttctccccaatctcccaaatccctagcctttgttaactaccattctacattccacctctatgagatcaattgtcttagattccacatataactgagaacatgtagtatttgtctttctgtgtctggtttatttcacttagcataatgttctctaattcattatatccatgttgtcacaaatgacagaatttccttccttttaaggctgaatagtattctactgtgtgtatataccacattttctttatccattcatctgttgatgaacataagttgattccataacttggctactgtgaatagtgctgcaatgaacatgggatgcagtcagagaaattgatttcaaatcttttgggtaaatacccagaagtaggattgctggatcttatggtaattctatttttagtttgaggaacctacctacagttttccataatggctatactaatttatattcccatcaacagtgtataagagttcccttctttttctgcatctgatgaaatgatcatacagtttttgtccttcattctattgtgatgtatcatatttattaatttgcatatgttgaaccatgcttgcatctcagggacaaatcccacttgatcatggtggatgagttttttcaatgtgttgtggaattcagtttgctaatattctgttgaggatttttgcatccatgttcatcaaggatattggcccatgattttttcttgtaatatcttagtctagctttggcatcagggtgatgctggccttgtaaaattagtttggaaatgttcccccttcagaccccaactgcagccctgcccaactgcagataccaaatagcgtaattgcttagccaaggaatacatcctgtgaccaaattaaccagaagccatcaaagtaccttgtcagcagctctgccggatagcagagaacagccagttgtctcaaagaacagtggaaacctaagttattaattgtatatctctcttcttttctaacatatgcatttggtgttataaatttccctctaaaaattgctttttcttcatccccaaattgtgataagttgtattttcattttcattgagttcaaattatttgtttttaaatttctcttgagacttctttggcccatgggttatttagaattttgtggtttaatttgcaaatgtttggaaaatttccagctatctttctgttatgatttctagcttattgctattgtcatctgagcacatactttgtataatttctattcttttggatttgttgaagtatgttttatggcccagaatgtggtctacagaatgccatctagcctttctttatgtagatgcaagtttctgacccatgtcatttttcttttgcctgattaagttctttccacatttctttcagagctggtctgctggaaataaattacctcagaattttctttatctgggaaaatcttcatttctccttcactgttgaaggataatttttctggatatagaattatagaatgccagtttttaatttcaacactttaaagatttttgtttcactcttttcttgtttatttggtttgtgatgagaagtcaaatgtaatttatatccttgttcttctagccaggtgtgatgactcatgcctataataatcccagcactcagggaggcttgaggcaggagaatcgcttgaacccaggagttcaagaccagcctgggcacatggcaaaaacctgtctgtacaaaaataaaagagaaaaaaagaaaacaataaaaaatatatccttattcttctataggtaagatttttttccttctggcttccgtcaagatgttctctttgtcttttgttgtctgtaatttgaatataatattcctaggttttgtgtttttgttttgctttgatatttatcttgcttggtattctttttgtatctgttgtttagtgtctgacaattttggaatgttctcaacaagtattactacaagcatttcttctatcccattctctcttctggtattccaattgtgcatatgttacgccttttgatattatcccacagttcttggatggctgttctattttcattattttttctcttcgcattttagtttgggaattttttattgaccttcaaattaactgatactttccttaaccctgtgaagtcaatggggctatcaaagatattcttcattcacgttgctgtgtttttgatatctagcatgtcattttgagtctttcgtataattttcatctctctgctgacattacacaccttgcacattgtatactttctccattagatctcttaacatattaatcataattatttaaaatgccctgtgccatagtttttaaatttgtatcataacagcctgggtttgatgcttgcttgatctcttgaaaatatatttttcttgccctttagcactcctaatgactttttgttaaaagccagacatgttgtatcctgtaacaggtgctgaggtaataaggccttcagcagaagaattgatagcactcagggtagcagtttggttgtgtttaatgttgttttagctacaggtatcaaaacctttcttgtttttgtttcccttcctggctttcaggcttctctttgtattgctttagagaaagcctatgtcttgcaattctttcatctgcaatccagtattgttactctggaggttcactggtagtaagtgtggagaagggaagtagtctacaatctgattgagtctcagacttttagttaacctgtgtcttggagacatggtgttcacaagtatatctattcctacttcaagggcacggttgtcttatccctgcccctactcccttccctggctgcaacatttccaatggaattccttaaacgctgttatctttcctccttagttaagaaataaaggctggtgctagagtagaattcccttaccctatctgggctatagtttcaaaattaccctctggcaaatttcccccaccccccatccccagactaagtctttgttagaaaaaaaggggaaggagtgttttaagctggatattctttgcctcccctaccaaggccactagcttatcctcagctcagatctttagctcagatcctcagctcagatcctcactgaaagaatccactggattcctagaatgaaggccatgtaagtgtgggccctctctttcccatgattgtgctcccccatgaattttttactcttatactagtaaaatactcagcctccagcaattcatgaaaataatcattcatgtgttcctccagtttatggtaagtaactcttgggaactgtatttctctggattgtctatctctctagatcttaaggtggcagtttgcccttgtcaccacagttctctgataagcccaataaaagttgttaattttccatttgtccaactttttcttgttataagacaggagtaatgacttttaaactctctacatgtaagaacagaaactggaagtccaccacagaattttttattcagtaggtctgggaggggggaagttataaacatattttaaatatatttttatctagaagtatattagaacaggctaatttcaggaattttgtgagtcagttgttaaacatagacattactcaaaattaaattatataaacttattattaaataaatcatattaaaaacaaagataataattactcaaggatcatcacttcctagttatgctattaaattttactactaccgtccagaagtggtggctcacacctgcaatcccagcattttgggaggccaaggcggcggatcactcgagaccagcctggcaaaaaaggtgaaatcctgtctctactaaaaatacaaaaattagctgagtgtggtggcaggcacctgtaatcccagctacttgggagtatgaggcaggagaatggcctgaacccaggaagcagaggttgtagtgagccgagatcgcaccactgcactccagcctgggtgacagagcgagactttgtctcaaaaaaaaaaatctactactacctaattcttgcagttatttaaaatatctattgtatctgtatggtggtgtgctactaagtatctatttgtaacttcccattcagaaaatttatgttgggagcttgaaatctgctgtgatgagaggatttataacatggaaattggcaaatgctgcaaataaatgtttccttgccacctgtgtaggtagcaaaatatttatcagcatacttactgcttaggcctaaaccctagtcccagatattgcaattcaattgacctgaattgagacacaactatgggaatttttaaaaggcataccagatgactttaatatgcattctagagcgaggaagcactgttctggtctaaaaaagaagccagtgggtagaagtagaattgtttaggtgtcattcattttagaggctgactttgtagttggaattcaccagcaacggctgggcgtggtggctcacgcctgtaatcccagcactttgggaagccgaggcaggcagatcacgaggtcagcagttcaagaccagcctgtgcaacatggtgaaaccccgtctctactaaaaatacaaaaattagccaggcatggtggcaagcgcctgtattcccagctattcgggaggctgaggcagaagagtcacttgaacccgggaggcggaggttgcagtaagctgagatcatgccactgaactctagcctgggtgacagagcaagactccgtctaaaaaacaaaacaaaacaaaacaaaaaaattcaccagcaactggccaaagtgatataaatatctatattgtttttcaagtcttctggaggtaaatttgtgttacttgtttttgtttgtttttgatgtagataagcaaagaaaggcttcaaggcaaattgttacataaagatttagtctttatgctaagagtaatgcaaatcctttgaagagttagtttctaagcaaaagaggatgcaattagttgtgtttctaaaaaaatcattctgaatatagtttggaaaaatagattggaaggtggcaagaatatctacagagaaagctgggggaggttatgacaataatccagttttccctgcctccacctgagagaatgagggtctctcctgcagcagacattgctgattggttaggtttttattccaaaccctttctctctctccttgcctctttcttttaatagaaataatataattaatagaaagctaaatacttgattttccaggctcttttaaagctaagggtggtcatgtgacagttctggccaatgagatgaaagcagaaatataaaggaagcggaatggcttctgggaaattttttaccttcctgaaaaatgacagagataggatggtgctattgcccttctcctttctgtctttaatgtggataaaatgcccagagtgagctagagaagatattttgagaccataagaaaagaagaaaggctttaggaaagagaatagcagaacggccaatccaaattctgacaaaattaagccaaaaaaaatcaaagccaaaagctatctcttcttttaatgtgagaaaagtaaatatttgttcaattcttgttagttgggtattctgttacttgctgtcagagtcattcctgttacatcccccaacatcagaaagaaaagtccataaagcaccatttttccaaccttatatcttcaccagtccctcattatcattttaaaggaaaaaaatccttattgcactccaaatcaagtacccctcaagtatgtaaccatttctcccagcacttctgatcatccattattatttcctcattcttgtatcttcattttcataatcccttctattacctcatgttttaccctctgcctggattgagcttcccctacttcttctccaaacaagtaactaatcatctttaaaaacctgattcaaaagtcaataatgttctctgtgaaaccttttttattttacctcaaaggatttaatcactcctttctaagtgttcccatgacgttccacatatgttattatggaactgatcacaaatgtatcagaattatttgtctgcaattagaagctgaatttggtggctcacactgataatcccagtactttgggaggccgaggcacacagatcacttgagcccaggagttcgagaccagcctggtcaacatagtgaaaacctctatctacaataattacaaaaaattagccaggcacggtggtacatgcctgtattcccaggtacttcagaggctgaggtgggaggatcgctggagcccaggaagcagaggttgcagtgagccaagattgcactccagtctgggtgacagagtgagatcctgagaagaagaagaaagaagaggccaggcacagtggctcaggcctgtaatcccagcactttgggaggctgaggcaggcaaatcatttgaggtcagaagtttgaaaccagcctggccaacatgatgaaaccccgtctctattaaaaatacaaaaaaattagccaggcatggtggcggacacctgcaatcccagctacttgggaggctgagagaggagaattgcttgaacccaggaggcggaggttgcagtgagctgagattgtgccactgcacgccagcctgtgtgacagagcaagactctgtctcaaaataaaaaaaaagaggaaagaagaaagaagaagaggaagaagaagaagaggaagaggagaaggaagcagaggaggaagaggaggaagaggaagaagaagaaggagaggagggggaggaggaggagggagaggaagagggggagaaggaagaggaggaggaggaagaggaagaagaggaagaggaggaagaagaagtgaggaagaagaggaaaagaagaggaaaagaggaagaggaagaaaaggaagaggaagaagaagaggaagaggaagaagaagaagaagaagcagaagcagcagcagcaacagcagcagcagaagcagcagctgagctctaacacaaagcgccattggttcctcaggctgatgattcaaaacagtcacccagggaacttaaaaaaatagatattcccctggtaattctcttgaagcgacttcacaagccagcatttggaaatcattaccatatttcttttatctcaagtatccaaccaataataagcatattgactaaataacggactgttactgaaataaacaagtatattttcattacctgtgaaactagtcaatctttcccgtttataggatggttcttccaggtcttctgctattgattcacttgctgatacacttgacttagaaactgtactgcttcctaaaactgacctttaataatgaataacaaaattactcatttatttagatgtccttataggaaactacatatacaaattagaacatattatcagatggagaaatcaaatatactatgatcatataagcaaaatagatacattaatttttaaataatgagttggtttttaatatttcttaaataaaaagttacttaaaatttatttgtatctttatttattttttgaaatggagtctcgctctgtcacccaggctgtagtgcagtggcatgatctctgctcactgcaacctctgcctcccaggttcaagtgattctcctgcctcagcctcctgagtggctgggattacaggcttgcgccaccacgtccagctaatttttttgtatttttagtagagacgtggtttcaccattttggccaggctggtcttgaactcctgacctcaggtgatctgcccacctcggcctcccaaagtgctgtgattacaggcgtgaaccaccgcacccagccaaaatgtattttagaagaaagacatgttaaacatgcttaaagtccttcggtgaattaccaatacatttagtacaaaaatccaaaatacagtcaacctacccagcatattcatcttcattattagtcttcctttactttttttctttttttagttcctcaatcttacagagctctctaacttcagagcctcagcctggaatactcttccttttgtttttcacttggtttctgttcactgttcaaatgtcatcttaaaaatgtgatttatttcattttataaaggccttctcaaggtttaactaaaatatatgtactcagaaataaatcaatggaagaatccaaaaataatttccttaaacatatgaacttagcagtactccatggtattacatactttcttttttgttcctatttatagtctcaactgcccatcaaaagaggatgtaaagtttattggaatatcctcctttaccaggtactcctatatttttgcaggcaaattcagaggcaagctccagagaagcataattgctgtgtattataaaataagagagaaatcaaactctaggagaacagagatttgcatgggagaggaggggaaaaaaggaaagccacctcttcctgtaaaatgcagctcaaaagaagctgaagaaacctgaagaaaaatgtctaatgagaatttgaaattaattgtatgtgattttagtcccatcttttggttgctcaggaagtcttgagtgaaatatatatatttttcacaaatgttttgttgtgagtgtatggaaactctgaagacattaagagctctgcatttaatttaaaacatgagaggaacatagagatggaacactaggatgataatcaaaactgggtggctcatgcctgtaatcccagcattttgggaggcctaggcaggtggatcacctgaggtcaggagttcgagatcagtctggctaacatggtgacaccccgtctctattaaaaatacaaaaaattagccaggtgtagtgggggggcgcctgtaatcccagctacttgggaggctgaggcaggagaactgcttgaacctgggaggtggaggttgcagtgagccaagatggcaccactgtactccagcctgggcaacaggagtgaaacttgtctcaaaaaagaaagaaagagagaaagagaagaaagagaagaaagagaagaaagaaagaaagaaagaaagaaagaaagaaagaaagaaagaaagagagaaagagagagaggaaagaaagaaagaaagagaggaaagaaagaaagaaagaaagagagagagagaaagaaagaaagaaagaaagaaagaaagaaagaaagaaagaaagaaagaaagaaagaaactgggagactggagacaactgatatctaagatacacatttgcaatttaaatggaaaggcaatatatatgatagaaaaaaggaactatataatagtatactctaccttgtaaactgccctaacgtactaggatttattgtattctgataaaggctataggaagatataaattctgatccaagtgatccttcttgtgatgtcaagagtttacttggttttgctgtaccagtaagtggatctggatggtaaagaggtcggggagtaacatcagttccatttatgtcaaatacctgttaaaaatggttatttaaaatgaaataactaaaaaagacagggcttctaaataacagctgctagaaaatagaaacaaatatggtagaaaaaagattagtataatgctcctataataggataaacatgaaaaattggatgctttaaaatgtcatgcttagaaagtttcttaattatgcaaaaactttcttaaaatattatttttgctttatctatatgtaattaatatatattaactttaggaaaatcagaacagtggaaagataattcatccagattgttagtattttggtgcatgtaaattgtatgtacacattttaaagaaaactcactatttttcacttaacatttcattaataggcatttcccaagttattatatgcttttggtttacagttctgcaccacaaaatgattcagtcaacaatggaccacatatatgacagtggtaccataacattataacagaactgaaaagttcctatcacctagtgacatcacagtcatcataatgtcatagcacaacacattactcacgaatttgtggtgatgctcgtataaacaaacctactgcactgccagtcatataaaagtatagcaatactattatgcacagtacataatatttgataataataataaattatgcttctggtttatgtgcttacgaaactacactttttaatattttagagtgtactccttttatttcttaaaaaaatagttaactgtaaaacagcctcgggcaggtcctttagtgggtactctagaagatgatattgttataagagatgatagctccatgcatattactgcccccaaaaaaccttccagtgggacaaaatgtggaggcagaaaacagagatattgatacagttgaactctttttatatatttattcctattttgatttccgtttggagggggagaatttcctattcaagtcctttgcacaatttttattgagacttttttattattggtaatgtatgagtcctttcagttgtatgagctgcaaatgtcttctttcactctgtggctttattttctttatggtatatttgatgaatatgagttatttttaacgtagtcaattgtatcatgttttccattatggattgtgctttagacatctccttaaaaaaaacattcccagccctgaagtcctatatgttgcttttcatatttaagtctataatatacccagaattaattttatatataggataagaaagccaatatatttttgttttataagaacatccaattgtctcaacaagagtttttgaaaatcctgtcctttccccattactctgcagttcacatttattataaaataagtgtttatatgtgctcaggtcatttgaagactctctaatttgctaatattatatgttttattaagcctggtatctaggaaagcaagtgtttccactgagtttttatgcaagtgtcttggctatttttagcctttagcatttacatataaattttagaattatcttgaaaagtttctggaaaaaataactttaaaacttgagattttgattaaaattgcaaagaatctataaatcaaaatttaggataatcttaaaatattgacttttgctctgcacaaatatgtctatatctccttttgttttggtcctctttaatgtcttccaataaacttttatagttttaaaaatattggtatatgcatcttttgttatatttttccacaagtgcttgataaatgttagtgctattataaattgtatcattttaaaatgtctaatttttggatgggcacagtggctcaatgcctgtaatcccagtgctctgggaggtcaaggcagaaggactgcttgaggctaggggtttgagaccagcctgaacaacacagcagaatctcgtctttaccaaaaatttgagaaaattagcacacacctgtagcccacgccacatgggaggctaaggcaagaggactgcttaagcccaggagtttgaggatatagtgagctatgattgtgccactgcactttcagtctgcatgatcagagcaagactcatctctaaaaaaatttttttcaaataaaaaaaatctaatttttgaactatttgttgctaacaaatattcaatccacaaatattcaacgttttctttcttcctttccaattcttatacattccatttctttttcttaccaatttgaactgatttatgttgaataaaagggggctcttttttgaaatgcttcaccatttgacatgatcactactgtaggattttatagatagcctaaataagatgtttaaagttccttgtgattctcagtttcataagaatttttaaaatcatgaatattaaatgttaacagatactttctgtctatattgaaatgatcatatgcttttttaccacattaagctgttaatgtggtaaattacactaagggtttttaaatgttaaaccaatcttgatatcttggcacagaccaagcttccttatgatgtatgtattaagcatttgttgttgttgttgttgttgttactgaactttattggataatattttattgaggatttctctacgtttgcaagtgaaattggcatataatatttgtttctcatactgtattcaggttttaatatcaaggtaatgctagcctcataaaatgagttttggagtatacccacttttagtgttctgttttcatctatgtatgtttgacacataccacaattgaagtcatctgaatctggaattatctttgaaggaaggtttttaaatcactcatataaatttctttaatagcttccagttttcaatttttgtttgtctgctttggtaaagtgtaattttttaaaagcttttttacattttacctaaattttcaaaattcaaaattgaaatacaataacataatatgcattaatgtgctttttaaattgcttttaacatgtacaattcaatagcttttaatatgttcacatatatgtgcaccaaaattaattttggaatctttttacacttcaagaagagactctgtatccattatgatccctgctatggtttaagtgtgtgcaccaaaagttcacgtgttggaaatgtggtcccaatgcagcagtgttgagagctttgactttggaaggtgactgtgtaatgaaagcttgtcctcacaaatggattaatccattcatgaattaatggataaatgggttatcaagggagtggtttagtcatcacaagagaagtctgttataaaagccagtttccctatctctcataaacttccctcaccatgcgacaccctgcaccacctcagctctctgcagagtccccactagcaacaaggccctaaccagatgtggttccttgaccctggacatcctagcctccagaactgtaataatattcttttgtttataaattacccagtatcaggtattcatttacagaaacagaaaacacactaaaaaaattaataccaagaagtgggactaataacaaacacctgaaaatgtagaagtggctttggaactgagtagtggatagaggctggaagaacttagagaagcagtctagaaaaaggctgcattgccataaacagcactaagggtgattctggtgagggctcagaagagcagactagagaaagtctgaatctttttaattgcttaagtggttgtgaacagaatactggtagaatttggaatagtaaagacttctgatgaggtctcagacagaaattcttattagaaaccggaataaaggctgtctttgttataaagtagtaaacaacttggcagaatttatggaaggcaaaatttaagagtgacaaactaggatacctggcaaaataaatattaatatctaagcaaagtgttcaagatgctgcatggttgcttttgcttgcttacagtgagatttgagaacaaagggatgagattacaaaaaacaatttataatcaaaagggaagcaaagcagaaagatttggaaaagtctcagcctggccatgtaaagaatgaaccaagggtgtggcccagaaaccatttgctaaggagtttagtacagatagaagggatcataaagacagtggaagaagactccaaaggcatttcagagatcttctaggtggctcatcccaacacaggcccagagatctaggagggcagaatggtttcaggggacagaccctgggtgcccttcaagagcccactacccagaactaccttgggtccccaaattttggcaaggagtcagccaccccagctgtggcacaagtgacccccattggggctgtgcccactactccagaagatgtgagtcataagccttggcagcatccacatggcattaattctgcaggcttacaaaaagcaaaagctgtggaggaattaagatccatcttaattccaatggatgtatcagatggcctgggagtctatgcagagatttatcacaggggcaaaaccactgcagaaggcccctaaagggtaatgcctagtggagacatgggagcaggattgccacaggaccccagaactacagagctatcagcctgcaaagccagcctgggagagctatactgtagactgaccccagcaaagtcacagggtcagggatgcccaaggccctggggacccaatccctgcaccagtgtgtccagaaggcagtacatggagtcaaaagatattattctccagctttaaagtttaatgtttgctctgctgagttcagactgttttgagacctattatttctggcctattctcccttttagaatgggaatgtataccccatgtctgtccaaccattgtatcttggaagtaaatagtttgttttgatttcacaggctcacaggtaagactctgggcttttgagttgatgttggaatgagttaaggcgttggggctactgggatggaattaatgtgttttacatgtgaaaaggatgtgaatttgggggccaagggcagaaagttatagtttaaatgtgtgtctaaaagttatgttagaaacttggtccctaatgcaatagtgttgagaggtgggacttttgggaggtgactgggtcaagagggctctaccctcataaataaaataggttatcaagggagtggattagttatcatgagaggggtctgttataaaagtcagtttctccatctcttgtgagcactcctcaccatgtaataacctgctctactccaggaccctgcagagagtcccccactagcgaggagatcctcaccagatgtgcccacttgaccctggacttctcagcctcgagaaatgtcagaaatacattgcttcataaattacccagtcttgagcattcagttatacaataacaacagaaaacatattaagatagtcccctaacatctccgctcccagccctacgccaccactagtatcttcatgtctctatagacttccctattcaggagtttgatagtgaatggaatcatatactgtgcagtattttgtgactggcttgtctcacttagcatattttcaagattcatgcatcagtgcttcattcctttttatggttgaataatattctattgtatggctatacaacattttctttacccacttttccattgatggacatttgagttgtttccaccttttgtctattatgaataatgctactagaaacatttgtgtatacccttgtgtgtggaaatatattttatttctcttgggtatatacacctaggagtaggattgctggttcatatggtaacactgcttaacctcttgaggcacttccaaactattttacaaagtggctaatttatattcccacaagcagtgtatgagggttctgctttctttacttctagcacttgttatgtgactctttgattctagccatcttagtgggtataaagtgaatatttcattgtgggcttgatttcaatttctctgatggctaacaacgtccaccatattttcatatgctttttgatcatttgtatatattttcttgagaaatgagcattcagattgtatgatgaataattatttgtctttattaatgaattgtaagagttctttatatatgataaaagctcttatcagatatatgtttcacaaatattttctatttctgtgggttatcttttcactctgtatatgcttttgatgcaaacatttaaaaattttcataaggtcaaatttgtctactttttcttttgttacgtatgctttcagtgtcacatgtaagaatcctatgccaaatccaaggtcttacccctatgttttcttctaagagtgttacagttttagctcttaaatctgtctttaataaattttgaattagtttgaaaatatgaggtaagggtctaagttcattcttttccaggtggcaatccagttatcctggaacaatttgttcaacagaatatcctttccccattgagtgatctcggcaatcataaaaaaatcagttgactttaggtaaatgggtttatttctgaactctcaattgtatcccattgatctacatgtctatctttgtgccaataacacatgattttgattactattgctttgtaacttttgaaacagcgaagtgtgaatcatcctactttgctctttttcaggatgattttggctcttctgggtcctctgtgattccatatgaattttattttattttatttttatttttttgagacagagttttgctcttgttgcccaggctggagtgcaatggtgcgatcttggcttatggcaacttctgcctcccaagtttaagcgattctgctgcctctgccttccaagttcaagcgattcttctgcctctgcctcccgagtagctgggattacaggcatgcaccaccacacccggctaactttgtatttttagtagagatggggttttaccatgttgttcagggtggtctcgaactcctggtctcaggtgatccacctgccttggcctcccaaagtgctgggattacaggtgtgagccaccgcgcctggccccatatgaattttagaatcagttgtcagtttgtagaaagaagtcagctggaattctgataacaattgtgttaagtttacagatcagtttggggagtataacgatcttaacaatagtaggtcttttgatcatgaccatgggatactttcccattgaattagatcttatttaatttctttcaataatgttttatagttttcagagcatacattttgcacttcttttattacatttattcctaagtattttactgtttttgatgctattgtgaaataaatcattcttaattttcaaatggttctatgcatgtgtctagaaatacaattcatttgcatattgatcatgtatccggctgccttacaaaactcatttgcaagtcctaatagtattttagtgaattccttaggagtctgtatatataacatcatgtcatctgcaaataaagatgtttttacctcttactttccgaactggatgccttttatttctttttcttgtctaatttacatgcctagaacctccatgataatgttgaatagcaatgcaaggacttgtcttgttcctgatcataaggagattaagtgcaattaagtataatgttagctgtggggtttttgtgaatcctttgtcaagttgaggaaattcccttctattcctagtttgttgcgtgtttatatcatgaaaagatgctggattttttaagatgcttttcccttcaattttgttgatctttttaaagaaccagcttttgttttcattgattttctctattgtttttctattcaatatttcattaatttccacccaaatattttttatttcctcccttctgcttatttcatgttattttgtgttattcactcttttttttcagtttcttcagttggaagggtaagttatttgagatctttcttctttctaatacaaatgtatatctacaaatttccctctaagcagtgctttagctgtatcccataagctttggtatgtcatgtcttgattatctatcatctcagaatattttctgattttccttttaatttcttctttaacttactgattatttacctatcaccatcacaatagtacattatttctattagtgaatatttttctaatgtagattttaatttcatcaatgatttttcattatattttaaggttgaatatttcattgtgtatatataccactttttgtgtatccagtcatttgtggatgaggactttagttgctttcaccttttagctattgtgcataatgctgatatgaagatggttgtacaaatatctgtttgaaactctgctttgaagtcttttgatatatactccttcctgaatcatatagtaattctactttcaaggtttggaggaatcacgatactgtttttctttccttttttcttttgagaaaggatatagctctgtcatttaggctagagtgcagtggcacgatcatagctcactgtagccttgaaattctgggctcaagtgattctcctgagcatctaggcatctaggactacaggcttttgccaccacacctggctaatttattttttcattttcttatagagatggggtcttgctatgttgttcaggctggtctcaaactcctgacctcaagcaatcctcctgcctcagcctcccaaagtgctgagtctggcatcaagcaatcttcctgcctcagcttctcaaagtgctgagattacaggtgtgagccaccatgcctggccctacaataccatttttcatagtggccacaccatttcacaatccactaacagtatgcaagggtttcaattcctccatgtcttaccaacacttattttgttttgttttttttaatagtagctgtcataataggtatgaagtggtgtcttactgtgattttgatttgcatttccctaatgtttagtgatgttgagtatcttttcctgtgtttgttggttatttgtacatcttctttgtaaaaatatctaatcaagttatttgcccattcttttaattgggctgtttctttgttgtcaatttgtagttatttatatattctggttattagcatcttatcaaatatataatttgcaaatattttgtaccatcctgtgggttgttttttcactctgttaatgtcttttgatagacagaaatttctaattttaatgtagtccaatatatatattttttctttagctgcatatgcttttgttgtcatatgcaagaaattgttggcaaataatttcttttccctattttcctctaggaattttacagagttagctcttatttggggtctttgatccattctgaatttatttttgcagatggtataaggtaaggatccaacttcattcttttccatgtggatatccagttgtcccaacaagatttgttgacaaaactgtcttttctccattgcataatcttggcttctttgtcaaaaccatttgaccatatatgtgaaattttatttctgggccattccattccattggtctataccgtatgtttgtttttattccactaccaccctgtttggattactatagatgtgtaataagttttaaaatcaggcagtatgagacttccaactttgttcttcttattcaagattgtttgggctatttgcatctcttgatatttcatatacattttaggataggtttttctacttctgaaaaaatatcactgggattttggagggaatgtattgaatctgtaagtcactttaggtagtattgacaacctaacactattacgccttccaatctatgaacaagaaatgtctttctgtttactggtgtattctttcctttcttttgtgttttgtagttttcagcatacaaatctttggcctcctttgttatgtttatccctaagtatttcattatttttgatgctattgtaaatgcaatctttttcttaatttcctttttggaaattcattgttagaaatgcaactaatttgtgttgttgattttctgtcctgcaactttgcagaattttttagttgtgtgtgtgtgtatgtgtaatttttacagttttctgcatatagatcacatcagagagaactttacttcttcctttccgatctgggtgccttttatttattttgagacagagtctcagtctgttcctcaagctggagtacaatggcgctctctctgctcactgcaaccctctgcctgccaggttcaagtgattctcctgcctcagactcccaagtagctgggattacaggcacctgccacgacggctggctagtttttttgtatttttagtagagacggggtttcaccatttggccaggctggtctcgaactcctgacctcaagtgatccgcctgccttggcctcccaaagagctaggattaaaggcataagccaccatgcccagctggatgctttttatttcttttccttgctcagttgccctggctaggactgccactactatgttgaagagaagtggtaaaagcaggcatcctccttttgttcttggaccttaggagagatgctttcagtctttcaccattggagaaaatatacatatataataaatattttcaccattggagaaaataattttatatatatataaataaatgaaatatagtttgtgtgtgtatatatacatatgcatatatatttaaatgcatgtattcatatatatgtgtatatacacacataaataagtgaaatacatatgtgcaaatatatagtatttgtttaataaaatgagagttgttttagttttccgccattatatgtaaaggtgctatgaacattcatgtagtagtgtttatataaacttatgctttcttttctcttggtaaatacctagacatggaatagctggatgatatagtaggtatattttaacatttaataagttgacaaataattgttttctattttccatgtctaccagccatgtgagagttttagttcctccacatacttgtcaatacttgatatgatcagtcttttaattttagccattctaataggtacttagcagtattgtatggtttttaattaatactgatcatcttttcatgtgctcccatgctatctgtttatctactctggtgaagtgttagctcaagtattttgctaatttttaaaaattgggttgtctcaatattgctttgaaggttgtttatacattctagttataaatattttatcaaaatatgctttgtaaataattctccccattgtgtcacatttctttgcattctgttatcaatgtctttcaaagagaaaaagttttaattttgatgaagtccaatttatgaattttatcttttatggactctgcttttaatgtcccatctaaacaaatgctgaacccattcaaaattatatattatatgcttttctgtatatatataatcatttgattaaaagtttaaaagagtcaattcttaattatgaatcttctagtaaggcaaaataactgactttatgacaaataattttattgtattttcaagactatattgctgacaacagtgaaagatagttgtaatgtatataattaataccataagcaaatagttcttaaggtcatgaatagacttttctcattccactctaatattcttcttatcaataactagttataggagccaagtgtcaatattatgttgtatggaataatatgtggtaaaaattaacaaaatcagtatttcaaaattatgagtgattatctgaaagcagcatattttctatctttaacatttcaattgagtttttcacagtgccattttcaaataaactcagaattctaagaatattacctgtgttgtctttatattgggatttggtttttctacagttttcagttcaggtggaataagcacggttttggacacagccattctgctttgatttgcaccagtatatcctttcactgaagttgctttcattgtagcaaaaaagctaatagacttctttggttgtgtggcattgttcctatataagaaaaataaaatataatgcaaaggattcaagattgaaaagaaaaatcaaccaacaataaaaaagtagatttcctgtaaaaacatgtgaacaatctaaacatataacaagaaataatgataactatttgaaatcttattatgtataaacatagttctaaagagttggcatatattacatcactttctcctcataattccaagaggttgctattaatattattttatataaagccacagaggctttaaggggaaacattcctacaatggttgagatttgaacccaggcagtcagatcctaagtccatgctgacttctctgggtcttagtttctttgtctgcaaaatgaggataataacagtacttaactcatcggttattatgaggattaaataaattaatttttgtattatggttagtaagtccctggcacatagtaagcacacatgagtgtgtagtgcagttacataggcagatttaaacatgattaataaagcctgagaaagaatagcgtgttccttcctgaattatatactactttttttttttttttttttttttgagacggagtctcgctctgtcaccctggctggagtgcagtggcgtgatctcggctcaccgcaacctccgcctcctgggttcaagcgattcttctgcctcagcctcccaagtagctgggactacaggtgtgcaccaccatgcctggctaatttttgcatttttagtagagaggggtttcaccatgttggccaggctagtctcaaactcctggcctcgtgatcgtctcacctcagcctcccaaagtgctagcattacaggcatgagccactgtgccctttttaataagaagagaagttacaatcaaaatatttatatccatgaaaaaatattttttcacttttggatttaccctgtaaattccttaagacaaggacttaccttatcattttattccttctagtactctgtaatatggatttctataaaatggggatgagcctccctgagattataaaaatatgcttccaaagaaaacattttaaataatacatttactttttaaatcataaaaaatctgacaagaataaaatatttttaaataacgatcaatccagttttcatattttatttttcttcatagcatttatcgttacttgacattttgttgttgtccacccctctgcagaatgtaagcatgtttagggcaggaactttgtcttgttcactgctgtatccctagcacccagcacagtgcctagtataccatggacacttaataaatatttttaaaatatatgagtaaatgaattccatttgtgcactatttcaaatttacatttaagtatcctaccctattctccttctatctctaaggacttaacccccaacatctctaaaaaaaaataaactatcattcatgtaaaaattccttcaaattatttcaccacctcctttaaattcttctcccacctcctacaaactcacttatctcttttttcctttctcagtaaaagagttgccattcttatctaagactaaccttttatgtgaactctgaaacttgtcactggtgtctcagggactcttctccatccataattccaggtctcctatcttatttttttctcttttccctgtgagcataaaattatgccccaatcatctcctcaacttgaaaatccttcctttaactatgtcttcctctacctattactatatctctccttcctttcagtccaacttcttaaaatgttagtcagtaatactgcctactacatgacttctctttttgctctgtaactacaatgtagctttactctttcttcttcagctgaccattccttcttaaaattgacttctcagattcgtttctgtcataccacagactattcttcaacctccttgagacctctaatcacctgacctttccatttctaccaaataatcagaacattttagatttctcttttctctattaatctttaatccacaatttatcaattgagtcactcttttgccattaccttcaactctctcattctcttcctccttaacattttgccctactatccttacaaaatccggtcctcccattcccttttcctttgagctccccttttacagattacgtttaggctcaaatcttagttacctgatttctcactatatacactatccctgagtaaattccatggtttcaatgaccacaagtactctactttcttatggcatttacctttctcttctaccatcctctgaagatttcatatcctaagtcactggctctatctctaatagctacttctggcataattcttgagcatttcaatatccatgaaggtaatccttcaaataccctgacctcttagctccttgaaatcttctcacataaatgattttacctgccttgctacttcagacacttactcccatggtcatacatgtggcttttgtttttagaaggtcaatcagcatttcctatttttccagcttaaataccctctcaaactccaatccttcaacaatccttcgaccctattatgaccttcaggcccttgattctaccatgctttattcctctaccatctttctcatgccatctcttccctcttgaggttatggttagttactttaattgatagttaattattataatcattctttacttacattcttaccatacctttcccttcatttcagcatacttgctggcaaaaccaaaatcatggttatttccaattatcctcttactttgagcctatacctgtatattaaccatgtttatagtgtctgtaaatttgatactgtaacatctgacctacatgcatgggtcaaacacatgccctattctggacaacctgatgctatgcctaagttaccttgtcttggcctctggcctctcttcttgcctcccatcctctttactaagaggagtcctcctcccaggcatgcacttgtcaaatgcaaactaagcaatccagaatccacaccattatggggtttttacactctgtgccactatacctgtcctaatcaccccatggccaaatctcagaccaagaggggcagctcctgtgccccagaacctactgagattattcaaagtagctaatcttaaagttgtctatgctgcttcactcattacttctgggtagtcccctgtggtgtggtgggccccctcttccttggaactgtgaataataaactattttttcaatggcaatgacttcctatctattagactaactataccctaaattttgcaataatacactatattttaactcaacctgtgcagctaaatgaaactggaagaaaaatacccaactatgatgacaggtctcactttaaattatgggtcattaacttaatcaaggtccttaatgtgccagcaatctgtattttcttggtccattttttactacactctttaaggctatcttataccttctctttcttcaaatatgaaaacctcctctcacattttcactctcagccatctgaatgagaaaactgaagcaatctggtaacttcttcatactcccactgtcacatctatgcacttgcctatatctgtgcctatattctctatttttttcttgttactctgaatgaattctctattattgcagttcaggtcactccctctacatgcataccagattccatttttctgcctattcacggacattgctctagcagttctctctctgcatcataagtttttctctctctattggataattaccttcagcatgtaaacaagctgttatttctcccatcttaaacaaacaagaaacttctctttacttcacctgtctttccagctatcagtcattcatgtttcctttaattacagcaaacccttgggaaaaatctcctatttattgttgccacctctctctacacacacacacacacacacacacacacacacacacagtctctcttgaatagagtctgatcaggtttttgcccttatcattccatcaaaaggattattaccaaggtccaatcacctccacaatactaactctaataatggtcatttcaatgttttcatctttcttatctgcagcatttgacccagctgtttattcttttctctttttttttttttaacttggatcgtaggacactctctttgcttggttttcctcctcccttttctgtggcaatcatccttgcacttctcttttctatttacattcatagtctggttaactcatctaatgccatgatttaaaagtaatctatgtgaaaattattcccaaatatatgtatatctctaactagacctctcctctgtatatctgcttgcctacttgacatcactaatggaaacttagcatgtccaaaactaagttcctgacattaacctccaccaccaccaccaccacatcaccctcaccccatccagcaaatccactcctcttgcactcttccctatttttgttaagggcaactttactcttccagttgcttgggtgaaaaaaaatttcaaaatacatctggaatccattcatttgtcaccactcttgttgctaccatcctggtccaaacactatcctatctctcttggattattgcaatagcctttcgcttcatcttcctacttaaccttgatcccctaaagtttatcctccacgtaacaaccacaatgacctctttaaaacacatgtaagggttgggcacagtgacttatgcctgtaatcccagtactttggaagattgagacaggaggattgcttgaggtctggagttcaaggttacagtgagctatgattatgccactgtactccagcctgggcaacagagcgagaccctgtctcaaacaaatatagaacaataagataaaataaaataaaaataaataaaataaaatatgactactcgaaatccttcatttaccatcccattcagaataaaagcctaagtccttactatgacttaaaaaatcttacatgcatacagctaggcctctgatttcatctttcgtgatctcttccttgtttactctgcttcagccatagtggcatcctttatattcatgctgggcacattttcatatcaaagacttgaatttatgtttcctttgtctgaaatgctctttctcatacaggtacatacttagcatcctcactttctttaggtctttaatgaaaaactaccctctccccacctgccctaatcactccatggccaaatgccagaacaacaggcgcagcccctgtgcctcaggccttccgtggcttccctttctaaaatgtcaaaattctctctcaagtacttcatatcttcttgccttatttttctccttagaactttttactatctaacatagtatatctttaacttatttatcttgtgaatcagttattgcttccccttggaatctaagttccatgagggtaggaactttaggctctttcattccctgttgtatccctaatgcttacaacagtacccaagtgtggaaaaaacataaactgtttttgctctgctctcaaaccacaacaatcaatacagatttctgtggccaaatgcgtagggtttctccccacacaccaactaaacaatcagttccgcagtggataccatctggttgtcctccaattcaattccagcactatctacctgaagatagtctcagatcctacaggcagagagctcagtcccataagactacctctgacttcgaatggcagttgaaaaaataggttgtggcctgtttctgaatgacctgctataaaatcagggttcccacaaccctctccttgggttcagttaatttgctagagtggatcacagaactcagagaaacacttacttttactggtttattgtaaagtatattacaatggatacagattaaaagatgcatacggcaagggaagagccagtagcttacatgctctctctgggcacaccaccttttagaaacctccatgtgcccagctatccagaagctctctgaacccagtccttttggtttttatggaggttttattaagaaggcatgattgatgaaactgttggctattggtgatcaacttaacattcagcctctttcccctccctgaaggtttggttggtgaggctgaaggtcccaaccctataatcatgcttttgtcttccagatgactaacccccatcctcaagctacctagaaggtactagtcatggtcaactcattagcatacaaaaagacaacactctggagattctaaggaccatttgatcaaagaccaaataaatatttattttacaatatcacagtacataatacagtggctgtttaatacatttattgaaacaatgaataatctccaaatcattatatccaactcaaaatattgccttactcttcatacttgtgaaggaaggagtcaagctgagaaatgctcaggataaacctgccttccattctattcaaagtcatccctctgctcatagatgcatatttttttcttttctttgagacagagtctcactctgttgcccaggctggagtgcagtggctcaatcttggttcactgcaacctctgcctccaaggttcaagtgattctcctgcctcagtctcccaagtagctgggattatatgcctgtatcaccacacctagctaatttttgtattttcagtggagacaggtttttggcacattggtcaggctagtctcaaactgctgacctcaggatctgcccgccttggtctcccaaagtgctgggattacaggcataagccagcgttcccagctgatagatgcattttctgattgcctcctttggaaaggcttatcagaaactcaaaagaatgaagccgggcacggtggctcacacatgtaaacccagcactttgggaacagattacttgaggtcaggagtttcagaccagcctggccaacatgtggaaacctcatgtctacaaaaaaaaaaaattagctgagtgtggtgggacacacctgtaatcccagctactcgggaggctgaggcaggagaatcgcttgaatctgggaggtagaggctatagtgagccaagatcacaccattgcactccagcttggggcgacagagtgcgactgtgtctcaaaaaaaaaaagaaactcaaaagactgcagccatttgtctctcacctacctgtgacctggaagccttctctctgcttcaagttgttccacctttctggatggaaccaatgtacttcttacatatactgaatgatgtctcatgcctcccgacaatgtataaaaccaagctgtgctccaaccatcttcggcacatgtttccaggacttcctgaggctgagtcacgggcgcgcatgctcaactttggccagataaactttctaaattaactgagacctgtctcaaatttttggggttcacattttggtaaccacgaagggattctgaacgtggatgcccctgacctttgacaaatttcctatcagtgcttgttaacagcatgagctaactttatggctcaaaccaataggaccatttgctgaggtctgagagcacccccttcagagaatccctgatctcccaaaatttgctagggatctaaagtttattttgctgtacaactcccttttttttggagttttacttgcttccaacacaagaatggcaagtttttcctgcttccgtgacgatggaaggcaggtaactcctttatggagtttgagcttgcttccaacagggaaaatgagggttttttggtttgtttgttttttctttcctgcttctaagatggtagaaagcagtcttcagcctgagacccatccctaggtaagtaactgacttggggttttccttggctcaagttaagattaacaaccagctggtcttaatttctcctcacaattagagtgctcagtgatgatgttgttggggatttttgttgttgtttgttctggtttgaagttgctgtttaaggatcctaattctagttcaaagatgcattctacaaagtctttattgctttttctcccaaatttaatcttaattcggtttgtctgtgtgcatttggatgaggaactgaactgttgttttcatatgttaatgagagactgagttttctcagctccaaaggaaaagggcatttgctcctccaaactgaaaggtgcccctgggtaccctgggacctcgtggaagtatctgggcaattgtggccctgcagggaaatccccaacaaaaattaattttaaaaatggcttgcccaggaaatatatataagggctaatgacccagcattttgagccctctctgaggtcacagacctctggagagagaaactgagacacagtaagaaggtggaggccgggcgcagtggctcatgcctgtaattccagcactttgggaggccgaggcgggcgaatcacgaggtcaggaaatcgagaccatcctggctaacatggtgaaaccccatctctactaaaaatacaaaaaattagccaggcgtggtggcgggcacctgtagtcccagctactcgggaggctgaggcaggagaacggtgtgaacccggagcaggcggaggttgcagtgagcctaggtcgcgccactgcactccagcctgggcaacagagcaaaactccgtctcaaaaaaaaaaaaaaaagaaggtggaaacgactcagtggtgacacacagtggagtcctgtccacaaacggcacatatcaatccaccacacaaaaaccccaggccacagctctgttcctcctttagaaaaaaaataaaaataaaaaaataaaaagtgggaaataaataatctaagagtgaggtgaaaacaagcagaatgcatctttctagcattccataggtttcacggcacctctacttgccaaagtatacgtaaaatggaaataatatggtctttgtgcacatttacaaggtcaacctgcaaactatagagttcctaagtcctctttttctctattttttttccttttctgcctgctctaaatctgctgttacttttctgttaagataaaaaccagttttgatccaacaagttcttttagcaagccagtgaatttgtatttatctcgtggctaaaagttctgaagtaaaagctatagaatctgtgtgtatgtgcattaaaaagacttttataatttctacaattttatgtttaatggcaattaaatccgttttcatttccttctagcacataaaactttttctctccgcatcttataatgtaaattttgctatctgactttcacctgagttgtttcctttaacatgcacatttaaggctatttagctgacaactgcccagggttgtgaaacaggttatcaagaatcagaaaatctaagataggaaaaaatgaaaaaaaaaaggtttttatgaacctataaaatgtccttctatttgcatgcctaatatgtctatgtatctatgtgttgtgtacacaatgtttcactactaaaaatatataaaagagctctaattaattggcttaaaaataaaagcacttaaatcaggtactaaaaaggaaaagactagtcaaatgctttttcgagtttatgtaacttaagtaaaatctttaataaataagctagctttaaaattactggtaaagtaacattagaaatgtcctaagaattgccagcatacattttgtttgcatttattaatcaagcaatttcatacttatccctgacaaatactataaggtgtcaaaatttggcaaagggtttataaaaccataaacccagcccaagacagaatgacctttgctctgtaatctttaataaataagacattaatattggcttaatgaaaatagctcatcttgaattatttagtaagattaccataacttctaaacctgtggctttaggcattctagtccacaggcaataaggaggtttgttttgggaaagaactgttatcatctttgtttcaaagctaaactataaactaagtacctcccaaagttacttttgcctgtgcccaggaatgaacaaggacagcttggaggttagaagcaagatggagtcagttaggtcatatctttttcactgtctcagttataattttgcaatggcggtttcataactttaaatcatgactactgcagttttcataggtcatataggtaaacaattaaaataattaggtaaatgtaatggaataaatacttgtagacaaacttgtcataatttagaatctaaggttatattaaattcaataattgatatttcattatttattttccaaaaagtttatattgtagaaaaacattcttggtaaaaataacaaagagtgtatcattttaaaaaaacggtgaacaagttttgtctaattcaaagtttatttaaaggttatatataaaacaaggtaaaaggaaccaggaaataacagaaatgtaaagaaagttataaaaataaacaggtttttgtgtggtaagaaagcttaaagagaataattttatatgagaaaaaaaatctttggtcaagcacagtggctcacgtctgtaatccaacactttgggaggctgaggtgggcaggtcacctgaggccaggagtttgagaccagtctggccaacatggcgaagccccatctctactaaaaatacaaaaattagctaggtgtggtggtgtgcacctataatccatctacctgggagactgagaaaggagaattgcttaaacccaggaggtggagaatgggcaacagagcaagactctgtctaaaaaaaaaaaaaaaaaaagaatcccatatggtaaatttagtcctaaaataaaatgactggttgtttaagaaggagggatgttcaggacaaaccagaaagttcaagcatatcatgaataatcagtgtaaatcacaaaagaggatttattttaaaaaaaacttttatatgatcaagttgtcatattgttttgctttgcttacaaataaagaaattgagattaaattttttttaaattaaggttattacatccatgtatctttctgtatctactcctaaagtacttgtgacattaagttacagggttttgactcctgggtctaaaaggacaagtcctgctaaatcttaacactgacagcaattaaagccttatctccaggccccatagaagatgctaatcaaaataaacggcatccctgagacacagggccaataattaaagccattcaactcttcaaggtcccgtgactgttgtgaaagaggttggaatgtgggattttaagggctgcttttaagagataaaataagttcagtttctctataatcattactgtcaaaggcacactgatgcaagaccagtatatgggcccctgtgtcagattaacagggttttcttgaagcattaaccaactccttaataaaggttataaaaggcatttggaagctgtattgctttatgttatggtcaaaattaaaattttatagtttataaaattttgaaaaataaatttaattggcttcatgctgttttaattagggcttgttcagaaaattatgtctcctttctcaaagaatgaagatttttgccttttttttttaattccttatcactttggttaaatgaatgacttattttacaatgacctatgatcctatttcatggtatcaagtcttttaaacctttgatattttacaaactttccaaaatcaatttataaattgtcttttcctgacctaattaatcctttaagatattaggtcccctaaagtccaaaaatgacataatttggcttatttggtataaaaattagacagggagcattgtcaaatatgaaatgatgtttggttttctttgggctatatttgtataaatgttattggtatgtgttccaaaatgatgggaaactcctgtaattctgatttaacttagtgaacgttatcagtaattgtaattgttgttaaattattgtgtgccacagaggtaacacatttgtcaattgtgtctttgattatggctgccctaaaatttttgtcatccatggacaattgttgtcttgttttggtcctttttaggtggttctataatcaactatggaactcaaacaggtgttcttaaatgcaagtttctgataactttgcagattgtgacattagaatagagggggaaaaaaacttgcaggattctcatggagagctgaagtgttcatgactatcaagcagaacaggagttaactccataaactgaactgacaagagactaaagcaatctttttaactcttgctttaaatgttgcttatcctttgttttttagtcttcaaacttttcttttgagctattgacagcttttaagagtttagtatactcctatgaacaaaattttgagcatatttgtttttcactacctgatttctccagaatttggaaatatttgtgagtattcttaacttatggtaatacagtcatttgcacaagtgcaataagaatctgttttaattcgtaacaggatacaattggagaaattggttattttaccaaggctttgactgaaatagtgtgctttcctttaaggaatcaaacgtgacttatggaaccaataaagcccttggaaaaactggcctcatattttgtgtacatagtccctgtacagggtttctgacctgtgttaagtgaagaatgtcactttctgacaggcccagaagcctcaggtttatcttggaacctcaagaggagaggaaattcacccaactcataggtatttgattgcataaatccatggctgggcttggctttaaaagagtcttatttgagatttctcctatgaaagtccaaaaaagccagtttaaaagcctatgtaaaaattttcttgttgcattgtatagaaataattaggccaagtataataaagcaaaccagtcgtaccatgatttgtctttagtaaaaatgggaaactggagagaaaaattatgtttcaaaactatagtagacctgttgttagattctagtctttcctaatgttttctcaatgtttattattttctacagtttggaccaaattctaatttttcttggccacaagtcttcaaaataatgttttcaattttcttccttcttttttgccccatttttcctaagttggagtcactgaaaactaagctgtgctttcttaaagccctgtgaactgaagccagacaacttaaacttcagaagaaaataaacagcaacctatttacatacataagccactttcatacctacttactgatgtatggacttcagagtaatatagcctatatcaatttttccagggttgttcttttgttgtttttctcccttcctcccgtttcctcttcacaggacatgagacttcacaatctgctaaaaatgagctttgggacctaacccatctaggaacaaactgtcctagccatgagagatcagataaaacctgagaccagagactcattttcttctaaaatgttttctccaaaagatttttttaaaaagaaatgggggaaatgtaaaaggaaaatattttgggccccaaaattactaagctaagggagaattcaagctgggaactgctcaagacaaacctgcctcccattctattaaatgtcatccctctgctcactgatatagatgcatattctgattgcttcctttggaaaggcttatcagaaactcaaaagaatgcaaccatttgtctctcacctacctgtgacctggaagccccctccctgcttcaagttgtccctgcctttctggatggaaccaatgtacttcttacatatattgattgatgtctcatgcctccctaaaatgtataaaacaaagacatgccctgaccaccttaggcacatgttgccagtacttcctggggctgtatcacgggtacacatcctgaaccttggcacaataaactttctaaattaactgagacctgtctcaaattctcaggttcacatactcatgtgaataattgactactagatagctctagtctaacagccatctcaaagtgaatatatgcacaataaaataatctcacattaactcataaaacagttcttcctctatttaaggagaacaaacacctaccttggaaattggagacaagttgaaaacagagaatcacaacctactgggagcagaaaatgccactgaagccagcaacttaaaagacaactagctaactactgaagacttgagtgtagactagcttgagagagaaaatattctggggatcccatggggggcccctacactttcatgagctttacctccatgtgcccacaaagttctcaggataaagattaaagaaaaatttcctcatggttctagcaggtggataggaagtaatctttctaaaatatacctagaatgttatgttctccttaacaaacacctgccctcaaggacaactactttaccagagcctaactagagttttatcagggcctgactgacatgtgggaatggaaatacccaactctggcccccaacagccatcttttcaccccaaagaaaaaatgtactgaaaagcacttgtcaagtctcatcccagggacaagggcccattaaaacactaagagctaatcataggattgtccaacccttcccctccccctacatcttcccactgataggaataggaagcagggaaattctgggcagaagaaggcaggtccctggcgagggccccaccctcaagcctggaatcatggcccaaagtgagaacatacatctgtgttttcctgcttgaatgctgccttttcaaaaccacccatggcccgccctgtcccactatcctgcacccataaaaaccccaggctcagccagcagaaagagaagcagctggacgttggaagtcagagagaagtggcttgacttcagagggacagcttgatggtgtagctttgaagaggaatctggctggggacggctgaacttcaggggaagattaccttcccgttctgtccccttttcagctcctcttcccactgagaaccactttcacacaataaaatcccctgcatttaccagcttcaactctcatgcgacctcattcctcctggacactggacaagaactcaggtgccacgagtgtgggtgcaaaaggctgtcatgctgaccctccactgagctgttaacacttacgctgtctgtagatggcaaagctaaaagggcactataacacctcctctggggttttgggcatcgtggataccctcccctagatactgttggggagtgagtatgtagtttgctcttgaaggtgcccaaaagcactcaccctggctcctgcacccactcacctgtgctccacctccctcaaggggtggagcagcgagtgagtggagttcacccctgccagcgcctgcacactccagttcccacctgtgaaggagtcactatcctgcttcaccaccatatctacagggctcctgtataataattagattacaatggaaagaactgcaaggctgaatctatttaaggagtccctagggaaactgtaaaagacagaaacaaggacagtagaggaaactgatgccttacacatttacaactaaacagtaaacacagcctaattcctagccacacaaacataaaacacactatcagcctatttaatctcagttcatattatctatacaatatgttcagctttcaacaaaaaattgtaaggcatatcaaaaggtacaaaaacagtgtgaagagacaaagcaagtatcagaaccacacttggatatgacagatattttgtaactgtaagactatgaatttaaaataattgtgattaatatgctaagggttctaatggaaaaaatggataacattcaagaacaggtgagtaatgtaagcagagataaaaacattaaataagaatcaaaaggaaacaagaacatgtaaggaatataaaggcactggacagagaaataggatgaagaggtgaacaatcagcagttatttttattgcaatgggagacttgtccagtattgtaaagctaaaggcaagaatctaacacaggaaaagagaaagtggaaaactgacaaatatttgcttcatgagatcctttccaaggtcaggattaagtcctaaaagaaggaagatgagaaataacaaattaggccaaaccaaaaggttgtaaacttgtctgtgaaacttcgttttaattaggtaacatggctactgcaaaaagtgaaggttatactacttcccgtctcccaccccattctttccttaatagatgttatgaaattgtcaacatttaagaaactcccaaaggaatttttcttagacatcatactatgagagttggacagtttttgtatttttcaatttaataaactcaatttaattttacattaaaatttctataccttaaggtgaaaacaaaaaccatacaagataagcagtaaccaatgttactgaagtaaacactcattcattcagcaaatatttattcagcaccttcttcaatctaggcaatggatacagtagtgaacaaaacaaaaatctctgcctttttggagtactatccttaggtgaagatggatgaataagcaggtacacaataaacttgtagaaatttttttttttttttttttgaggtggaatctcactctgtcgaccaggctggagtacaatggcagtgatcacggatcactacaacatcaccttcccggtctcaagtaatcttcccacctcagcctccaaagtagctaggactacaggcacatgccaccacgcctggctcaatgttttgtagaaatgggggtttgccatgttgcccaggctggttgtggactcccaagctcaagtaatttgcccactggttgtgaactcccaagctcaagcaatttgcccacttcagcctcataaagtggtggaattacaggcatgagccactgtgcctggcaggaataaattttatggaaaaattcaagcaaaggtgagggactgaagagctccaaaggtgaagtattattactttatatggggtggtaaaggactctttgacacagttacctaaaggaggtgagtcatgaggttatctgggggcacaatattccaaaaaactgcatatgcacaggctccaaagggggaatatagtgtgtctgatgtgttgtgggacaacgtgggatgtaattaggcaagaggaagagtctatagtgagatcctgtggggccctgtaaagagttttactgagtgaaatggaaaaaacttgagaaatgttttgagcagaaccacattgattactacctggagggtgttggcaaggagactatttaggtgggtatcacaatgtaacacagtgatttacatgggagtggtagtctggatttatttggcaggtagaaatggtaaaatttgcttatagagtgaggtataagatagaagtcaagggtaatcccaaggtttttcccctgagtaagtgaaagagtggaatttgccatttactaaaatgagaaagattgcagttaattagaaaagacagaaaatattatatatttggtttgagatgtttattaacttataagtgcaggtgttttttcttaaaatctgttttcttgggagaggtcttagccagagattaacatttgtgaatcatcattataggtgatattaaagacatcagagtgaagaggtttatggactaacccagcaataccaatacagtcctggatcatcaacaatgaatcacatatacaatggtgatctggtagcagagctgaaaaattcctattgtctaacaacgttgtagttgtcacaacattcaagcacaagacattaccttttctatgtttacatacacaaatacttagcattgtgttacaattgcctacagtattcagtacagtaacatgctatgcaggttggtagcctagaagcaacaaatgcattttcatcattatgcaaacaccatttagtgtacttacacaaacctagatgtatagcctactatagcttaggtgtacagtctactatacaattgtagcctaggtgtatagtagcccatacatctacgtttgtgtaagtacactagaagatatttgcaaaatgctgaaattggctaacaaggtatttctcagaaggtatcaccatcgatgcatgactgtatttagttatggtagtgaggaacagataccagcaaaggatctgggaaaggtgaaaccatgaaccaagacaagaactaggaagagtggtttctcagaacccaaataaagcttttcaaagatcgagaagcgataaacccgaccgacactgcttcattcaaaaagaatgaaactgtggatcagccattgtatttggttgcatggctattgctggctttcatagaagctgttttgatggagtggtaggatggacaaaagcgtgagtaccatattcaagagagaatgcaaggttctctcccaagaactctcaacaagttccgctgaagaaagattagctgaggtggaggagattggagaggggaagagaaaacaaattacttagggaattttgggggaacttagtgggcagcattacgggcagcgctaaggaaccatttaaagtaagacaagtccacacagctgtgtgcttttctacagtcttgttcaactgctgcataacaacagaatgttggaagcaggaattagttttaaagtaagatggtattgacgagacgacaataaaatacctctactacagagcacagcaatgttcggcctggtggctcacagaagctgaggctcttgaacgtctgggcacagcatgaaagcatcaagcttgagagactgcaggccttaacaaactagaagtgctagaacgatggttctaaaccaggtcttttctcacacagcaagcacagcaatagagatttattttatcttattttttagacagagtctcgctctgttgctcaggctcgagtgcaacggcacgatctcggcttactgcaacctccgccttccgggttcaagggattctcctgcctcagcctcccaagtagctgggattacaggcatgtgccaccacgtccggctaactttttgtatttttagtacagacggggtttcaccatgttggccagcctggacgctaacttctgacctcaggtgatccaccccactcggcctcccaaagtgccgggattacaggtgtgagccaccgcgcccagcccagtagagattcttttaaagactgcggtaggtcgataaaggagacattgtggcctaggagcttcaaggtctacagactgaacccagttagggtagggcccctttccaaatccagaaatggtatctattaatagaagggctccctccgggtcccagggggatggactacggtttttagcgccggaacttacaacccgaagttctgctgcttgtgactgcctgccggagagactggcatggtggcgaccagctggggagtggtgcaccacccctttttttggccgcctctgaagtccctgtacccccaagctcctccgttagcggctcgggccgaggctccggaatgtttgccgggcgtcatggcgacggtggagccctggctcaacaagcggccgcgcggttggctggcggcacgaggccgaggaggagggcggaggcggaggggagggcagagggttggtggagctggaggaagctccggacgacgactggaagaaggaggcgggcggcccgggcctcaggcccctcccaggctctgagtctcccggctgcaggcggatggatggggcttcttcaggcggtggcggcagcagcgaaggtggcggcggcagcagcggcagcggctgtaagtgcagcctccacaagccatctctccccttctattccagtttgggatgaggggctcctgaggtgtcctcagtcccctttctctccttcccctcccccacggcagtgtaccgcccggaagacccttaacttccggggaggggctgccgcagaacgcgcctggcttgctctccgccggctgccaaaggcgcatgcgcagcttcctccctctggccatcgactgcctcccagcgccgcctttttgccttcgcggtggtggcgccgcgctgggaatccgctgcggagtgagttcgcctcgccccgttcgcttcggtccctgatcccagtcggggtggggctaagctgaccaccctgctgtggctccgcctctttctcctgtatttccctcacttgtgtcccatccccgggaggctctcgcttgcactgcagcctttatggtgagcagcgccctgggccaacttgcccttttcggatggagtcagggagggaggagagactcgaatagggtattactgtaaggaaacgaggtcctcctagcgcgtgggaggatcccttgggacagatgcccgccgctctttactcttgttctttcagcttgtagtggctaggtccctggcctggagcctatctgtggtccctgcatgctgtgtaaccttgagcgagtcactatccctctctgggcttcagttttccctatttaaagcttcctccaacgctagaattctgcatttctgcagaagaacttatgtaattacaagattgacttggctattgaggccgcttcaccaagatgacccggagttgactgaaccttcttcacttatgggtggaatgaggcgacctatttattgggtcgcttttattcctttatcattagttacaaattgcatgacttaaggctcattaaatgtttttctaaaattgtcatgggatccttgtcctgattcccgaccatctttttaaaaatgcgaaacagggtggatggtgagcttgtatcatcgtttctgtctccttgctactgaggctctctttcctttgatccagatggtgtggtcgctcgattctcccagtgcctggctgagtttcggacgtggttaagaaccaactggttgaggttcaatgcagacaagacggatgtgatgctggtaggcaggggtacacttggagattaagggagggaaaatccaaactccctcaagtaatataagattatattactcttcttatatgttccagtgtttgagaactgatgggccaaaaatttccagaatttgggtgagataaaaataacatgtcatcaatgtaaaaaccataatcatagtttgtaatattctgataaaatggggccactggataaaactgtaaaaattatgaaaagaaaatccaaaactgttatttgaagaaccaaaagcctatataagtgttttagagtggcattaataacaaaaaatgaaactaacgaaagatgatgctgattgtcactatagatgtggggcttccaaatgtaataggctaagttttttagatgtaggtattttcaaccaaattagtaattatccataaaattttaccaccacatcataaagacatggtgtaggctgttgcttttaaataaaaatttcaggaaatagtttataaactaatctcaaaagagactcatggacgctgaaaattgttagatatagaattttttagttttggatgtgttgtattaatctatttcagtcagctaaccccagagtctaaattgttataagtacagtattttcttggtgcattttgagaggtacctttttggattgcataacagataggtttatatagtatatatatatatgttacttgtatttgaatcaggtgttggtactgaataaaaggttatatttcttaggtatatgtaaattgccaaagaagtttgttcattggttcgtttaaggtactggttgaagtaagattgtgctcctaaatgcttttgttaaaagcataataataactgaggggtttgtgtgtgcgtgcgccttatagcctctatagaattgttcaataacttttgaatggaagattcagtaaattgcttacaaatgatttatcaatataatagcagttttgagtagcttaatgtcataaaaattaatgttactttgcctgaaaataaggaggcttttaggtggggaataggagctgaagaggcatttattcaggctttgtatagtggttttttgttttgggacattaatcacaaacctcacataaaattggaattcagcacacttttttagtttaaaaattttatacacaattccaacagaactactgttttggatatcacattaataaataacaaagtgtaataattttaagcagacacaattaatggtgcattttcttatgcctttagctctctcatgtcctattttcaactcttctagtatgaataggctttaaaaataaatttttttttgttaacccaagtataaatattaactgtttgcatttggatacaaagaagatatctgttgaattaatccaaagtgctgaagaactaagggtaatggatggaaacaacaaggaggtagattctggcataataaaagaaagaatgttttaaacatttgaactttttttgaaaagagcagcctttttatgagatatagtgagtcactggaggggtttaaacataggcagaaagcctggtagtagaagcatgatgagagattactatcttgacagggtagagaattgactaaaagatctctaaggtcccatccaacactaaaattctataactagtgaatagttaatttttatatatttaatactgaagagggtaagtaagcgttttgagaaagacttttcattccgtaaggtggctcctgaaaattttacagttaggtgtatcactaaaataaaataatagtggaaggatactgaattcagtggtaatgtgttacctatgaattgcagtattagagctgtttcttttttataatatctgaacctaaaaaacccactgaatccacatttataaaaaggggaaggggaaaaatgtagagagtttttttccctcaataataataataccatttaaaactagtaatattgatacacaatattaataaacttaaagagttatttaacagtaagatagatacccattcagaaatgtttcagacttccattttcctgacaagtttaggattcattcagtaggttaatagactatgatcccctgctctttatcatagttgggatttctgttggtagtttaactgaagaatcaaagattcagtgtacttaagcaagttatttctgtaccttgtattgtaacacttttaattttcctttggtagccaaatttcataaattagctttcatatgttaatggaaaaccctccttcatctccatggtataaagcctgagtttgtacctctaggcccctaattgtgtctgtacccacctcaggtccatgtatatccattgttctttgccttcagctcttttcattaagtgtattgattgaaaactatttggatatgaactgacacttttaaaaagtcatttttatttcaagtccagaggattgacataattcaacagggtaactattagaaactatatacctctgctaaaatatttattcccccaaggaatcctgaaaaacacttttatataagttttctaaaaaataaaatgaaaatactgtacagtacagttaatggtaaaaattgtttgtagatttgggaaccttaaagttttcctttctcttctttcccttgcttttctttcagtagaaaatgtgcatcagatgtttatgtttaattggtttacagactgtctgtggactcttttcctgtcaaattaccaggtaatgtcctttcacttagcagctacttcatatatctgtaaatgcagtttattcatgcacagattattattggacataacagtttcaaattaacattgaatctttggaaataggaaaatgcttgatagagtctagaattttaagggaatataaataatttaatagcctcccctatattgcattataagttaagtattaactttaagaaaaattgtatatgtacacatttatgcaatgtagtattggttcacattatttggaaggaatgaataattctcgtatttaaatggttgattttggtagccacttttgaaactgcattaagaggaacccttgaagattaggaaaaaaatcccagtcttttgaaataaagactttcaaactggtttagtaaaatatgttagtgactgttttaatgtcacctttgtgttattcagtatgtgccttagtataatggaagtgaaacatgttagttactttgaaatcattggttctggccatcatcagcattggcatcacggccaattggcagctgtaggccaatacattaaaataaactttcaagttacaggcatttcaggcattgcaaataagtaggttctccctccatgctactaaatagatgatatccataaaacagtcaattttcagtattttaaattttgtctagttgtgcaaaattcagtacataactgtgttgctaccggcatgacagaagtgtgtgagaaaacgcaaatgacatgaggatggcggactgcctatcataaccccttccattaatttttgctctgacctctctagagatttggggatatagaattttacatttcctgtcgggaatctactgatggagaaatatttgtcaaggcataaccgctttcaaagcacagttcttgccgccgttgcatcacagcaacatccgtttttcagcaaatgcatttcaaaaacgacctacatgtaaaatattacgtatttttcctctgctgtgtcaatgctggatgtgactcctttggcactgttccttgacctctctgatccgtagacaaccccctccgcctggagtggcggatcagctggagccagcgaagcgccccgcgcggttgcccacctcctcccacacccaccttgactccgccccctccgctcttcccggggagggctggccgcggggccgcgcgcgcgcccctgctccggcgcgtgctcgctggtcttttccctccagtccagcccagccggggcgccgcgagggggcggagtggggtgtggtgggcgcgctcgggcggctcctgcgcgttcccgccgaggcagtggcggcgggagcggcagagacggcagcggccggagtcccgttgctgagtctcacatccgggttctggccgtgacccagctgcggccgccgcggagatgtgacccggcagtacggcaaatatggcggaggtaagggagcgagctccccctccctgtcccggagccgggcgcccccggccctgggccggggaggagtggagtgggcctggccaggagaggcccggccctgctggcgccgctgcccacctgttgtccggaacaggccattctctgggcgggagcttcgcctggaacttagttgggatgggtccgggggtaggaggaagcggaggcgtacttggacttcgggggcagtttgaagggtagtgcagcgtagtagtgcggtgcgagggggagggggcgcccgccggggaaggggtgcctgtggcgcaacttcgccggccggtgctaggggccaggagagaagctgctgcttcctcttgcgaagttttttcccttcctaaccgagatgctgttgcgcccttccgcgtcacccccatccatttgcgactgacatccagtctgtgttagtggggaaaacgtaaggctgacggcctttgattaactctgtaattttcatgatcgtggtaaaatgagagtggataaattaatctggccagccgcaatccagccctccaggttggggggagtctgcccatttatccagacagttccatctcccgctccccaaggtacaacctctgagctgcttttccacctccccccaccaccttcactttccaggcttccccccaccccctttccaaatcaaggctacctattcttgtcttctttctcttctaatttttctttcattggagaagctttttcttgtttctttttgctcgttttatagtaaacaagttcctaaagcccctttttttgattttacatatttgggccgcagttggcgggcatacaactgctgttgatttattaatcggaactaagtatacgctactggaactttaaataactggaagtttaaaaaatgtttaaaatatctgaagttttgtgggatttgttttgtttccgtttttccttacccgtggaagaatttcagtattctttattcctgagagttcgagatgatgtatttggattttttttatgactcctttgaaataagccactgtaaattttgattgataaggcatttctcttgtttgaattgccattttcatggtttcacaggcaccccaaaacagatttaggaaggagggtgagattttgctgtagcagacaggactgtttgctgcgagtattctttttaaaacattcaatatctctaatttacaactaaatttagatcttagatttattttcatttcttttgctcttggtggttaaagaattgtatttccaggcacatgaattggagaacgtagtactttctgtttccccaaaatgtgactgcgtttgttccagtagactgagaatcggtacctggattttagtcctggtgaggttcttattcttaagtgtttgtttccttcatgtttaaggagttgtgtgtagctggatttatacattttgtcagttagtgtcttcagtggacccctttcagtgaatatcgggtaagcagcaatgtgctacataggtaatgtggtttcttctttcatggtgttgctcaggatggtttgagctttgaggtgtgtagtcatatactaaggcaagatattactgaaggaaaatagcttatacagagaaatttaagttaaaaaacttaaatttaaaatttctgtgtttttaaaaaataaattttattgccgagggaactaaaaaatctaatatgtaaaagaaattatgttaacttttttgttttaaaaattaaagatggttgcgttattgtaagataaaggaaaaaaatattttgattcactaatcatttcctaatattttctaatgtatgttttagttttcttaaatattttatcagttggagaatggaatgttttgtgggaacgcatggattgttcaactgcaagaaggaaagaactggaattttgtttttatttggtttttagtgtttatttaatgacctggtatctttaaacaatttatcttctatattcttcagttacttgtagatagtttcatgtatagtgaattggggaagagttagaggaactttcgtgatctgtgtcctacaaaaaaatctaagacaggtgaagaagtgaaaagtacaattgatttatagttttcctggcctcaatacttgaataattatgacgatttttgagaccagtggttttaaacaattagacaaaggagaaatgcttggttggcttttactttgagctctcagtagattcattctttatgaagccaatataaaagcatgtgattaaataatccagatgctgaattattgtgcttttgatcaaataaatctgaggatttaaggatagcttgtgaagtaacagtaagtgcaaagcaacagtatatatctatttgttaaatctgagggggaaaacaggttattgaagaagtatgtctccagagaaaaatgtaggtattatgcttctgggcttttaaaaaaaaaaattgatgcttcctacaagagcatgaccctgaccatgtttttccagaaaaatatttaattcttgaatagaaagtgctttagatgagaataggatatactaattttttatatttgatctgattatcttagtccataataggaagtatatattggttcttcagttgtgataacattaaagccgtatttaatgtacttagaataaatagcatatgctcccttgcttaatactttttggcaatatttctcattgcttattatcccttaaaattatttaccaaccttctaaaaggacgctctcctagtcacacttgaaggaaattacaggatagttgcagttttactaactgcaaaaataagaggaaaatgagagaaaaaatgagaggaagaaatagttaatcctttgggttttataaggaatgtactagggacctttgggaacgaacaatttgtcttgtattttagcgtttgtaaacacgtaagggactttcttctcaaggaaaaaaatccatggacaattcaagacctgtcttttcacctaggccacatttctgtgatataaagagaaaattaatggatttgcttctttctatttaagtattttagtactttcaaagagggtatataatctgtttattcactttcacacctatccatttctctttaaaatggactccttgcttagtattttttgagtgtatttggatttttttaacgaaggattatgttaaatgttacttatgaaaacattaatttctactctaagcaaaatgtgtttcactgcagtgaatttaagcttcaaataattctcgacactaataatgaattttttttcatgtttatacttcagagctattaagattttaaaagtagtcaagatcaccagtgcgtgagagtcctaaaaatcttaattcattggcagttaagagttagggtactttaataggtgggaaaggtttggtgggagaaacaagtgaattactttaagataattctggtaagtgagactaaccagttttctaaataattcagaaataaaacactgccattgaagcttaagcatgtctttatgaaaagtaatcagctatctagaaatgcctgcctggcttgatgttcattcaaaattcattgcagtgattaaattgttcaagtaccagtcattgcttggggcttgttctgtttgtcttattctgtggcttagaacaataacttattatgtaggtatgaaattcatgaagtagcaccccaaaaaattgtttttgcaaattgagatttttttaacagtcctagatttaaaaaaataaatttaaacatatcccatgcatttagctgcatactccttagtagtgttaggtttctagagcaatttataataaaagtaaagttaggtcttgaagaaatctaaatcttttgatcatagagaaaatgaaagtgagcagagagtttacgtagtttgtcctaggtcgtgcaattcatctatggcacagtttagactggaacccagccttctgtattcctagattcctagtgcttattttctttttctttctttcttttttttttttttttgagacagggtctctctctgttgcccaggctggagtgcagtggcgcaaatcatagctcactacaacctcaaactcctgggctcaggtgatcaatccttccctcagagcctctcaagtagctgggactataggcatgtgccatcatgcccggcttttttttttttttgtggagacagggtctcgatatgttgatcagactggtctcgagcttctggccttaagtgatcctcctgtcttgtgctgggattataggcgtgtgccactgttcccagtccttattttctatgatatcattttacttctgaattattaatactgtagtaaattgctaattttaatttcagtacattcttaacctttttataccccagaattcctgagagtaataacaaagttaagtaacttaattttattggaggagagggatggtgagccagcccttggcacggtaaccatctttcacccta

SEQ ID NO: 314 - DNA, 27408 bp, Homo sapiens
tacaaacaaatggaaaaacatatgctcatggattaggagaattaatatattttgttttgtttttgtttgttttgagacagagtctcgctctgttgcccaggctggagtgcaatggcacgatctgggctcactacaagctccgcctcccgggttcacaccattcttctgcctcggccttcccagcagctgggactacaggtgcacgccactatgctcagctaattttttgtatttttagtagagacagggtttcaccgtgttagccaggatggtctcgatctcctgaccttgtgatctgcctgcctcggcctcccaaagtgctgggattacaagcgtgaaccaccacacccggctgttttttttgagacggagtcttgctctgtcgcccaggctggagtgcagtggcgcgatctcggctcactgcaagctctgcctcccggggttctcgccattctcctgcctcagcctccagagtagctgggactgttggcatgtgccaccacgcctggctaattttttgtatctttagtagagacaggttttcaccatgttggccaggctggtctcaaactcctgacctcgtgatctgcccagcttggcctcccaaagtgctgggattgcaggcatgagccactgcgcctggcagaagaattaatattgttaaaatgaccatactgcccaaagcaagctacagattcaatgcaatccctatgaagatatcaaatgcattttttccccacagaattagaaaaagttctcagagctttgtagaatcaaaaaagagcccaagtagccaaagcaatcctgagcacaaagagcaaagctggaagcatcacactacctgacttgaaaatatattacaaggctatagtgaccaaaagagtgtggtattggtataatagtcacatagaccacggaaacataatggagacccagaaataaatccagatatttacagccaactgattttcaacaaagatgccaataacatacattgggaaaggataccctcttcaataaatccaaaaactagatatccatatgaatgaaactagacccccatctctcaccgtatacaaaaacaactctaaataaagacttaaacatatgactcaaaactgtaaaactactagaaaaacaagggggtcggggcagtggctcacacctgtaatcccagcactttgggaggccgaggcggacggatcaccagaggtcaggagttcgagaccagcttgactcacatggtgaaaccccatctctactaaaaatacaaaaaaaaaaaaaattagccaggtgtggtggcgcatggctgtaatctcagctacttgggaggctaaggcaggagaatagcttgaacccaggaggcggaggttgcagtgagctgagatcgcaccattgcactccagcctgggcaacaagagtgaaactcagtctcaaaagaacaaaataaaacaaacaacaacaacaacaacaaaggaaaaggaaaagcacgtgttgggagaaaatatttgctaaatatattcgacatcttttatctcaaatatataaataacacttataactcgattataagttaataatcatccaaagtttaaaatgggcaaaagatctgaacaaatatgctttgaaagaagatatatggttatcaaatacacacttgaaaagttgttcaacgtcactagtcattcaggaaatgcaaatttaaactatgatgagatacaactactacacatttattagaatcgttaaaatgaaaaagacaaacatacaaatatatggcaagaatgtggagcaactagaactctcagtgagttctaatataagtgtgataaatttttttgaaaacagtttgacagttcttaaaatgttaaacataaaagccgggtatggtggagtgcacctgtagtcccagctacattgggcaggaggatcttttgagcccaagagtccaagtccagcctgggcaacatagccagaccctgtctcaaaataaaaacaaaaacaaaacaaaacaattaaacatacacctaccatatacccccaaaattccacttctaagtatctacccaagagaattcaaaggatatattaacacaaggacttgtacacaaatgtttatagcagcttcatttgagatagtcaaaagttagaaacaatttggccaggcactgtggctcatggctgtaatcccaccactttgggaggccgaggcgggtggatcatgaggtcaggagtttgaaaccagcattgccaacgtaatgaaacctgtctctactaaaaatacaaaaaaaatcagccaggcgtggcggtgcacacctgtagtcccagctactcaggaggctgaggcaggggaattgcttgaacccaggaggtggagcttgccgtgagccgaaattgcgccactgcactccagcctgggcgacagagccagactccatctcaaaaaaaaaaaaaagatggggtcttgctctattgcccaggctggtcttaaactccccggctcaagtgatcctcctgccttggcctaccaaagtgctgggattacaggcgtgagccatcacgcccgactgaacctcttttccttataaactatctagacttagatttttccttccttccttccttcctgtcttccttcttccttccttccttctttccttttttttttttttttagacagaattctgctcttgtggcccaggctggagtgcaatgccgtgatcttggctcattgcaacctctgcctgccgggttcaagcaactctcctacctcagcctcccgagtaactgggattacagccgccaccaccacgcctggctaattttttgtatttttaatagaaacgccgtttcaccatgttggccaggctggtctcaaactcccaacctcaggtgatctgcctgcctgggcctcccaaagtgctgggattacaggcatgagccaccatgcccagcctgagatatttctttatagtaacacaaaaacagcctaacaaaaaggtcacatagtaggtaggatttagtaagaaagagagctgagatttcaaggcaggtgaactgggtctaatgtttccactgctttactcacctctccctacctctagatttccaccctcccatgttgaaatctcttggttataaattttcacttgtgcttctttcttagatcaccttcttgaatcacagtggtgtctattttcatatccattgagggtatagtgattccttgagggttacaaggtctgcagatcgatgagttcttggcattttggagaggccagagactggtagctctgagtcattagttgtcaggccatgcctccccatcaaacaatcgaagcttggctgacttctctgagtgccagaagaaggctggggctgggggtagaggatctgggtttcacaagaggcgagtctggaaatgtcaaaattggggtccaaggtgagaggatggcgtggtaggacaacattgtctgccatccgtgtataatggctgaagctctggttagtgggtgtggcctaaggagaatgtagtgattcccactgtcggtgtaaagggcttcatattgatggagagttttctgtgttgtcagaagttctggtggacactgtgagacagatttcatggatttatagatgagacagctgaagcttgggagtctgtgccccagatcgcacaatttattagcagtaggagtccaagttgagccaagccagagaaggttactgagtgttttggcacccttggccttaatctgctgctcttcagatttcacagcccccatgttccagatagttcactcaaagcttgggagttggagatgagggaatcaacagatgctgacactagcatgaaggagaggtatagctgatctggaggtatgattgggagaggttgagaagcctttcaagggtgtccctgatgtgggagggcacaagcaaaggcccaggggcaaggaactgcccagtagattccagaagagaactaccattgcatacagcagagtgtacaataacagggtagtcagtacactgcatcaaggggctgaaggcaactgccttttggtttgagcatagtctgaaagcagtggagccactgaatcccacaaaagctggtaacctggacagctcaaaagtcacagccatcaggactttgcctggaatattctggcattattggcaaacatctatcttcccctaacaggttggctgctgtatactgagacccagtcggagatcagaaggcaggttcagtagaaacacgtaggactctactcatgtattaggaatcttttttttttccttttttatttttattttttattatttttttgagacggagtttcactcttgttgcccaggctggagtgcaatggcgtgatctcagctcactgcaacctctgcctcccaggctcaagcaattctcctgcctcctgagtagctgggattacacgcatgcgccaccatgcctggcttttttctttctttctttctttctttctttctttctttctttctttctttctttctctttcctttctttctttctttctttctttctttctttctttctttctttctttctttctttccttccttccttccttccttccttccttccttccttcctttcctttcccttccttccttccttccttccttccttccttccttccttcctttctttctttttctttctttctttctttctttcttttcttgtagagatgggatttctccatgttggtcaggctggtctcaaagtcccaacctcaggtgatccgcccgcattggcctcccaaagtgctgggattacatgcgtgagctaccgcgcccagccttttttttttcctgttttagagacaaggtctcattatgttgcccaggctggagtgcagtggtgcaaacatagctcactgcagtcttgaactcctgggatccagtgatcctcctgcctcaagtagctggaaacaggcatgccacaatcatgcccagcaccatcttatgagatctaatcttggccactcacacagaggattgagctctgatgacgtgtctaccctaactttatttgcttagaaggctgagccccatatggctcagctaacctttaattctgatcccacatgtgtcttacatattggagacattagcatcttccatattggagacattacactcaggaaggaaggcctgagtagggtaggtatcccccagacacctcactgtgctggggagtatttgagaagccctgctgtaaactttgctgacggcaaaactgttgtggcttctgctcacaatgtggttatcattgtccatcccctcaggggcttccaggagacgtggcagctgcagtggcctctgatccatcatacagtatggatggacaccacaggccaaagattctcatgtcagaggatttccggtcttttctcccctaggcctcaggaggacccagggaaatatctaaagccaacctatagttttggtgaactgagtttgcattgaaatgtttttggaaatgattttcaacatttataaaatcacatgccacatagaaatctgaatatttggctcttcttggaaaaccaggagatatgggaaatctgtactgactccaccatattgtctccccaccccttaagagggacagacctgcttggtggccaccagaagtggaattatgaaggccacggccatatgattctcaagaaaccctggctactcacataagccactccagaccatgatttctgtcttctctgtcttgaggtgcctacctgtgcagtgatggccatgagatgaacagcccagggagtccacaggaaatccacaaaatatttatttgaatttcagttatgagtgacacataggtctgcatgtcctgagaagttctgtacacccttatctcacttggccatagtcattggaagtttctgatgtgcgtttagaacagacatgtcccctcttgtctaccacagtcttctccacacttagagtttttgtaccaatgatagttcccacatagccctggcaggtctgaaccagttatgcctgcctactgagttttatatttcatgagtcatgagccatgggcaggtactgggggatgtagctggtaaagtgggacatgcattgggaacagaggaccaaacttttgctgtggaggttctcaaagaaactaccccattcttcagagctagctctgggcccacaggtgacccttggtgtccagatcacaagattcagtccaagcctgtcagtctttcataggaggccttagggcaacaagacaaattcaaccaaaactggactgagcactcttcctgcccatgcggctgtttgagacactcagtgcccccttacaaaagctgttctttttatattaggatgaattgtttcaaaccacctcaccaactctgatgcaggtggctaaacattaaggcctttgttatctcagagagagacaggcagatccaggagtgagtgattgagactaaacagatcattcctaagtgtcacatgtagatgcaaacaatgtccatgaagagaaaccttttcttctattttagatggagtctcacactgtcgcccaggctggagtgcagtggcacgatctcggctcactgcacaccctgcctcccaggttcacaccattctcctgcctcagcctcctaagtagctgggactacaggcacccgccaccacacctggctaattttttgtatttttagtagaggtgggttttcaccatgttagccaggatggtctcgatctcctgacctcatgatctgcctgcctcagcttcccaaagtgctgggattataggcatgagccactgtgcccggccaagaaaccttttctggaaagctccagaagacaccagctcagatcttagcaagaattgtcataccaaaatctaaagccatcagtgggaaagaaaatgaaggtactcaaagcctatgtaattctctctagagaatggaaaagggagtatagtctgctttcccttagcacagtgagggagactgatacatatcatgagatcttgccaggtggcagagatgagacagtatggcaggcagctttggacatggcttccaatgatctctgccctctggtattcatgctcttgtgtaatgctctccccttgactgtgggctggaccaagtgacttgcttctaactaaatttagcaaagatgatgggatctcacttctgttattaggttacaaatgactgacttgttggtattctccactgcatgatcagcttgcaagctttgattgacaagctgccattttggagaggcccatgtggcagagaactggaggaggtctcagaccaacagacgggtcctcagtccagcagcccacaaaaaactgaatgctgccaattacatgagtttgcttggaagcagagccttccctagtcaagccttcagatgatacacccccagctgacatcttgatgttagccttgtgagaaaccctaaagaggagtcagctagctgcaccaaagttcctgacctatagagactgtgaaatagtgactattgttttaagccactaggttttgagtaatttgttacacagcaataggtaactaatacagatggcttctgcaatagcagtaatacagtgccgcctaagattctgggagctgtggctttcccacatttgttgcccataactctcttgtgaattctctggtgatttttcttaaaagggggtgtctatagctgaaggctttcccattttcactgcatttgtaatgcctttttcccataggtactttatatagctttctcacataggagaggtgactgaagaccatcccacattccttagatgcaggggttttctctactgtgaattttttggttatagataagaatcgatttcttcttgagggtctttcttcataccaagtatttaaagatctctcttcagtgtgggttcttaggtggttgaagagggcaaaagtcttcatgtcttcccatagccactgctcttgaagggcttctccctatcatggcctgcccggtgttatctgatgttagagctgtgtggcagcatcttctcactcagctcttcttcatggcttccctgtgccatgagtactctggtgatggagaaaggaaggcctttccacattctcttttgagcttctcattattctggtactccagtgctggaagggggtagttaccctggaaagccttcacaaatgcctggcccttgagtcctctcacttatgaattttgctgtgcatgaactgaaaagtgctcttactgtgagccatgtcacatctgaaaaggtggtcttcaccataaatggtctactgttggtgaaggtttgatccactcccttgtgtggggtttctacctggagtacactgcctaacgttcagccaggagtacaatctttggcagggcaagggtgccatggtcagggtgaggaacgaccagtcatggagtactggtcctgtcacatatcccactactgagcctgttaggtgacattcacataggcagggagaacagagagggatctaggacagatgtggaagcagcagtggctactgaaactgctgttcagtgatgtgagcccaggccacccttcttttctagagatggggccttgctatgttgccctggatggactcaacctcctgggctcaagagatcctcctgcctcagcctctcaagcagctaggactataggtgtgcaccactgcacctggccaggcctctcctttatggggactcctgttcacatcccagccaatgctctcatgagtacttccttgtatgggggaggtcaaagaaacagcagcagctcacatgtgatgatgctgaaattacatggtaaataagctttttaaaataggtgccggccaggtgcggtggctcatgcatgtaatcccagcactttgggagtccaaggcaggcagatcaggaggtcaggagatcgagaccatcctggctaacatggtgaaaacccgtctctactaaaaatacaaaaaaattagctgggtgtggtggcgggcaactgtagttccagctactcgggaggctgaggcaggagaatggcgtgagccatttaggaggtggagcttgccgtgagccaaaatcgcgccactgcactccagcttgggcgacagagcaagactccatatcaaaaaaaaaaggtgccaaacaccatattctacaaggttctggatctctagctccttctaaaataccagctctgtcaactgtgttaaatgcccccatctgcctgtgcccactctgttggccagcaagactgtgaaggcatgaagtgtgtgttagtgaccagaaaccctggccagactgcaaaaaccactttcctggacgtcaggctatcacttctctcagctcccagttcctacctggggagtgatgggtgccaagatacagtttgagagaggtgaagtgaatgtacatgacattgcatttatctgctttaactgtggcaaaaactttaacatggcaaatacaaaggtctgtagctctggagttgttctgcacaccctcaccctgcacagtcccagttgatggggaactatggctattcctttgtccatgatggcatgtgccctagttcaccagtctacccaaatccctggttattacctcacatccagtgtttctctatgcacatagagtcctccatggacccctctaggtctttgccttggtgaccctgtgactattttagtgttgtagatgagtttatttttcctctgggtaagctctgggccctacggtaactgaaacaggccactatgttcaatccagagcctttcagtctttcccagtctttcacacagcaatgcaaagtaggctacaacaggacagagcaactacccgctcttctactgtgcccttaggcagattttgtgcccccaaaaggcactccccaatctatccattcattttctcaacctaccccaacagaacccctaagattaaaggtgacctgatcaataaggtctttattatcaccagttagtgcaggcaaggtaggtgattccagtggagggtgatttgtggcctcaatggacacatcttaggggttaaacacagacttgaccacatccacaaggaatgtgcatcttcctgagctcaaattagatttccctcaaggcccctcaaccagcatcggttcagctgagcacagtcctgaatccctagagaacacaggaaggaaggctcagggtactgttttccccatgcatgaggacaggactgctgcaaatttttggatccaggcaagatggaaagtgactatggcttctgccttatgctgcatgggtgagatggccctgcaaaggttcctgggctggtcagaaacagagtagcttctgaaggcttttccacattagcagtacatgtaggtaatttttctggtatggggattctgctgcatgaagtttgacttggctgaagattttctcacaaagaccacttccataaggctccactcaggtatgaatctttttatgctgtgcaaggttacaaagatggctgaagagtttcccacactggctacactcataagtcctttctctggtgtgaactttctggtgccgaacaagtgtagatctttcactaaaggcttttccacactggatgcactcatagggcctttcttgtgtgtgaactctctgatgacgaaccaggtgggagttactgctaaaggctctcccacattcactgcattcgtaaggcctttctccagtgtgaactctccagtgacaaataaggctggattttcggctaaagaatttcccacattcactgcatttataaggcttttctccagtatgaactttctgatgcttaatgagaatggagttttggctaaagaatttcccacattcattgcactcataaggcctttcttttgtgtgaactctccagtgttcaatgagagtggagctgtgagcaaaggctttcccacactcactacactcgtaaggcttttctccagtgtgaattctccagtgctgaatcaggctggagctgcggctgaaggatttcctacattcgctgcactcataaggcctttgcccagtatgtactttctggtgctggatgagggtggagctattactgaaggctttaccacaatcacagcattcaaaaggccgttctccagtgtgaactttctgatgtcgaaggagatgggagctttggctgaagtctcttccacattcactgcactcaaaaggccgttctccggtgtgaactttctggtgctgagcaaggttggagttattgttaaaagctcttccacattcactgcattcatacggtctttctccagtgtgaactctccagtgctgaatgagagcagagcttcggctgaaggatttaccacattgactgcactcataaggtcttacctgtgtgtgaactttctgatgccgaaggaaattggagctttggctgaaggctcttccacatttcaggcactcaaaaggcctttctccagtgtgaactttctcatgccgaatgaggtgtgatctgttactgaaggctttcccacattcatcacactcataaggtctttctcctgagtgaattctctgatgatgaacaaatgtgagtttgtggttgaaggttttcccacatgcaatgcactcataatattttacttcagtgtgaaatttctggtgcttcctcagcttagatgagtgactaaaggccttcccacactccttacacacatggggtatttccccagtgtgaaactttttattaccaaggattgatttctcctctaagaaatttccacctgttgggcatgtaaatggtatctcttcagagtgagttctcagatggttggggagagtggagctcttcaggaaggcttttccacagttgctgcactcgaagagtttctgtgtggtacagacttctggaagctgcccaagattggaatatggcttctgcccactgtcaacagcttgaagctggaggaggtcacagctgcccaggatgaccttcccaccttccctgcaagtgaaggggttctctgacaggtggactttagagctcttcataagtgcgtccctgtccttgtaccatctaaagggcttccctccactgtgctccttctggtgctggtgaaggtttgcattcaaccaaaagtctctcccacatgctccacatgtgtagggtttctcctcagactgtgttccctgatgctcagccaggtgcaaaatgtctttcaagaatggcccacacatgtcacaggagttagctttcttggtggaaggatctgcattagggatcctgacctgtaacacttctacagaaacattctgcttgggatgggccccctcaccctctactccatgccaagaacctgaaagtagagaaatgccagttaactaagaattccacttggtgggaatggttgacttcattagaaatgttacccaggaattcacacccaagaagaggtcccagggattgctgacaggccaacagggccatcatcagggtgaagaagggcccattactattggcaggatagggaccagccaagcaacagaataagggagacctcaccaggggtaaggacacagaaatgggtcaaaggacttaaatagacatttctctaaaagaagatatatacacaaatggccaataagcatatgaaaagaagttcagcatccttaaacatgaggagtatgaaaaccaaaaccataatgagataccacttcacatccactagcatagctataataaaaaaaaataaatgacaacaaatgaagtagaaaaactggagcacttatacactgcagacagggatgtaaaatggtgcagccaatttggaaaacagtttggcaagtctgcttctacagagctacacaagagaactaaaaacatccacacaaaaatgtgtacaggactgttcatagcagaatttttttaaaatttgagatggggtcttgctatgttgcccaggttggtctcaaactcctgggctcaagtgatcctcctgcctcagcctcctgagtagacggattataggcaccttgcccagcttctatagcagcatttttttctaacacctaaaaaatggaaacaagccaaatgctcatccactggtaaatggataaacaaactgtagtctttctatacactggaatatttggctataaaaaagaatgaaatattgatacatgctacaacattgatgaacttcaaaaacatgctaagagaaagccagtcacagaaaaatacatagtattctataaaatgtctaggaaacgtaaatctatatagtcagaaagtagattagtggttgcctaggaccggggggaaagggataagggaacatggggagtgacagctaatgggactgctaataggacctacagtttctctttaggtgatgaaaacatgctaaaattacattatagcaatgattataccatgtgaaaacatatagaaatcactagactgtgtactttaaaaggtgaattgtatggtttatcttaataaagctgtttttaaaaaatatctcactgggggctgggcgtggtggctcacgcctgtaatcccagcactttgggaggctgaggtgggtggatcacgaggtcaggagattgagaccatcctggctaacatggtgaaaccccctctctactgaaaatacaaaaaaaattagctgggtgtggtggcaggcacctgtagtcccagctacttgggaggctgaggcaggagaatggcgtgaacctgggaggcagagcttgcagtaagctgagatcacgccactgcactccagcctgggggacagagcaagactccatctcaaaaaaaaaaaaaaaaaaaaaaaaaggaaaaaaaaatctcattgggaaagagacagaatctgggcatgacctcatactgggtaacccgaccagggattggtgaatctcagtgggatctgttaggcagactggaggtgtctgatccccaacctttgcctccacaaggctcctgggcaacagctattaggaaagctcatgaggctgctcagagagagacaggggaagtacacacagcagaacctcagcaccccagcacctacaacaggaaacccgagaaggaagcagtacccatgatctggctttgggatgaacagagctttctatggggaaaagacacaaggcataaggtagtcatcaccatgctgagacagggcattaccaagtgaggtcacaagctcaaggttttccagcatcacactgtggtacaggtgcctctgggctgcatcaaggagctcccactcctcttgggagaagtatacagccacatcttcaaaggttaccatgctcttcaatgtggggacagctgagccacagggccaagaagtatgctgacaaagaaacaaacaattggtcaaatggaaatatgcaggaccttgctgtgtgactcagaatcctgatacatctaccactaatatctctttttcttatgatcctctcagtccacccactactcacccatccacagcttatcttcttcctcagggcccccacctaacatgccctggaattaatggtgcccctctctcctagtagtcccactggtcactgtatccaggccaacccaacctagaggaacaataggcaggtgggcagatggatgcttcctcctccctcctgctggccaattttccttgtgtcttctggctcatacctcccaaacataagaaaatttgggcttccctttcttaagcctcttgtaccagggccatgggcccaatggttcacattctctcacctttacatgtcactcctcagaccatacagttcttatatttccaacccctccctgttcacactgtaggcattctccctagcatctcaccatgcacatggcatacctgacagatgcaaccgggatccattcctggtccaagccagctacagagctccaaaaaccccactgcaagaggcagtcatagcccctcaagtcaatgcctcccctgccagccctgttccttcaaccatcagctgcccagaaccataagcagatctcaaatatctcttccctctgatatctttgcctttgtatgtgttgtctcctccccagtcatagctgtccttgctcttcctaacactcaaatccaagatccactggcccccaccttggcttggggactcagcttaggctgaccctttctgatcttgccactccaccagcctgacaaaaaccccaggaccctatttaagaagagataacatgccctgaccacaagaaggatggccgcaacaatgtagtgagctgtagagaagcaaatcaacctaaaccaaagcccaactctcatcctacttttgccgctatgcttcactgttgtcctagacctactctctgctcaggaggctcagccactatcttgaacccaacccacaactgcatgcagtgtccacacacaagcatccatcccttggatgtttccagcctaaacccgacataatttcataatcacatgtttagtggtctacttggcacctcaatttggtagtgtctgggacatctcaaatacaacatggccaaaatccaactctttatcttccccctgaaatctactcctcacaccaacttccacatctgaaagatctaaggtcaatttttttttttttttttttgagacagagtctcgctctgtcacccaggttggagtgcagtggcgcgatcttggctcactgcaagctccgcctcccgggttcaagccattctcctgcctcagcctcccgagtagctgggactacaggcacccaccaccacgcctgactaattttttgtatttttagtagagatggggtttcaccgtgttagccaggatggtctcaatctcctgacctagtgatccacctgcctcggcctcccaaagtgctgggattacaggcgtgagccaccacgcccggcaatttttttttttttttaagacagagtctcgctctgtcactcaggctggagcgcagtggcacgatctcagctcaatgcaacctccatctcccagattcaaacagttcttctgcctcagtttcccaagttgctgggattacaggtgcacactaccatgtcctggctaatttttctgtatttttagtagaggtggggtttcgccacgttggccaggctggtcttgaactcctgacctcaagtgatctggccgccttggcctcccaaagtgctgggattacaagtgtgagccactgcactcagccttaggtcaatcttaacatttcactttctttcactgtcccacatcaggtaatccatggcccagtttgggcagattcagaagccaaccatctgtcctacctccacgggcacccctctgtccagctacccaaagcacacatctggaccacatctgtcagctcctcactggccttcctgctccaccatcaccatccctccagtctgctgcccactaggcatccatagggcgtctgttaagactggagtcagagcacctacttcctctactccaaaccttccatggctcccaccaccatcagaatagaggtccagctcctcaggctgccattccaggcctaactattggtttcccttccctgtttccaccagactaaatggagaccggcagtccccagaatgcttccatttcatcaccactaaacaaggtacacatgctggtcactgtccctgggacagccttccagatctcattccacaggattccagaaatgggaatccctcgatataaccccttgcctggattcaggatggtaagggtaagtgactcccagggcagggcccaggacccacgtgtgaggacaggacacgatcaagagtcccaggacaccaacatcccctctatctgggcttcaggatcctgagggccggaatcccagcgggtgagggcctggggcacactccacttacctgcgccgggcccatcagcaacgctggcaaccccattagaacctgtgggctgggcagggccataacaggaggcccagggctagccctgccgctgggccgaaccctcacacttccgctgggtgacggtcgcactcaggacctgtcttcccaaatgcaaaatgcgcgcaaggcctctgggcaccgcagggacgaaggctgggtatggagaccctggagacgcgtggcgctggctccactttcgggaacaccttggctcataaaagcagagtaattagccgggcactatggtgcgtgtgaaggcgcggtgacggtccctgcacccactcccgtgccctggtgtggctccagaggcctgctgtagcccaacccaccagcagcaaaatgaggaccgcaatggcggcgccggaagtcccgcctctcaatgacagctcggacttgccactggtccgagctttcattggctcaaggatccccgccgtctatgacgctatttccctatgcccgtcacgctactgctaggtcgttgccaaggtgattgaggaatggcgtttattgcgtcgctgctcaggcaacgcaaactacattatccagaaggaccctcgcggtgcctcagggctggccattggcagccgaggagacaggcacttccgggcggagtgtaagacgctggccaatcacagcctggcagcgggacttccgtcgtcgtcctcggaccatcactttggcatttctcgattttgtctgcttctgaagggaccgcgttgtcaggcgagggacggaatcttggaggctccctgggcccatggaaacaggagcgaggaaggcacgagagtcggggaagttccgccttcttgacatacaagcgcccccaccgcggcgaatatcgcccctgagcccagtgttcgccccccacaacaccgcaccccccttccccaccctgtgccttagataaagccggcccagtgggaccctcaggttgcaccgcgcggaggtgtccgcggctctcgggagtcgtcgcccttggcgttatgttggctttagggagcgcgaggccgaggccaagaaaagctacgcattgggaggtcttgacccagtgtgcgcccggctgtaggcatggaacgtgcgccaaaggtctcctggcacccactccgctggactcagcaccattgtcctaagtctccgattgagaagtatctgccccaggtcctctgcgggccccactgaacagtgtggagcgttcacaggttgggggtcaccatttcagaatccagtttgttgagacgtggagggtacaggaggagggatctgcatatgcgaagacttggacttgaccctgacctgagcgttcaggcaggctctcatgcccccttggcagcgagtggagagcgtaagaggagtcctgcctctcctggcacaccgagggcgcctgggagccatgaaaggtgttgaacagaaaagggatggacatgacctgagttagaatttggaaagtatttcagtggttgctgaatgaacacactactggagaaggtggttgtagtggggctggaagcagggagactgtgggggaggttattgcagtattgttccagacagttatgatagtggcctgtccagaacggaagcaagaaggatgggagaagtgatcagattcccagtggatcttcaagatagagctaatggaattttttgctaccttagataagtggaataagcatgagtaggggtgaaggaccatcccaagtagttaggaagaattaggatgcctcctgtggagaatagaggttggcagttggcaggaggaggatgtttcatggaagattagcgatggattttgtaggtatagagtctgaattgtctggagacctgtgagtggaggtgtcaaatgggcctctggatatatagaattctggtgtggcttcaggacgtccagactgcattatgttggtggcctggcccagtgaacggcctgaggataggatttgggaaggagggttttaggttggaggaccagtggctagggctcacgctcagtgcttagatcacatctgtctgcccattggcttggtgttgcagggcttaatgacctttgaggacagggtcagtacatcttccaagaatgtggggctccttagtgaggtccaagggggcttctacagtgacatgatactacagagctttgtactccagtgcccactaggtaaggctactgtgtctcctctttcccctacacatgaaatctaggttttcctccgcctttccattgttccctctgggaggtgctgctggccctggcactggccagtgtcctgctgtgtccggaattgtttccttcctctgggttcttggtctcgctgacttcaagaataaagccgcggaccctcgtgttgagtgttacagttcttttttttttttttttttgagacggagtctcgctctgtcgcccaggccggactgcggactgcagtggcgcaatctcggctcactgcaagctccgcttcccgggttcacgccattctcctgcctcagcctcccgagcagctgggactacaggcgcccgccaccgcacccggctaattttttttttttgtatttttagtagagacggggtttcaccttgttagccaggatggtctcgatctcctgacctcatgatccacccgcctcggcctcccaaagtgctgggattacaggcgtgagccaccgcgcccggccctgttacagttcttaaagatggtgtgtccggagtttgttccttcagatgttcagatgtgtctggagttttttccttctggtgggttcgtggtcttgctgacttcaggagtgaagctgcagaccttcgcagtgagtgttacagctcttaaaggtggcacatccagagttgttcattcctcctggtgggttcgtggtctcgctgacctcaggagtgaagctgcagacctttgcaatgagtgttacagctcgtaaaggtggcgtgtccaatgttgtttgttcctcccagtgggtttgtggtctcgctggcttcaggagtgaagctgcagacctttgtggtgagtgttatagctcataaaggtagtgtggacccaaagagtgagcagcagcaagatttattgcgaagagcaaaagaataaagcttctacagcatggaagaggacccgcgggttgccgctgctggcttgggtggccagcttttattctatttggccctgcccacatcctgctgattggtccattatacagagcactgattggtccattttacagagcactgattggtccattttacagagcactgattggtccatttttacagagtgctgattggtgagtttacaaacctatagctagacacagagtgctgattggtgcatttacaatcctttagctagacagaaaagttttccaagtccccagccaattagctagacacagagcgctgattggtgcgtttactaacctttagggagacacagagcgctgattggtgcatttttacagagtgctgattggtgcgtttacaaacctttagctagacacagagcgctgattggtgtgttggcagtcctttagccggacagaaaagttccccaagtccccactggacccagaagcccagccggcttcacttttcactgctacttatccctggctgctgcataaacaacccccacaccttccctgggatcttgacaaccttgtgaagccacagtgatggtccctgcacccactcccacgcccttgtccagctctagaggcctcctgtagcccaacccacaagccacaaaatgaggaccatcatggcggtgccggaaatctcacccctcaatgcccacctggaatcggaagtctcaaaacctgtgtagcatatcacatgcagctgggtcgtttcctggctaggttaccctgtcaggatctgtgacttttctgtcctttctgccacattccctcactctagtaggagttttctgccagctgtcccttgtgagtcccagtgggcactgacatggtcattgattgtggggtcactgagcattgactttgtgaagttcagttctttccagctatatacctgcataggtgatcttcacctacggtgatttgtcatggggtggatcaccttgacgtgggctgccttctcacaaaccacttgatgagagctgtataggatcactgccaccacccccgccatgtgatcacctaactagaacaaatgaagagacctggctggtggacagggtggcttgaattaggccatggacagagaggccccatggtgcaccagttctgttgagtggaagacagctgtggcagagctgttggcagtgccctggtggctcacctggtacctgagttgtgccctctgttgtcctggcaccaggatgtatagctgtgccttttaaaaaaaattttcctgaccttcttctgacactctatcctactttgccctgactcctgttccctggatggcttcctctctgtcttccaagattcactctttccccttctcccgtcctcccctccagtggccaggtcttctaccattggcctccctttaatgtgtcttgaacggataatgtatctttaaatagttgttatctgcacatggtggctcataactacagtcccaactacttgggatgctgaggcaggaggagcgcttgagaccaggagtttgagtccagcttgggcaacataacgagatcctatctctaaaataaataaataaatacatagatacctaaatagtttttgaaaacctcttcttccgtgagactggcttgttccatttgaggagtatgggcataggtgtcaatggttcaagacctggacttcgctcactgcatggtactgacctgtcaccagacactagggccctgcagctccacattttgcagaacctacagagaactgacactgaagagatagctgataaatacacagcatatggaaaggtgtttgaggggaagcaagccttttctcctaccaaaaaacttcacagtggaaaaaattgcaagtgtattatgagcatgggaaggccttcacttttgtcttcatcctgagaaagcaggagtacatgcacatcttcaaaggcccttacaagtatagtaacatggggaatcctccagccagaactctacctcctttgagcaccaatatgttcaccccagagaaagtccccataagcgcaaggagtgtggtccagccatgagcaaaattttgcaaaactctcctctgtatcaaaatggtcataccctaatgaaggactcctaagttcagggaatgtggggcactgccagctgtcctggtggcttccctggtacctgacttgaggttcatacatgttatattcagagttctgctttcattagcaaaaacaaattaacaccggaaaatggttgtacaaatgcaataactacatgaaagctttcagtgaaatatgaaacctcatcctgcagaattctcatcagagaggcccagtgcatgcagctaatgttggaaagcctattctcaattttaatcctatttagcaccagcaatttacagcattgtgagtgtagcatgtaggagagcaaaaaattgcagctcctgccttgatgtgcacaaagtgattcacactggaaaaaccctctatgagtgcagccagcatgggagagcatcggccacagctcctgccttgcttggcaccagaaacttcaccctggagaaaagccttttgattatagtaaatgtaggaaagtcttcacctcccttatttagtataaaagaattcacactggccaggtgtggtggctcatgcctgtaatcccagcactttgggaggctaaggcagggggatcacctgaggtcaggagtttgagaccaacctggctaacatggcaaaccccctctttacaaaaaatacaaaaatcagctgggcatggtaacgcccatctgtaatcccagctacaccagaggctgaggcaggagaattgcttgacctcagggggcagaggttgcagtgagctgagttagagccactgcaccccagactgggtgacagagcaagaccctgtctccctcaccaaaaacaaacaaacaaacaaacaaaaaacacagctgggtgcagtggctcacgcctgtaatcccagcactttgggaggccgaggcaggcagatcatttgaggtcaggagtttgagaccagcctggccaacatgatgaaaccctgtctctactaaaaacagaaaaattagccgggcatggtggcaggcacctgtaatcccagttactcaggaggctgaggcaggagaatcacttgatcctggaaggcggagattgcagtgagccaagatcatgccactgcactccaacctgggcaacagagtgaaactccatctcaaaaaacaaacaaacaaaacaaaacccagccctacatgagtagccttcagccacagctaaaccttgtgtagaaggattcctccctgaggagacactccatgatggccctgcatgtggagaagctgacagaacccatgttgtaccatgatcgccctgcatgtggagaagctgacagaacccatgttgtactttgcaacccgctgagggaccttggcagagctatcacaccactgggtcctgtggtggaagcccatctctgttttatggtgacttcccagttgctcaatgtaagtcactccctgtttcctgtttatactaccttggagggatggtaggggccttgcacacattggggtggtatcatgctcactcatgatggggtttgacatggacatgaccccattccaagcaaggagcctgattggataatttctttctcttttttttttttttttttttttgagatggagtctttctctgtcaccaggctggagtgcagtggtgcgatctcagctcactgcaacctccgcctcccgggttcaagagattcccctgcctcagcctcccaagtagctggaattacagccacacaccacctcgcccggctaattttttgtattttagtagagacagggtttcaccatgttggccaagatggtctcgatctcctgacctcgtgatccccccacctcggcctcccaaagtgctgggattacaggcatgagccactgcacccgacctctctccttttgtcttttcttttttcttttcttttcttctttcctttcctttcctttgctttcctttccttttctttcttttctcgtcctttcttttcttttctctctttcttttttttgaggcagagtctcactctggtgctcaggctggagtgcagtggcatgatctcagctcactgcaacctctgcctcccggtttcaagcaattcttctgtctcagcctcccaaatagctggacttacaggcgtgtgccaccatgcctggctaatttttgtatttttactagagacggagtttcaccatatattggccaggctggtctcaaactcctgacctcaagtgatctgcctgcctcggcctcccaaagtgctgggattactggcgtgagccaccatgcctggccgacaatgcaggagcttaaccaaaggaccacgttggctagggtcaatcagctgccccaggtgaccacccttagtgctaatcctgtgcagggtaggggtctgagccaaaaagaggaggctcttgtgtgtacagaaggcaatttgttgctatttttatttcatgcccaattcattaagaatgtttcaaacaattagcatttttctaagtattaagtaattaacatttgcctgaagaattacacattagatggataatgtaaaaataaagtgtttaagaagttaaacgtctccaaacattaaacattacttgagattggacatgatgggtcatgactgtaatcctagcagtttgggaggctgaggcaggtggattgcttgagtacaggagttcgagaccaacctgagaaacatggtgaaacctcgtttctacaaaaaaagtaaataaaattagccaggtgatatggtttggctgtgtccccacccaaatctcatcttgaattgtaactctcataattcccacacgttgtgggagggacccagtgggagataagtgagtcatgggggcagtttccccacactgttctcgtggtagtgaataagtctcaagagacctgatggttttataaggggtttcctcttttgcttggctctcatttgctcttacctgccaccatgtaagacagggctttcaccttctgccatgattgtgaggcctcccagccacatggaactgtgagtccattaaacctctttgtcttcataaattacccagtctcaagtatgtccttatcagcaatgtgaaaacagatgaatatagtaaattggtagagtggggtactgctataaagatacccgaaaatgtggaggcaactttggaattgggtaacaggcagaggttggaacagtttggaagcctcagaaggagataggaaaatgtgggaatgtttggaacttcctagagacttgttgaatggctttgaccaaaatgctgataatgatatgggcaatgaactccaggctgaggtagtctcaaatggagatgaagttgttgggaactggagtaaaggtgatgcttgctatgttttagcaaagagactggtggcattttgcccctgctgtagagatttgtggaactttggatttgagggagatgacttaaagtatctggtccgggtgcagtggctcacgcctgtaatcccagcactttgggaggctgaggcaggtggatcatgaggtcaggagatcaagaccatcctggctaacatggtgaaaccccgtctctactaaaaaaatacaaagaaattagcctggcatgatggcgggtgcctgtagtcccagctactcaggaggctgaggcaggagactggcatgaacctaggaggcggagcttgcagtgagccaagattgcaacactgccctgcagcctgggtgacagagcaagactccatctcaaaaaaaataaaaataaaaataaagtatctggtggaagaaatttctaagcagcaaagcattcaagaggtgactttgatattattaaaagcattcagttttaaaagggaaatacagcataaaagttcagaaaatttgcagcctgaccatgcaacagaaaagaaaaacacattttctgtggagaaattcaagaaatttgcataagtaaccaggagtcaaatgttaatcgcccggacaatggggaaaatatctccaggacatgtcagagacctttgtggcagcccttcccatcacaggcccagaggcctaggaggaaaaaatggtttcgtgggctccccctgctgtgtgcagcctacagacttggtgccctgcatcccagctgcttgaactatggctaaaaggagccaaggtacagcttaggctgtggcttcagagggtgcaagcctcaagccttggcagctcccatgtggtgttgagcctgtgggtgcacagaactcaagaactgaggtttgggaacctccacctagatttcagaagatgtatggaaatgcccagatttggagcaggcaaaagtttgctgcaggggcagggccctcatggagaacctctggtagggcagtgctgaagggaaatgtggggttgaagaccccacactgagtccccactggggtactgcctagtggagctgtgagaagggggccaccatcctccagactccagaatggtagatacaaccaacagcttggaccacgcacccggaaaagtcacagacactcaacaccagcccatgaaagcagctgggagggaggctgtaccctgcaaagccacagagctgcagctgcccaagaccatgggaacccactgcttgtatcagtgtgacctggatgtgagacatggagtcagaggagattattttggaactttaagattcgactgtcctgctgcatttcagactttcgtggggcctttagcccctttcttttggccaatttctcccatttggaatgggtgtatttatccaacggctgtaccccaattgtatctaggaagtgactaacttgcttttgattttacaggctcataggaagaagggaattgccttgtctcagatgagattttggactgtggacttttgagctaatgctgaaataagtagactttgggggactgttgggaaggcacgattggttctgaaatgtgagcacgagatttgggaggggcgaggaacagaatgatatggtttggctgtgtccccaaccaaatctcattttgaattgtagctttcataattcccacatgttgtggaaggggccccagttagaggtaactgagtcatggggacagtttcccccatactattcttgtggtagtgagtaagtctcacgagatctgatggtttcataaggggtttcctcttttgcttgactctcatttgctcttgcctgctgccatgtaagacgtgcctttcaccttctgtcatgattgtgaggcctctcca

SEQ ID NO: 315 - DNA, 99754 bp, Homo sapiens
gcgtagaggtgtttgtagtattctctgatggtggtttgtatttctgtgggatcagtggtgatatcccctttatgatttttttattgcatctatttgattgttctctcttttcttctttattagtcttgctagcagtctatcaattttgttgagcctttcaaaaaaccagctcctagattcattaattttttgaagggttttttgtgtctctatttccttcagttctgctctgattttagttattttttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttcttgttggtttcaaagactttaaaactactgctattaaaaaccctatctatactccttaactcttcatagtgtagagaaaatggtccaaattttgaaaagagtattggtgaggtgataatagctcttggattgaaaaattggtttataaccaaagtccagttacagatggaacgtctctgccacccactagaccagtggagcatctacacatggatttcgtgcagttgccactctcaatggcttaccaatatagtcttgtaatcgtattttgttctcaggatgaattgcagcctttccatgcataaagaccagctccataacagtagcaaattaaattactatggggcatacatagcctttatggagaatacctggagaaatttccagcagtaagggaactccttttactggaaaaattattaaacaatgaaataaagttttacaagtacgatggcactaccattgtccttatcatccctagtcttctggaaaaattgaatgaaaaattatatcttaaatctaagttgcctaaactaacaaaataatctggattgccttggccaaaacttttaccactggccttagttgcaatcagatctgtgctgaaaagcacatgctaacagcttatacaatagtaacaggaagacctatgaccttaattatagaacctcatttatctcttatacttctaaattctgtatgactaggtattgcaacatcttgatgcattatggtgaagaatatttccaccaagtaaaggaagctttctgtgacccactgactgatgaccagccttccataatatagaatctgaagattgggtcttttagaaatgacaccaaataaatacttctcttgagtctcattggaatgaaccataacaagttcttatcatcactcataaagcttcaggacttcaagacttgggttccagtctctcagctcaaaagggttcctcgagattgttggaactgtatgcaacctggagatctcgaagtaaaactgaccagggagatctctcccaccaaaagaagatggtatccttgaggtgaacagatttttaaagatcatggatcataaacctcttccctggcctctcatggaactccaatcttcttttctcttttggttctcactttttctttccatgtgtgcattgcaaaataatgctataattgaaattttatagtttgtagtttcagcagagattttaactgaatgttgtgtttgccatgccaaatccaaatcaatacatgaggaaaagaatgttctagcccattcttaactgattttaccagaatcccaaatttgaccatctgtttagattgcattactgatctacgttatgaagttagagttcaagacacattagttctttttaaaactttcttaattgatacataataattgtacatatttatggggtaaatgtgatattttgctacacacatagacggtatgatgatcaatccagggtatttgggtgcccaacaccttgagcgtttatcatttctttgtgtcaaaacatgtcaaatcttttcttctagctattttaaaatatataataaattattgttaactatagtcaccctattgtgctaacaaacactagaacatttttttctgtctaactgcatgttggtatctattaaccaacctctctttttcctccagcccactcttcccagcctctggtggctatcattctgctctctactttcatgaaaatcaacttttttaacttctacatatcaatgagaacatgtgatatttgtctttctgcacctggattatttcacttaacataatgacctctgattccatccatgttgctgcaaaaaatgggatttctttcttttcagtggctgaatagtattccattgtgtatatgtaccacatttgctttatccgttcatcccttatggacatttaggttgaatccatatcttggctatcatgaatagtgctgcaataaacacgggggtgcaagtatccctttgatatactgatttcttttcctttaaagaaatatccaataatgggaatgctggatcgtataatagttctatttttagttttctgagaagtctttctactgtttttcacatacatttcatgtgaatgtactaagttacattctagcaacagtgtaaaagagttcccttttctctgcatccttgccaacatttgaataagggtggtgtcagtgggcatccttgtcttgttccagatgttacaagaaagaatttcagctttctcccattcagtgtattaactgtgagtttgtcatatatggcctttaggttgacgtaatgtccctcgtttgtctgagagtttttatctcgagaagatgttgagttttatcagatgctttttggcatctattaaaatgatcatgttttttgtcttttattctgttgatatgatgtatcatgttccatgatgtgcatatgttaaacatctttgcatcgctgggctatatcccacctaatcatggtatattatatttttgatgtattcttggacttagcatgctagtattttcttgaggatttttgaatctatcttcatcaggggtattcgtttctacttttttatagtgtctgtctgtttttggtaccagaggaactcttcttgtcataacttaagccagaattgaaataccagatcctctgacagtagtctaagggagatatgcaacagaaaggaaagcttaaataaaactctttgcaagaatgcctattgagctacattttgatagcctctcagtaagtaacaactcagtatcagtccttggttagaaattgccaatgtctttattccaacaaatggctccataaataattcttagtagcactgtcagggtacacatttttatctgtggaagttttaacaagcaatcatatgcatgggtcactccatggcttaacaaacggagaatgaaaaactaatgcagactagtgccactgtcacttcataacaaatcagaaaataagcattggtcctctcctctaaacttaaactatagataaaaaaggaacttatcagcaggtatcaatcccgctgggtgtttccatggcttcaactagtataaataaaatttgtcattcacattagctagtataactgattccacaactaaggctatagctgacaaataaaaatctctagattctccagctcaagttgttttaattgctttagattatttgttggctaaacaaggaggtgtctgcaatggctaatatttcttgttatacctggataaacacatctggtgttgtaaaaattcaattacaaaaaaaattaataagcaagccatctagttaagacaggttaaattctcctctagttcattctttgatttatttgattgtagttgggttggttctttgggggcttggctaagaagcatactttagtttctttgtattattctcttaatagtaaccattctaatctccctggtatgctgtgtcctctcaagaaccttaaatgcatgctcataaccatcaacaatacaccagattatcttgttgcagtgagaacaaggaaaaagataaacaacacaagaaaagtttactcaatgaacctgacatcatgacttatgaattccatgctgaaacaaaggccaaccagccacgattgtgacagtcacacacacacacccaagttttggccaatcattaataaataagaggctgatcagaagggaggacttattaaaataatttaataggatgcctttagcctaaggtggaccctgagacctaggttcccatggaagcaaaccaaaatctaacgtgaatgtgtttgtcattaagtgactaacttagagaaagtaaaacttaagttcaaccaatcagaaaccatcaaataacctctaattacataactagggattgtccacataggtaattcaaataaggcaattatattactgtaacaaactgatcttttttttttttttgactttccttctctattcatcctataaagcttttcttttgagcatccccagtagacccccaaccacaatccttggttggataatgccagattcataaattgcaatttgttcaaatagcctcaaaaggactaatgtgactcaatttaagttttttaagttttccattaattccacttctcttccaacgtcatatatctctattatcataggtctgctaagtcatattgcccaaatgtcaggactgcttaagccacagcttgaaccgtggagagcccttttctgtcctggaacccactcaaaactgtcattattctcccatttagacagatgtgtctatgagtaggatttttacaactgtgtcagacattaagaaaagttttggaaaattttaaaataagtccttaaattactgcattacactgctggactaagattttaagagtaataagccacatatcatcacacttattttgctgaatataaaattattattactttaataatagtgcttgttaaacaatattttgtatcattactaaataaaattttaaaatttaattattttatttaatcttgtactttctaaatttttacttttgatgttgtactatacataataatttagtacagtgacatctatttaatatttacataagaatgtatatatatttaagatgtactccaaatgattttactgatatgaatgtacaataaaaatggttgtaaatcccccctctagtgaagccacaagagtatacaacagttaaaacataagagtaaatgagacaatctacggagaattctagaataaaagaagtaggccaagaatacaacagaggggaatagaagcatcattaagggaaaagagagaaacatggcccagcatcaaagactgaggtgagaaagtgaggaagatagaaccagtgagtattatcacagaagccagaggtgaagggactttcaatagcaccaaacactacagcttggttaggaagataggtagatgttctttgaaggtgacatttagagttcattgcgatcttactcagagaaaagtttcagtgaaatggtgagggcagaaaccataaatttgagggatctaagtagaacaatttgtaatctaactgcccattccccttatattgcttatgagttcttgtaagatgcagccaccctagtttacaaaccattttttgattagctcttgtgctttcaaaattccagacttttgtgatatgattccctcacctcttcctcttcttcattctctctgcctattataatcctacttattttgcaaagtttatctcaactgacacttccattgagaaatctttctttgttcctcgggtcactatgcactttcttctttatatttttataaaccttacttaccctttttttggccaggtgctgggattacacacccgtaatcccagcactttgggaggctgaggcaagtggatcatttgaggtcaagagttcgagaacagcctggccaacatggtgaaaccccgtctctactaaaaataaaaaaaattagctgggtgtggtggcatatgcctgtagtcccagctatttgggaggctgaggcaagataattgcttgaacccaggaggcagaggttgcagtgagctgagatgacaccactgcaatccagcctgggagacagagcgaggctccgtctcaaaaaaaataaaaataaaaacaaaaacaaaaaaacttatttacccttttttatatcacagcctgaattatactctagttagcaatctatgtgtctttcttcccaactagattatgagcttcttgtcaggagccatttttatctaagaagttcttatcctcaccctgttcataccccagtacccctatgccaattttcttttttccactgccctgtatgttgtaagtacttaataaagggaaaataaaactgaaattttagcaatcagtgtagtaagtatggattgagggtctgaggatctagctcagtttgctacaaagtgcccaaaagatttatgaattggtctgtgacttgacgatatttaatcaagatttacacaatcatgggatatactactcacaccttattaagtgataagtatattatagagcaggcaagtattgtgtatttcaagaagaagaaaaatcaatttgatttcaaagattaagaaaggctgcaagatcttctttgaactcaactattgagatggaaaagagggagaagctgttttagataagagaaacattactagcaaattaattgaagcaaatgcacaaggaacaaggaagggagcacatggccgagtttgctgagataaggaggagaaaacaagttgatgataagatacagaaaacaatgggatatctagaacaccaaaataagaaaaattgatttggtttgaaaagtaatgggaattttataaattcttgagcagtgcagtattattttttccccctttcattcagcaagtcctcaattagcactaaagagtgccagacacggccaggcgtggtggctcacgcctgtaatcccaacactttgggaggccgaggcaggcagatcacgaggtcaggagatcgagaccatcctggctaacatggtgaaaccccgtctctactaactatacaaaaaattagccgggcatggtggagggtgcctgcagtcccagctactcgggaggctgaggcaggagaatggcatgaacctgggaggaggagctggcagtgagccgagatcgtgcctctgcactccagcctgggcaacagagtgagactccgtctcaaaaaagaaaaaaaaaaaaaagagtgccagacactgttcaagatatttgaaatgcaggattgaatgtgtcaaagaaaccccttccctttaagcctatatgctaatgatagtgatgggacaggagtgaccgattttagatgtcctaacaaatatatagtatatcgaggagtgaagtgtgaagaaggaaacaacagggtaaaggacagctggtatgagcagaaaagacggtatagcaatctcaataattcatatggggagccagataataataatatcaaagtttccctgagggcattgtaggatgtgggaacaaattcacctcacagagtgaagaagttgatgaccttggccgcactttctacactttcttggatcctctttaaatactaattattttctacaaagcatattagtcacacttcccccagtaacaggtcaaaccagcctgagactattttctgcctgttttatcttgtatgttcagaatagtgaataaaattgtaaaaatgagatcggtttcatatgaatcagcaagatgatcatcaaacagactttagtgaaggtcatttgtttttacctcattatctcacaagacatctttaattaatttcaagtggtttatatatttttaggactgagtccacagaattacactgatgtcagtgcagagaaatccctttaggatttggtggaaagctttaactttgcagtgttacagatataattatcaacactgacctactagtagtctcctagattttcattcttttaatcccaaatgttttagaggccaaggtttatattctttaattttatgaaaaccacatcataaagctgttacaaagctcttctcagtaaaatctaggtaagagaagcgtgctaacttatttttacttctaattttagcaaccataaagctctgaattatttagtacctctgaattatttagtatcttttattgttcttaaatttcagcttttttctaatctttctagcacttttcaaaattgaatgctatgaagaactaggatgagacacaatactgcaatttgtctgactttctgattgtaacagaatttcaaaacacataagtaaagttacaaagaaattctgttaaataatttaggcatgtacatagaaagttattgctaacttaactgactacatggcttacatttattattttaaaacgaattaataaaatagtcagcccatgtttttgttttaatattttgaatataaaaacatgtctattttgaccatagaacttatatgatttgaattatcagtcagtatgtcctaatgaatcactatgcagggaaaggaaatagccttttaaagcaaaacaaaatttgacttcaaaaatcctattaagatataaaggattttctcctttttcctaagtgttagaaggctatagtataaaggtgagcttgcttttacttagtagcttttaatctgctatagtatacttcagaaaatcttatataattttctgaagaaacagaaaaatggtagaaaagagtcaatttagataaaagaaagacacctaaaattttatgtaatgattttatatatttctttgtagactttcctttaaagctaatagtctgcagaaaccaaagaatcattaaggatcattagtagaattcataaagcaactttactcattccaggtcatcagggtggagctaatactgaaattaatactgccttttcccccatagtattttacagctcttttcacagaagtataaatcacaactaacctcaaaatgcttacaatataagaaaattgaatagactgacatttttaaaaagcaatgtatatataggcaagaaattctgaattgtgtggagtatataagagagcatctaccgttcggaaaatggaaatctgtgtggactggggcaattagttaaaactttaagtagcattatataaaaagtattccttatcaaaaggaggaaggatttaggcatgtaagagaaaatcaacaggaataatagaatggatagagtcaatgtttatgaaatgggtgtgacactggggaaagggatgagacaagtgataatctacggatgtttatttctttaaatctccaagataattttctttaaagataaatattttcctcctcagttcttggtgaatttcatacagttcctaagatataaatttaacatatctgttatatgcttttttaaaacattcaatctactggaagaatatatagaaattattttcttggagagagatgtgtgtgcgtgtgtgtgtgtgtatatatatatatatagccccatataatatatatattctatattatatgacatatatatatatattataaatttgttttaaggaggatcttcaatacaaaactgacagtgaaattatttgagaacaatgaaccagataggggtcccctagttttttatgctatccttgcataaatttataaagatgaaccatttccactttaaacatcttccctggaattatcaaaatatccttgtgaatcctaagggtcagagcttgaggtcacagacactgacactttaggagaacaaatgtcccctagaagtatgtgaggatgtatttagaaacagcaggggaaatatgacaaagaaattcctctacttgttgtaaaaaggaaaaaaattgaaggaacaataatatgctctcaattacaatcaattacaatattataacccctcattcatctctcaacagacaaggtggagatgaataaggagaatcactccttgatagctgagttcatcctcacaggatttacatatcatccaaagctgaagactgttctgtttgtggtgttctttgccatctatctgatcaccatggtggggaacattggtttggtggcattgatttatatagagcaacgtcttcacacaccaatgtacatatttttaggcaacctagttctgatggattcctgctgttcctctgctattactcccaagatgttagagaacttcttttctgaggacaaaaggattaccctgtatgaatgtatggcacaattttattttctctgtcttgctgaaactacagactgctttcttctggcggcaatggcctatgactgctatgtggccatatgcaacccactgcagtaccacaccatgatgtccaagacactctgcattcagatgactgcaggagcctacctagctggcaacctgcatcccatgattgaagtagagtttctgttgaggttaactttctgtgggtctcatcaaatcaatcattttttctgtgatgttcttccattatatagactttcttgtattaacccttatatcaatgaattggtgttatttatcttggcaggatcaattcaaatctttactatagtcttagtttcttatttctacatccttttcacaatatttacaatgaaatccaaggagggaagaggcaaagctttatctacttgtgcatctcactttctctctgtgtcaatattctgtgattcccttctcttcatgtatgctcgaccaggtgcagttaatgaaggggataaagatatacctgttgctatattttatactttagttattcctttattaaatccttttatttatagcctaagaaataaggaagtaataaatattatgaaaaaaattatgaagaagagaaaattttgtcacattctgaaacaaatgtcatcccctctggcaacttgataatactttattttaaatcaagggatagtgaggcagtttacaaggccactttgaatataaaatattaaattatttaaaaataatgatataggagttcaaaatgttcagaaaggagaaattcctgtaaaatatacttcaaaatctaagctactagtgttcatcaaaagtgaactaaattattcatgaagtctcagattgtgtcagagtgtaattagttacaattttcagcaaatccaacaaatactaggaataaatgtcagtacatataacggtagtgtgcatttactattgttggcaaatttctggaatcttaaagcataattttacgaactcaggcacattccaagttctcaaacattagtccctttttaaccagaatcatctgtgagaagtaaattgtctgtctgaatttgattctaactttttttgagttctttcaagagattgcttgaaaaattattcatgcagaatatgtattctctaatcaataatattttcatatttagtgttagtcattagtcattttacattctcaagttctatgaaacagagtacctgtattgattgcttttccctttctataatgccataattttaaaaatgtatttctgggcttggcacagtaatctgggcttatgcctgtaatcctagcacttccagaggccaaggcaggtagatcacctgaggtcaggagtttgaaactagcctggccaacatagtgaaaccccatctctactaaaaatatttttaaaattagccaggcatggtgcatccttataatctcgactacctaggagactgaagcaggaggatcgcttgaaccctggaggtggatgttgcagtgagctgagatcaggccactgcactctagctttggtgtcagagtgagactctgcctcaaaaaatatatagaaataaataaaaagtgtgtttctgtgtcattcactctcaactcttagtaacactgaatcccagacatctattcagggaagagtttgtgacttatatggagccagtgagacagaaaaggtgattttttcctgaaaaatgagttttcttattttaaaagagatccacaaaaaatagtctttctctctctgagtgttacggtatgcggatatgaaacccagcagagccaattccctttcaccatcaagaggaaaaccagcctggagttgtagtcaatactcaaatgagggcatagctgaagaaatcacacagaaatagacccaaaatctctggagtaaaccatctcttctgactgtataatccaatagaccttcttatcttttaagcttatttggcagagatgttttattcatgactgaataaatactaacggatacattcctgcttcttgactatcactcgtatttgtctctttatattctattttaaattaatcctcaggtgatcttttagttttcaaataacttttcagtggtatccattttactgtacagcaaattaattaggttttttactcttattactattttaatttctaataaccttactttaaaaaaaatgagggacagagaaatttcttgtctacagaaatacagtggtagagctcaggaaccaaacccaggctatctggctccagaatccatggtcttaaccactaagtcatactgtacatagcacaaactaaaagcaggagaggaaacattttaacaatctcagctgtgaagtgggcagagaaatagggcagagattcaaaagagatatggatcaaagacatttacctccaaatttattttgaaaaatttcaaacctacagaaaagttgaaaaaagtatatgattaacattcatatacttcttttagccaattaagcaatcaaacaattgttaacaattattgaacaattattaacattttacaatacttgcctatcaccaaatgtgtatataggtatataatacctatatacatacttataatatatatatacattaatgcagtacaaatgtacatatatattacatgtccatatggatattatacaaatgacacatatacacataaatatatacttacaatacatgtatacatacagttaatacctatatacatagatacattttttaataatcaaaacatctaaatagggcactggcttgttattagcagttccaccaacctgaactactttaattgtaaattactgatgggctcacagcaataacagaacattaagatgctgttaggcataaatgatgcagaaaatagggattccaagcatctaaacaatatttatttattaaatacacaaatatgaaaaaaatttactgagaaattgctatcttgctatgcactaagctagtgtcaaagaaaaccagagcaggacaaaagttaaagtgctaaatacaaagttgattcaggactattgccataggggcagaaaaaccccagtgtagagcttcatttcaaatgcagcagggaaaagggaggtcttgtagccaaagaagcagggggtggccagcgaatgaaaaattattaagaagagacatcaaatctagggggaattctggttgaaccaatcgaaaaggatttatttattcttttatttatttatatttgagataaataaatcacattgtcacccatgctggagtgcagtggtatgatcatagcccactgaatccatagcacctgaatcctaacaggatttttgctgaaggcaagccagagtattcagataccaagaatgggaagggaagaattttgatcagatatagaaggtcatcaggtattgaggatgggaggattcttgctagattgtctttctgcattatttactagaactagattttacaagaaagtacacaagtcagccaaagagaaggttcagaagcctgaccgtagtttgttcaagggaaaaagaggcattcttcccttaagtttatttctcctccagtttgctcatttatgactagcaaaaccatctgcttgtacctggtgcaggttgctaattgtattgtgagatcaatgagacatttaatgagagggatacccataaagaaaaacagaatgataaatattagaggctgctctgctgggttttttttcttccaagaaggaagcttagaagcagtgttagcacacctctcccacttgaaaggacagaatagcatgtagagatttatgctgtgaacttttttcaagaagcaacacaggaacttaacaagaaaactgaaagaagcacaggctgtttgaaagaagtggcaggctacagcctacactgtgaaacagccaaaaaactctaagtccccaaagtgtgagaaggggacagactgcatccaggatacacatccccatcagggaacgtgaaatccaggccatgggggaaggcctttaccctacccagagctgggactgatttagggaatagtgagaaatataaaagtagaggcagtagtggaaagcaccttgcaggcattcccaatctctagcatggactgagggaaaccattcattccttattatacctcacagggactcagggaagtcagccaagtagctcagacagtggtcacagtttgaaagaagcctccagttgaattttgggatataatattgagtgggagcaaactcccttggccagaacccaggggcaagtgggaagtacactgcagccatgagtgcaggagccaggctgccaaggctgcctggagcttagctcagtgctgctagcagaacacttcaggagtgagaacaactttgccaactgtgtgggatctgggtgaggcttactgccacctgctactctttactccctgtgcaaactctcttctgtgcaacagaggcagttacactcccctctggagcattaccccagcagcctgataaatgccctctgaccctcagagaagctgcagcttgccactcatgtggagagtcagagcacagccccaacctggctgtgcccctccaccctccctggtagtgtaacacaaatgacagaaacatttaggagctttatggccctgcccatcacctgagaaaccagaatatctcctctgggcaaagcagggaaagctcaaatcctgctactattacaggagcaggtactctttggcaagtgctacctcctggctggaggccagccaacacagtccactacagcatctctagatagaataagagtgtgcccagaaataagaaaactggtatctgacctcagctaccaccactgcctgcaacacactggctaaccaggaggtctgagtctgtccacatgccgagttcactaccatcataatcaacattcaagaaaaacaacacactaaggctatctataatcaaggattctcacaaagtctacatcactcccctgccactcccatcacagccagtactggtaccaactgctgtggttttgaggaaaggtaacatcactagaaccctcacagactttccccagcaccagcctggagtatagcagccccaccgggtggttagacccagaagaacaatcactatagtctggctctcaggaactcatactcctagagtatgggagagagcacctcatcaatggaacaccccatgggacaaaacaatccagttcttctgggtgaatatctgtctcaaaatgcaaccatgtcaacatttccctggtcagctattttttttctgtaattccatatatgttcaactagtatgaaatctgtgcatattggaaccacgcaatgccaagactgcctacacttacttttgaactgattgtctaggttcctaataaagaagtctctacctaccatgaaggaccctgaagcaaagaagacaaaattctcaacagaatcaggagcatctctataaaaattctattgtttccttaacttgagttattaaaatacctgggacaaaagaatctggatggcaagccttaaatcccagatttttccactggtgggaagtttctttcagcagagacacaattgcagtgctgggctcaggagggaaattttgcagctctactttaacagtcaggcagccttggtgctcatgaaagatcttacagaaggggaattctttccttccttgtccgccactgcagacacagctggggcttctcccatgggagctcagcatgggtgcacctatagagagtgtcaggcctctgagcccaagccaagccatcgcatcccctgtgacttgcacgtatacgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaagcacccccactgagcaccttgcaacccccactcctgcccgccagagaacaaaccccctttgactgtaattttcctttacctacccaaatcctataaaatggccccacccttatctccctttgctgactctcttttcggactcagcccgcctgcacccaggtgaaataaacagccatgttgctcacacaaagcctgtttggtctcttcacatggacgcacatgaaagagagtcttcctggaacacttcagagtactgcattcccacagaaggagcactcccaagattcaggtttgcatgagaggcagagtcacaatttctctctatttggaatatcagcatccttacagatgaaaagaggtgcctctcttgggacacgagtgagtcttggaggtggatagctttactgctggcctggtggaagaactgaattggctcccatccttctccctgataagacctcagtgtgcctaattgagagctcctccagccaccttcatcaaggctaggacctttgcacaccattgggtattgcatttatccatatgctttagctacaacctgttcctacccagggacacctcccctactggcctgaagcctgaaccatcaactcagtaaataaaatactggaggtaaattaaataaattaaaaagtacataccatgggggaatgagataaacttcaacagacctctgccattccaattctataggagatagtgaacttgcccacacactgagtacattgctactacaacaaatatctgaggaagccgtcatacaaagactataatcaaggaactcaaacagagtcttcctcaaacagagtcttcacccctaaaagcaccatcaagaacaaaattagggtaaaaagaaaactataaacattaaagtcgcatccttaagggagaaaaaatgaaattttagaaaaagtcaaatcaaaaataaattcaagaacacttagaagaaatagtctacccaaataagaaagaacgagaggagtaattctggtaataaatataacaaaacaaggttctataacattctgaaaagattcccccagtaatgaatccaaaccaaaatgaaattgttgaaataccagataaagaattcagaaggtcaattattaagctactcaaggagatactacagaaaggtgaagaccaacataaagaaaattttaaaaaattcaggatacaaattaaaaaattctagacaaataggtatcataaagaaaaaccaatcagaagttccaaaaatgaaaaactcatttagggaattacaaaatgcagtggaaagtttcaactatagactagaacaagtagaagaaagaatctcaaaactgaaaggcaaagatttttaattaacccaatcagacaaatataaggaaaaatgaaacaaaagaaattaacaaagtctcaaagaaatatgagattatgtaaaacagctaaccctaacaataaacggtgtccctgagggaaaagagaacgcttaaaatttagaaaacttacttgagggaatcattgaggaaaacttccctggccttgctggaggtttagaaatccaaatacaacaaactcaaagaactcctgggaaatttattgcaaaaagattatcaccaaggcacatagtcattgtgctatctaaagtcaacatgaaggaaagtatactaagagctgggagaaaaaagcatcaggtaacttatagaggaaaatctatcagactaacagcagacttctcagcagaaaccattaaagctaaaaggtattggggttctatctttagtctccttaaacagaataactgtcagtcaagaatttttgaatccagcaaaataagttactttcataaatgaaagaaaaagttatttttcaaacaaatgctgaggtaatttgctattaccaaaccagcactacaataaatgctaaaaggagttttaaatcttgaaacaaaaccttgatatgcaccaaaatagaacctcttgaaagcataaaactcagaaaaaaaagtatgtaggtaacaatgaacatgatgaatagatcagtacctaacatctcaatattaacattaaatgtaaatggcctaaaagctccacttaaaagatacagaatggcagaatgtatacaaaatcacaaaccaaatatctgctgtcttcaagaggctcacctaacacataaggattcatataaactcaaggtaaaggggtggaaaaagatattccatgcaaataaaaaccaaaagagagtgtaatggtaaaagggtcaatccaacaagaagatattacaatcaatatcaaattacaaatttacatgcacctaacactggagctcccagatgtataaaacaattgctactagacctaagacatgagattggcagcaacaaaataatagtgtgggactttactattccactgacagcactagacatattattgagatagaaagtcaacaaagaaataatggatttagtctgggcatggtggctcacacctgtaatcccagcactttcggaggctgacaggggcagatcacctgaggtcaggagttggagatcagcctgggcaacatggtgaaactctgtctctactaataatacaaaaattcactggacatggtagtgggtacctgtaatcccagctattcgggagactgagcaggagaatcacttgaacctgaaaggtagaggttgtagtgagcagagatcgtgccactgcactccaacctgggagacagagtgagactccatctcgaaaaaaaagaaaaaagaaacaatggacttcaactacactctagaagaggtgggcttaacagatatttacagaacattctacccaacaactgcagagtatatattcttctcataagcacatggaacattctccaaaagagatcatacaataggcacaaaacaagtctaatacatataagagaattgaaattatattaagtatcttctcagattacagggaaataaaactagaaaccaactccaaaaggaatagtcaaaactgtacaaatatttggaaactaaataattttctcctgaatgatttttggatcaacaataaaatcaagatggaaattttagattattcaaacgaaataataatagtgaaaaagttatcaaaatctctgggatacagcaaaagcagtgctaagaggaaagttcatagcattaaatgcctacctcaaaaaagtcttgaagagcataaattgacaacctaatgtcacatcttaaggaagtaaatacaaagtaaacccaaaggcaacagaagaaactaacaaagttcagagcagaacaagatgaaattgaaaccaaaaagtataaaagataaatgaaacaaaaaactgattctttaaaaaggcaacaaaaatttatagatagacaatttgccagattaaccaagaagagagaagatccaaataaactcagttagaaatgaaactagaaacattgcaaccagtaccacagaaatatgaaagatcatttaagcctactatgaatgcctttatgtgcacaaactagaaaatctagaggaaatgaataaattcctggaaacatacaaccttcttaattgaattaggaagaaatagaaaccctgaacagatcaacaacaagcagcaagattgactcagtaccaaaaaaaaatgctaataaaaaaaattcaagaactggatggattcacagctgaattctaccaaccaatcaaagaatggttggtaccaatcctactgaaactactccaaaagattgagaaagagggaatcctccctaaatcattctatgaagccagtattaccctaatacccaaagcagaaaaggacataacaacaacaacaacaacaacaacaaaactacagaccaatatcccagatgaagatagatgcaaaaatcctcaacaaaatactaaatatctgaatccaacagcacagcaaaaagataatacctcatgatcacacgggcttcatcctggggtgaagagatggtttaacatacagaagtcaataaatgtgatacatcacgtaaacacaattaaaaacaaaagtcatgtgatcatctcaatagatgcagaaatagcattctatcagatccagcatcactttatgataaaaaccctcaataaagtagttatatcaggttgctgcaaaaggtaattgctgttttgccattaaaagtaatagcaaaaaaacacaatttacttttgaaccaacctagtagaagggacttacctcaaaattggtgagccattgatttgagagcagctgtgatgttgtccatggccatgatgaattgtataagtaatgactaaatgattctattttgttgagtctaactttttcagccaggtggtagattcctaggaatggtacccaaaggtggcaaacctttctgaaaatgtaatgagatcatgaaaggaacttgttctatagctgtttttcctaaattatctccttaggaactgagatcagctacaaaaatacctctgagtttctgaaaaccttatttttccaatagtgagaattaggtaaactggagaaggtgggtgatagttcaataaaagaagaaaattgtagaaaatcaagcaacataaagggattagtaaaattggtaagaaaagaagatctggttcagtaggtcagtaaaagacaagcataggttccacagacaaaataagaaacatcaggagctaacaaatgttcataaaaataattatctgatatcttaaggtgacaataggatgcaaattttgagggtgtagaaagggcttattggatgtggtctacatgcagctggcttgggtcagggaaattaggctgggagggggaatgagaacatttccatttacattatggatatcctgggaatctatagtggcttcgaggctttatattggacttagtgacaactagataaatgtagagacaaatactcattgccaaaatgaggactgcattattggaccacagcagctctcaccatgggcttctggagccccagcaggaggagaccccttaaaaagtagcaggggcagcaagccagctgaggtgaagcccagagggtttggtttggtagcatctgtagcagagcatagtcagggaagtccatccccctaggctagacttgctcccatagaagactttagacctaggggaattttcagacctgatatccacagggcagtcttgcccatcagatgagactggtctgacctgagcaccccttggtctgctggcctctcccagggccacagcctggccatgtctgcttgcaggacagtcttgggtacactgggggcctacattagagcttctctgcttgtagactgtgcatgaccagtggcaagccccagtgaagtggccactacagccatgcattagtctgcccactcctttcccatactgcagcttcctccaggtccacagtgactccccacatcactttgttggcacacgtctgcacaggtgggttttacttcattgcctcaccagcaaatggaagtgcagtttgcctctctgctaccaaccaccattgaagatggagccttggcaggcccagaggcagcaaccattgccctgtcagcaccctgcacttgtactaacactgcaaagagaacagcagatcctcccccaacctgaaagatcactcttgcttttgaggcacagagaaagtacccagacctgcacccacaagcaccctgcccccaagccaacaccaccttcaatgcaatcacacacaccataaagttagggggaggctccccatcctccccgcagctgcatttcctctaccactgtggtaagtacctgcaggaaagcaggaaccccagcacccactatcactctgtcacagctgcacctcagcaaccccccaccaactgcagtggatccaaaccctgaagagtgaaagttggggccaaatactagtcctccagagttacagcgcacagttcaggagttgggagctgagtattggccccctaaaatcacccagaaatgaagccagttggctgaatccaccttataccacaatccaaccctcaaggttatcaaataggataaaaggaaaaacaaacatccaaaggccagcaatttcaaagattaaaagtagataagcccacaaagatgaaaatgaatcagcacaaaaatgctcaaaattcaaaaagccagagtaccttcttttctccaaatgatcacatcacctctccagcaagagttctgaaccagcctgagatggctgaaatgacagaaatataattcagaatatggataggaaacaagatccttgagctacaggagtacattaaaacccaatgcaaggaagctaaaaagtcatggcaaacaatgcaggaggtgacagacaaaatagatagtatagaaaaaatgtacctggcctgatagaggtgaaaaacacatctacaagaatttcataatacaatcacagatgttattagcagaatagacaaagcagaggaaagaatcttagaaattgaagactagctttctgaaataagaaagtcagacaagaatagagaaaaaagaatacctcattgatgttcctaaaagagatggggagaatggatgcaacctgcaaaacatattccaggatatcatccatgagaaattctccaatccagctagagaggccaatattcaaaatcaggaaatgcagacaaccccagtaaaatactttacaataagatcatcccaaagacacataatcatctctaaggtcaaaatgaaagaaaatatattaaagacaactggagacaaaggtcaggtcacctaaaaagggaagcccttcagaataacagtggacctctcagttgaaaccctacaagctagaagagattggaggccaatatcaatattctgtaaaaaaggaaattccaattcagagtttcatatccagccaaactaagcttcataagagaagaaaaaataagatccttttcagataaacaaattctgatggaattgtttaccactagacctgccttacaagagctcctgaaagaagcactaaatatggaaaggaaagaccattaccacctactagaaaaacacactgaagtacagaaatcagtgacactataaagcaataacattaacaagtctgcaaaataatcctctaacatcatgatggtaagatctaatccacacatatcaatactaaccttgaatgtaaatgggtgaaatgccccaattaaaagacacacaatggcaagctggataaagaaccaagatccattgttatgctgtcttcaagagaccagtgttatgtggaataatacacataggctcaaaataaatggaggaaaatctaccaagccaatggaaaacagaaaaaaaggaggggttacaatcctagtttctgacaaaacagacaataagccaataaagatcaaaaaagacaaaaaagggcattacacaatggtaaagggttcaatccaacaagacaacctaactaacttaaatatatatggacccaacacaggagcacagatttataaagcaagtgcttcgaggccttcaaagagacttagactctcacacgataatagtgggagactttaacatcccattgacaatattatacagatcatagagacagaaaattaaaaatcatcaagacagaaaattaacaaaaatatttaggacatcaactcagcactaaatcaaatggacatgatatatatatacagaattcttcacccaaaaataacagaatatacatttttctcatcaccacatgacatgtactctaaaattgataacataatcagaacttaaaaactcctcagcaaatacaaaagaactaaaatcataacaaacaatttcttggaccacagtgcaatcaaattagaaatcaagactaagaaattcactcaaaatgatacagttacatggaagttgaataatctgctcttgaagtacttttgcgacaagaaattaaggcagaagtccaaaagttattcaaaactaatgagaacaaagagacaatgtaccaaatctctggaacaccactaaggcagtgttaagagataaatttatagcactaaatgaccatatcaaaagttagaaagatctcaagttaacaacctgtcattacaactaaaagaactagagaaccaagagtaaacaaatcccaaagctagcagaagataagaaataaacaaaatcagagctgaacagaaggaaatttagacacacacaaaaaagccattccaaaaaaccaatgaatccaggaggtgattttttgaaaaaaaattaataaaatagatagactgctagctagattaataaaggaaaaaagagaagactcaaataaacacaatgagaaatgacaagagggatatactactgacaccacagaaatacaaacaaacatcagtgaatattatgaacacctctatgcacataaactagaaactatagaagaaatggataaattcctggacacatacaccctctcaagaacgacccagcaagaaattgaatctctgaacagaccaataacaaggtcaaaaattgagtcagtaataaatagtctaccaatcaaaaaaagactgggaccagacagattcacagctgaattctaccagatgtacaaagaagagctggtgtcattcctgctgaaaccagtgcaaaaaatcaaggaggagggactactccctaactcattctatgaggccagcatcaacctgatgacaaaacttggtagagatacaaaaaaaaaaaaagaaaaaaagaaaacttcaggctaatattcttgatgaacattgatgcaaaaatcctcaacaaaatgctggcaaaccaaatacagcagcacatcaaaaagcttatcaggtaggcttcatccctgggacacaagtctggttcaacatacacaaatcaataaatgtggttcattacataaacagaactaaagacaaaaaatgcacgattatctcaatagatgcagaaaaaggtttttgataaaattcaacacttttttgtgttaaaaaaaaaactttcaagaaactggatattgaacaaacgtaccacaaaataataagagccatctacgaaaagcccacagaaaatatcgtactgaaagggaaaatgctagaagcattccccttgaaaattggcaccagacaaagatgcccactctcaccactactattcaacatagtattaggagtcctggacagaacaatcagaaaagagaaagaaataaaacacatccaaataggaagagaggaagtgaaactatcatatttgcagactacatgtttctatatcaagaaagccccagagtctaagcccaaaagcttctttagctgataaacaacttcagcaaagcctcaggataaaaaatcaatgtacaaaaatcacaagcattcctatacactaatgacagtcaattcaagtgccaaatgaggaatgcaatctcattcaaaattgccacaaaaagaacacaatacctagaaatgaagctaaccagggaggtaaaagatctctacaagaactaaaaaacactgctcaaagaaatcagagatgacacaaatgaatggaaaggcattccatgctcatagataggaagaatcaatatcatgaaaatggtcatgaggtggagccaagatggccaaataggaacagctccagtctacagctcccagtgtgagcaacgcagaaaacgggtgatttctgcatttccacctgaggtaccaggttcatctcactagggagtgccagacagtgggtgcagtgcaccgtgcacgagccgagaagcagggcaaggcactgcctcactcgggaagtgcaaggggtcagggagttccctttcctagtcaaagaaaggggtgacagacggcacatggaaaatcacatcacttgcaccccaatactgtgcttttccaacgggcttaaaaaacggcacaccaggagattatatcctgcacctggcttggagggtcctacgcccatggagtttcactgattgctagcacagcagtctgagatcaaactgcaaggctgcagtgaggctgggggaggggtgcctgccattgcccaggcttgattaggtaaataaagcagctgagaagtttgaactgggtggagcccaccacagctcaaggaggcctgcctgcctctgtaggctccacttctgcgggcagggcacagacaaacaaaaagacagcagtaacttctgcagacttaaatgtccctgtctgacagctttgaagagagtagtggttcgcccagcacgcagctggagatctgagaatgggcagactgcctcctcaagtgggtccctgaaccccgatcagcctaacgggttggcacccccaagtaggggcagactgacacctcacatggccgggtactcctctgagacaaaacttccagaggaacgatcaggcagctgcatttgtgggtcaccaaattccgctgttctacagccaccgctgttctgcagccatcgctgctgacacccaggcaaaaagggtctggagtggacctctagcaaactccaacagacctgcaactgagggtcctgtgtgttagaaggaaaactaacaaacagaaaggacatctacaccaaaacccatctgtccgtcaccatcatcaaagaccaaaagtagataaaaccacaaagatgggaaaaaacagcagaaaaactggaaactctaaaaagcagagcacctttcctcctccaaaggaacgcagctcctcaccagcaacagaataaagctggacggagaatgactttgatgagttgagagaagaaggcttcagatgatcaaacaactccaagctataggagaaaattcaatccaatggcaaagaagttagaaaccttgaaaaaaaattagacaaatagataactagaataaccaatgcagagaagtccttaaaggagttgatggagctgaaagccaaggcttgagaattgcatgaaaaatgcagaagcctcaggagccaatgcaatcaactggaagaaaggatattagtgatggaagatgaaatgaatgaaatgaaggaagaagggaagtttagagaaaaaagaataaaaagaaacaaataaagcctccaaaaaatatgggactatgtgaaaagaccaaatctatgtcggattggtgtacctgaaagtgacggggagaatggaaccaagttggaaaacgctctccaggatattatccaggagaacttcccctatctagcaaggcaggccaacattcagattcagtaaatacagagaacgccacaaagatactcctcgagaagagcaactccaagacccataattgtcagattcaccaaagttgaaatgaaggaaaaaatgttaacagcagccagagagaaaggtcaggttacccacaaagggaagcccatcagactaacagcagatctcttggcagaaactctacaagccagaagagagaggggaccaatattcaacattgttaaagaaaagcattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatagataggaacaactggtaccagccactgcaaaaacatgccaaattgtaaagaccatcaaggctagaaagaaactgcatcaactaatgagcaaaataaccagctaacatcataatgaaaggaccaaattcacacataacaatattaactttaaatgtaaatgagctaaatactacaattaaaagacacagactggcaaattggatacagagtcaagacccatcagtgtgctgtattcaggaaacccatctcacttgcagagacacacataggctcaaactaaaggggtggaggaagatctaccaagcaaatggaaaacaaaaaaaggcaggggttgctatcctagtctctgataaaacagactttaaaccaacaaagatcaaaacagacaaagaaggccattacataatggtaaagggatcaattcaacaagaagagctaacaatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctgcaccaagcggacctaatagacatctacagaactctccaccccaaatcaacagaatgtacatttttttcagcaccacaccacacctattccaaagttgaccacatagttggaagtaaagcactcctcagcgaatgtaaaagaacagaaattataacaaactgtctgtcagaccacagtgtaatcaaacaagaactcaggattaagaaactcactcaaaactgctcaactacatggaaactgaacaacctgctcctgaatgactactgggtacatgacgaaatgaaggcagaaataaagatgttctttgaaaccaatgagaacaaagacacaacataccagaaactctgggacacattcaaagcagtgtgtagagggaaatttatagcactaaatgcccacaagagaaagcaggaaagatccaaaattgacaccctaacatcacaattaaaagaactagaaaaacaagagcaaacacattcaaaagctagcagaaggcaagaaataactaagatcagagcagaactgaaggaaatagagacacataaaacccttcaaaaaatcaatgaatccaggagctggtttttagaaaagatcaacaaaattgatagactgctagcaagactaataaagaagaaaagagagaacaatcaaatagatgcaataaaaaatgataaaggggatgtcaccactgatctcacagaaatataaactaccatcagagaatactacaaacacctctacgcaaataaactagaaaatctagaagaaatggataaattcctcgacacatacaacctcccaagactaaaccaggaagaagttgaatctctgaatagaccaataacaggatctgaaattgtggcaataatcaatattttaccaatcaaaaaaagtccgggaccagaaggattcacagccaaattctaccagaggtacaaggaggagctggtacccttccttctgaaaatattccaatcaatagaaaaagagggaatcctccctaactcattttatgaggccagcatcatcctgataccaaagcctggcagagacacaaccaaaaaagagacttttagaccaatatccttgatgaacatcaatgcaaaaatcctcaataaaatacttgcaaaccatatccagcagcacatcaaaaagcttatccaccatgatcaagtgggcttcatccctgggatgcaggctggttcaacattcgcaaatcaataaatgtaatccagcatataaagagaaccaaagacaaaaaccacatgattatctcaatatatgcagaaaaggcctttgacaaaattcaacaatgcttcatgctaaaaactctcaataaattaggtattgatgggacatatctcaaaatattgagagctatctatgacaaacccacagccaatatcatactgaatgggcaaaaactggaagcattctctttgaaaactggcacaagacagggaggccctctctcacagcttctattcaacatagtgttggaagttctggccagggcaattaggcaggagaaggaaataaagggtattcaataaggaaaagaggaagtcaaattgtccctgtttgcagatggcatgattgtgtatctagaaaaccccattgtctcagcccaaaatctccttaagctgataagcaacttcagcaaagtctcaggatacaaaatcaatgtacaaaaatcacaagcattcttatacacacataacagacaaacagagaaccaaatcatgagtgaactcccattcacaattgcttcaaagagaataaaatacctgggaatccaacttacaagggatgtgaaggacctcttcaaggagaactacaaaccactcctcaatgaaataaaagaggatacaaataagtggaagaacattccatgctcatgggtaggaagaatcaagatcgtgaaaatggccatacggcccaaggtaatttacagattcaaagccatccccatcaagctacaaatgactttcttcacaaaattggaagaaactactttaaagttcatatggaaccaaaaaagagcccacattgccaagtcaatcctaagccaaaagaacaaagccggaggcatcacgctacctgacttcaaactatactataaggctacagtaaccaaaacagcatggtactggtaccaaaacagatatatagatcaatggaacagaaacagagccctcagaaataatgccacttatctacaatcatctgatctttgacaaacctgagaaaaacaagcaatgggtaaaggattccctatttaataaatggtgctgggaaaactggctagccatatgtagaaagctgaaactggatcccttccttacaccttatacaaaaattaattcaagatggattaaagacttacatgttagacctaaaaccataataaccctagaagaaaacctaggcagtaccattcaggacataggcatggccaaggacttcatgtctaaagcaccaaaagcaatggcaacaaaagccaaaattgacaaatgggatctaactaaactaaagagcttctgcacagcaaaagaaactaccatcagggtgaacaggcaacctacaaaatgggagaaaattttcacaacctactcatctgacaaagggctaatatccagaatctacaatgaactcaaacaaatttacaagaaaaaaacaaccccatcaaaaagtgggcgaaggacttgaacagacacttctcaaaagaagacatttatgcagccagaaaacacatgaaaaaatgtcatcatcgctggccatctgagaaatcaaaaccacaatgcgataccatctcacaccagttagaatggcaatcattaaaaagtcaggaaacaacaggtgctggagagggtgtggagaaataggaacacttttacactgttggtgggactgtaaactagttcaaccattgtggaagtcagtgtggcgattcctcagggatctagaactagaaatgccatttgatccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaatgtggcacatatacatcatggaatactatgcagccataaaaaatgatgagttcatgtcctttgtagggacatggatgaaactggaaaccaccattctcagcaaactatcacaaggacaaaaaaccaaacaccgcatattctcactcataggtgggaattgaacaatgagatcacatggacacaggaaggggaacatcacaatccggggcctgttgtgggatggagggaagggggagggatagcattaggagatatacctaatgttaaatgatgagttaatgggtgcagcacaccaacatggcacatgtacatatgtaacaaacctgcacattgtgcacatgtaccctaaaacttaaagtgtaataataataaaaaaattaaaaaaaatggtcatatggcccaaagcaatttatagattcaatgctattcttatcatttgattcttcacagaactagaagaaaacattttaaaattcatagggaactgcaaaagagcctgactagcaaaggcaattctaatcaaaaataacaaagctggagacatcacactacccaacttcaaactatactacagggctctagtaaccaaaacagcatggtactggtacaagaccagaaacataccaatggaacagaataaagaacgcctgaattagaccacacacctacaaccatctgatctttgacggttctgacaaaaacaggcaacaggtaaaggattactttttcagtaaatggtgctgggataactgggtaatcatatacagaaaattgagcctgggctccttcctcacaccacatacaaaaattaatatggattaaaaacttaaatgtaaaacccaaaactataaaaattctggaagacaacttaggcaataccatccaggatataggaatgagcaaaggtttcatgatgaagacactgaaagcaattgcaactaaagcaaaaaattgacaaatgggatctaattaaaagaccttctgcacagcaaaagaaactaacaacagagtaaataggcaacctatgaaatgggagaaaatttttgtgatctatgcatctgacaaaggtctaatatacagcatctataaggaacttaaacaaatttgcaaaaaaaaaaaacattaaaaagtgggcaaaagacataaatggacacttctgaaaagaagacacatgtggccaaaaataatagaaaaaaaggctcaccatcactggtcattagaaaaacacaaatcaaaacctcaatgagataccatctcacaccggtcagaatggctattactaaaaagtcaaaaaccaacagatgctggcaaggttgtggagaaaaaagaatgctttgacactgtgggtgggagtgtaaattagttcaaccattgtggaagacagtgtgacaattcatcaaagacctagaggcagaaatactatctgatccagcaatcccaatactgagtatatatccaaagtgatataaattgttctattaaaaacatgcacaagtatgttcactgcagcactgttcacaatagcaaagatgtggaatcaacctaaatttccatcaattatagaagaaagtagagggaatcaaagcagtcagcccagctgagctccacttggagccagggagaattccccattgtggagaaaagataaatgagagatccccagcagtccacattcccactgtagactcctgaaatgatatcttttttcaagatgcatgtgaaatgttacccatcccatgaagcttttcctgattatgtggaagaatataggaacgttcactcatttgaaacaattcgtagtttatttatgcttctttttttaaatgttcaacttttattttaagtttaggggtacatgtgcaggatgtgcaggtttgttacataggtaaacatgtgtcattgtggtttgctgcccagattatccccatcatccagttattaagcctagcatccactagctattcttcctgatcctctccctcctcctacctcccaccctctgacaggccccagtgtgcatgtttttcccccatgtgtccatgtgttctcatcctttagctccctcttgtaagtgagaacatgtggtatttggtgttctgttcctgcattagcctgctaaggttaatggcctccagctccacccatgttcctgcaaagaacaagatctcattccggggctgtatagtattccatagtatacatgtaccacattttgtttattcagtctatcattgatgatacgactcctcagccctcatgggctctgagaccagtattagtagcttcctggagtccatggcagtccaataatactatcaagtactgtttcagacagtgcattcatgacagatttcacacaaccctcaaaaccaagcagctgtagtaaaacaccacccccagcagcagagctgccttgcacctccacgcacctttaggaggcctgagtatgggcctctctgcatatcatctaggtgcctgaggacaggtccacctcagccactgccattaatgtcatcatgttccatctggggtcctgacagacctgcccagcttgccactgctgctgccacctacacatgttgtctgagggtctgggaattgttccaccctaaccaccattagagatacctgccagcaccttctaagtacctctgtgcaatgttttcactacaaataaacatcattttatagaggtaaacaataaaaaagaaaaaggaacagagaatatacaaaataatcagaaaacaatgaacaaaattgacagaagtaagatctcctctatcatcaaaaaccttgaatgtgaacaatttatattcccaaattaaaagatatagtctggccaaatggatggtgactgtttggaagtgtgtccccacctaaatctcatgaggaaatgtcacccccaatgttgaatgtgggttctggtggggggtggttgaatcttgggggaaattttctcatgaatggtttatcaacatccctctttgtactgtcctcatgacagtgagtgagttcccatgaaatctgatcatttaaaagtgtgtagcatctccgccactcgctctcttccttctgctcccaccatgagagatgcctgctcccccttcaccttctgccatgattgcaagcttcctgaggcctccccagaagcaggtgctagcattatgcttcctgtacagccttcagaatcatgagtgaattaaacctcttttcttttaaattacccagtctcaggtattctttatagcagtgcaagaatgaactaatatagatggggaaaaaattatatcctgcctttaagaaactcacttcacctgcaaagatatacaaggactgaaagtgaagggatgggaaaaatatttcatgcaaatggaaacaaaaagtatgcaagagaagctataattataacagacaaaattgaaattcagtcagaaaaacataaaaagtgacaaagaggtcactatattatgataaaaattgaattcaccagagatatgtaacaattcaaatatatatgcacccaaaattgcagaacccagatatacaaagcaaatataattagaaccactgagagagaccccaataaaataatagttggagaattcaacatccaactttcaatattggacagatcatctagacagaaaattgacaaagaaacattggatttaaacttcactttagaccaaatgaacctaacaaacacttatagaatatttctcccaacagctacagaatacacatttttctcctcatcacatggaacacttttcaggctaggcaatatgttaggccacaaaaaaaaacttcaacaaaaattgttaaaaaaaatcatatcaagtaactttgagaatataatagaataaaattcaatattaacaagaggaactttggaaactgagcaaatacatagaaattaaacaacatgttcctgaatgaccactgagtcaaagaagaaattacaaaggaaatcaaaaaaatgttagcaacaaatacaaatgaaaaggcagaaacagaaaataaaataccccatattctcacttgtaagtgggagctaaacactgagtacacatggacataaagatgagaacaataaacactggggaatacaagagaggaggagacggggagagaacaagggctgaaaaacttcatcttgggtcctgggagatggattcattcttactccaaacttcagcatcatgcaagcaatatacctttgtaacaaacctgcacatgtgcccccgaacctataataaaagttgaataaaaaccacaatatattgaaactagagggataccatcaatgcagaattttgagggaagtttataccagtaaattacaacactaaaacaattgaaatgtttcaaataaacaacccaacaacacacctcaagagctagaaaagcaaaaccaaaattatagaagaaaagaaataataaaaagcaaagcacactaaacaaaatagaaaacaaaatgaaaagtatatttttggaaaagataaaattaatatactttagctatactaaccaagaataaagagagaagactcaaataaataaaatcagaagtgaaaaaggtgacattacaacttatatcacagaactacaaagggttgttagagaaaattacaaacaaatatatatttgtttgtaatttttttttcttttttcttatactttaagttctagggtacatgtgcacaacgtgcaggtttgctacatatgtatacaggtgccgtgttgggttgctgcacccattaactcgtcatttagcattaggtatatctcctaatgctatccctcccccatccccctactccatgacagaccccggtgtgtgatgcccctgccctgggtccaagtgttattgttcaattcccacctatgagtgagaacatgcagtgtttggttttctgtccttgtgatagtttgctccaaatgatgatttccaacttcatccacgtccctgcaaaggacatgaactcatccttttttatggctgcatagtattccatggtgtatatgtgccacattttcttaatctagtctatcattgatggacatttgggttggttccaagtctttgctattgtgaatagtgccacaataaacatatgtgtgcatgtgtctttatagcagcatgatttatagtcctttgggtatatacccagtaatgggatcactgggtcaaatggcatttgtagttctagatccttgaggaatcaccacactatcttctacaatggttgaactagtttacactcccaccaacagtgtaaaagtgttcctatttctccacatcctctccagcatctgttgcttcttgactttttaatgatctccattctaactggtgtgagatggtatgtcactgtggttttgatttgtatttctctgatggccagtgatgataagcattttttcatgtgtctgttggcttcataaatgtcttcttttaaaaagtgtctgttcatatcctttgcccactttttgatggagttgtttgattttgtcttgtaaatttgtttaagttcttgtagattctggatattagccctttgtcagatgagtagattgcaaaaattttctcccattctgtaggttacctgttcactctgatggtagtttcttttgctgtgcagaagctctttagtttaattagatcccatttgtcaattttggcttttgttgccattgcttttgatgttttagtcatgaagtccttgcccatgcgtatgtcctgaatgttattgcctcggttttcttctagggtttttatggttttaggtctaacatttaagtttttaatctaccttgaattaatttttgtataaggtgtaaggaagggatccagtttcaactttctacatatggctagccagttttcccagcaccatttattaaatagggaatcctttacccattgcttgtttttgtcagttttgtcaaagatctgatggttgtaaatgtgtggtgttatttctgaggcctctattctgttccattggcctatatctctgttttggccccagtaccatgctgttttggttactgtagccttgtagtatagtttgaagtcaggtaacctgatgcctccagctttgttcttttggtttaggattgtcttggcaatgcgggctcttttttggttccatatgaactttaaagtcgttttttccagttctgtgaagaaagtcatttgtagcttgatgaggatggcagtgagtctgtaaattaccttgggcagtatggccattttcacaatattgattcttcctatccatgagcatggaatgttcttccatttcaaacaaacatatcttaacaaattagaaactcttgaggaaattgatacattacaggatacatacaaactacaaggattgaatcaggaagaaatagaaaacctgaagaaatcaataatgagtaaggagatcgaatcaataataaaaatctcccccaccaaaaagtccaagaacagatggctttacttctgaattctaccaaacatatatagaagaactaacatgtacaaacttctcaaagtgttccccaaaatttgaaggacagggaactctttatacatttttctatgaatcaagcattatcctaataccaacacagacaagaacacaccaccaccagaaacaaaacaagccaaaccaaacacaaaggcccctacaggccaatatccctgctgagcataggtacaaaattcatttttaaaaaaaatcaccaaactaaatccaataacatatcaaaaagataatgcaccatgatcaagtggaatttatctcggggatacaaggatgattcaacataggcaaatcaataaatctgatgcatcacaccaacaactaaagaacaactgatcatttcacttgattcagaaaacgcatttaataaaattccctttgtaattaaaactctctacaaattatacatagaaggaacatactttaacataataaaggctatatatgataaacccacttctagcatcatactgaatgaggagaatctggagccattccctaagaacaaaaacaaggatgtccacttttcccattttaattcaacatggtaccgcaagtcctagcaaaagcaatgagaaaagagaaagaaataatggtatttaaatcggaaattgggagtcaaattgttcctctctgcatatggcatggttttatatacagaaaaatctaaaacatcacaaaaaaactcttagaactgtgaacaaattcagtaaagtttcaggatacaaatttaatagaaaaaattagtagcatgtctaatcattggtaattaactagatgaaagagaaatcaagaaaaaaatcccatttacaatagcttcaaaaagtaagaataaatataaacaggaaggtgaaaattctttataagaaaaactagaaaacattgatgaaagttgaagaggacacaaacaaatggaaagacaatccatgttcatgggttggaaaaattaatattgttgacatgatcaaactacccaaagtaatcaacagattcaatgccatccctatcaaaatacaaaagatattctttacaaaaatagtacaagcaatcctaaaatttgtatggcaccacaaaataacttgaatagccaaagcaatttgattaaaaagaacaaagctttaggcattacactacctgactttaaaatatactacaaatctttactaatcaagacatcatggcattggtataaaagcagacacataaaccaatgaagcagaataaagaacttaaaataagtccacatattgacaatcaaccgatatttgacaaaggtgccaagaacatccattggggaaaagatatcctctttaacaaatattgctaggaaaactggatatctatatgcagaaaaataaacctagaccccatattttcatcatatacaaaaatcactcaaaatatgtaacaactaaaatgtaacactcaaacctattttttaaaactagaagaaaacatagggaaaacactttgggatatttgcaaaaattttatggctaggacctcaaatgcacacacagttaaaaaaaaaataaagaaatgggacaggaaagctgaaaagcttctgcacagcaaaggaaaggacataatctaccaagtgaagagacatctgtggaatgggaggaagtatttgcaaactatatttccatcagaagaccaatatctagcatatacaaagaactcaaacaaaaatacatcaaaaaccaataatctcattaaaaagtgggcaaaagatttgaataaacatttatcaaaagaagacatccaaatggccaacaggtatatgaaaaaatactcaatatcactagttatcagggaaaagcaaatcaaaactacaatgagatgtcatctaatcccagttagaatgctgttatcaaaaagacaagaaataacacatgaagataaaaatgtggagaagtgggaactcttacatattgctaggggaaatgtaaattagtatagccattatagaaaacagtacgagggtttctcaaaacctaaaaatctgactaccatgtgttccaactatctcactactggacatttatccaaaagaaaagaaaagggtatatcaaaggtatatactcattttaggattgcctgtactatttttgtaaagaatatcttgcactcgtatgtttattgcagtactattcacaaaagctaagctattgtatcaacctatgtgcccatcaatggatgaaaaaagaaaatgtggggagatcataggatcgtggtggatgggaggcaggactagattgcagctctgactcagacagacagagcagtgtgtggaggctcgcatcatgaatttttgcaggaataaatcaggaaatctgagaggacccacagaccctctgaaggaagtagattgctcctgcaggactcaggagacaccccatattctgtgagtgcccaaactgtaaaagtgggaaaggaagattgtccaccccagaacacacaccctcactggggaaaccgaagttctagattatgggaggagattctgaccttaactggaactgaatcaatttagagagcttagcaaaatacaggggtagaggaagcagcaggaaaagccctgtgaccttgctgggtcacctagcaaaccatttctgcctggcctcacaggggtccttcagaagggcagccagaggtactggaaaaaggccactgggagaaggaaatctccactgaactttggaacaatttgtactgatcgagaagtctcctggccagaactcaggggagggcatgaatctggtgtgcagactccacaggcagaggaagaaggtaagccatacttgcttttgcagctggggggcaggtagcctggagcaagttctcagccccgcttactcactgcctggaaacagacttggtgctgttggtgggggcacagagggagtgagactggccctttggattgtgtgggaactggatgaggtctgtgactgatggctttcccccacttccctgacaaccagcatgacaccatagagacagccataattctcccaggaacataactcaagtgaccggggaacctcacccctatcccccacagcagccacagcaagacccacccaaggagaatctgagctcagacatgcctagccctgctcccacccatggtccttcccttcccaccctggtaactgaagacaaagggcatatacttttgggaattctggggacccacctaccatctgttcctccccatactactacagctgatggtctctggacagtaccacttcctggcaggaagccaaccaacacaaaaatagtgcattaaaccaccaaagctaagaactctcacagagttcatttcacccccatgccacctccacttgaatgggttctggtatccatggctgagagacctacagaaagtttacatcaaggactgtgcagacaacccccagtaccagcctggagcctggtagacttgctggatggctagatccagaagagagacaacaatcactacagctcagctctcagaaagccacatccataggaaaaggaggagagtactatatcaagggaacatgccaggggacaaaagaatctgaaccacagccttcagccctagacctttcctctgacagagccagaggaaactggaaaagaaaccagaaaaccaactctggtaatatgacaaaacaaggttctttaacaccccccaaaaattgcaatagctcactgtcaatggatccaaaccaagaagaaatccctaatttacctgaaaaagaattcaggaagttagttattaagctaatcagggagacagcagaaaaagatgaaggccaatgtaagggaaaaaaaaaagatatcagaagtgaagagagaaatattcaacaaagtagatagcataaataaaaaacaatcaaaactttaggaaacaattgacacacttatagaaatgcaaaatgctgtggaaagtctcagcaatataatcaaacaagtagaagaagcaaattcagagttcgaagaaaaggcctttgaattaacccaatccaacaaagacaaagaaaaaagaataagaaaatatgaacaaagcctccaagaagtctggaattatgttaaatgacaaaacctaagaataattggtattcctgaggaagaatagaaatctaagagtttggaaaatatatttgggggaataataaaggaaaacttctccagctttgctagagacctagacatccaaatataagaagcacaaattcattgcaaaaagatcatcacctaggtaaattgtcatcaggttatctaaagttaagatgaaggaaagaaacttaagagctgtgagatgaaagcaccaggtaacctataaaagaaaacctatcagattaatagtcggtttctcagaagaaactctacaagcttgaggacattggggccctatctttagcctcctcaaacaaaacaattatcagctaagaattttgtatccagaaaaactttcatatataaaggaaagatacagtcattttcagacaaacaaatgctgagagaattcaccactaccaagccaccactacaagaactgctaaaaggagctctaaatcttgaaacaaatcctggaaacacatcaaaaccaaacctttttaagtataaatctcacagaacctataacacaaaaatacaatttaaaaaacaaaattgtaaaaatacaatttaaaaaaacaaaaaaccaaggtatacagaaaacaaatagcacaatgaatggaatggtacctcatatctcaatgctaacattgaatgtaaatggcctaaatgctccacttaaaagatacagaattgcagaatggataagaattctccaacccaactatctgttgccttcaaaagactcacctagcatataaggactcacataactcacataaacttaaggtaaaggggtggaagaagacatttcatataaatggacactaaaagtgagcaggagtagctattcttatatcagacaaaacgaactttaaagccacagcagttaaaaaaaaaaagacaaagagggacattatataatgatgaaaggccttgtccaacaggaaaatatcacaatccttgtccaacgggaaaatttcacaatcctaaacatatatgcacctaatactggagctcccaaatttataaaacaattactaatacacctaagaaatgagatagacagcaacacaataatattattgtgttggtaataatagggcacttcaatactccactgaccacactagacaggtcatcaagacagaaagtcaacaaagaaacaatagatttaaactataccctggaaaaaatggacttaatggatacaaacagaacattccatccaacaaccacagaatatacattctattcaacagtcaatggaactttcttcaagatagaccatatgataggccacaaaatgagcctcaataaattttaaaaagttgaaattacatcaagcactctctcagaccagagtggaataaaactggaactcaactccaaaagcaaccttcaaaaccaggcaaatgcatggaaattaaataacctgctcctgaatgatcattgggtcaaaagtgaaatcaagatggaaacttaaaaattatttgaactgaatgacaatagtgacacaacctatcaacacctctgggatacagcaaaggcagtgctaagaggaaagttcatagccctaaacacgtacactgaagtgtctgaaggagcacagacaatctaaggccacacttcaaggaactagagaaacaagaacaaaccaaacccaaacccaaacccagcagaagaaaggaaataaccaagataagagcagaactaaatgaaattgcaacaacaaaaattacaaaagctaaatgaaatgaaagctagttctttgaaaagataaataaaattgatagaccattagcaaaaataaccaagaaaagaagagagaaaatccaaataagttcaataagaaatgaaacaggagatattacaactgacatcacagaaatacaaaagatcattcaaacctactatgtacttttttttgcacacaaactagaaaacctagaagagatggataaattcctggaaagatacagccctcctagattaaataaaaaggaatttgataccctgaaaacaccaataacaagcagcaaatttgaaatggtaatttaaaaattaccaacaaaaaaaaggtccagagccacacagattcataacagaattctaccagataatcagtgaaaaattggtaccaatctattgacactattacacaagatagagaaagggggaaccctccctagatcattttatgaagccagtatcaccctaatacaaaaaccaggaaaggatataaacaagaatgaaaaccacagaccaatatccttgatgaatacagatgctaaaatccttaacaaaatactggctaacagaatccaacaacatatcaaaaagataatccaccataagcaagtggattttataccagggatgcagggatggtttaacatatgcaagtcaataaatgtggtacaccacattaacagtattaaaaacaaaaattatataatcatcttgatagatgcagaaaaagcattcaaaaaatccagcatctctttatgattaaaactcagcaaacttggcatacaagggatatacctcaatgtaataaaagccatctatgacaaagccacagtcaacataatactgaatggggataacttgaaagcattccctctgagaactggaacaagaccagaatgcccactgtcaccactcctctccaacctagtactgaaagtcctagccatggcaatcaaaaaagagaaagaaataaagggcatccaaatcagtaaagaggaagtcaaactgttgctgtttgctgattatatgactgtttgtctagaaaaccctaaagactcctcctagaactgataaaaaaaattcagcttctagaactgataaaagaattcagcaaagtttctggatacaaaattaatgtacacaaatcagtagctcttctgcacaccaacagcaaccaagctgagaatcaaattatgaactcaattcttcttacaatagctgaaaaaaaaaaaaaaaaactttggaatctacctaaccaaggaggtgaaagacctctacaaggaaaactacaaaaacactgtcgaaagaaatcatagacaacgcaaacaaatgaaaacacatcacatgcttatggatgggtagaatcaatattgtgaaaatgaccacactgccaaaagcaatctacaaattcaacgcaattaccatcaaaataccaccatcatgcttcacagaattagaaaaaagcaattttaaaattcatatgaaaccaaaaaagaacccacatagccaaagcaagactaagcaagaagaacaaatctggaggcatcacattacctgatttcaaactatattataagaccatagtcaccaaaacagcatggtactggtataaaaataggtacacaaaccaatgaaacagaatagagaatccagaaataaacccaaatacttacagccaactgatcttcgacaaagcaaagaaaaacataaagtggggaaaggacaccctattcaacaaatggtgctgggataattggctagccacatgtaggagaatgagtctgaatcctcatctctcaccttatacaaaaatcaactcaagatggattaaggacttaaatctaagactgaaactataaaaatgctagataacactggaaaaacacttctagacgttggctttggcaaggatttcatgaccaaggacccaacagcaaatgcaataaaaaccaaagataaatagatgggacctaattaagctaaagagcttttccacagcaaaaggaacggtcaagatagtaaacagacaacccataaagtgagagaaaatcttcacaatctatacccttggcaaaggactaatatccagaatctacaacaaactcaaacaaatcagcaagaaaaaaacaaacaaaaaatcccatcagaaagtgggctaaggacatgaataaacaattctcaaaagaagatatacaaatggccaaaaaatatgaaaaatgctcaacatcactaataatcagggaaatgcaaatgaaaaccacaatgtgataccacgttactcctgcaagaatggtcataatcaaaaagcaaaaaatagtagatgttggtgtggatgcagtgaacaggaaacacttctacactgctggtgggaatgtaaactagtacaaccactatggaaaatggtgtggtgattccttaaagaactaaaagtagaactaccatttgaaccagcaatcctactattgggtatctaccagaggaaaagaagccattatacaaaaaagatacttgcacacgcatgtttatagcagcacaattcacaactgcaaaatcatggaaccaaccaaaatcatggaaccaaccaaatgcccatcaatcaaggaatggatagagaaactgtgtgagagagatatatatatatatatacatatatatatatatatatatatatatatatatatgcacacacacgcacacaaacacacacacacacacaaaggaatactatttagccataaaaaggactgaattcatggcattcacagtgacctggatgactttggaaactattattctaagtgaagtaactcaggaatggaaaaccaaatattgtatgttctcactcataattgggagctaagctatgaggatacaaaagcataagaatgacacaatggactttggggactcagggggaaagagtgggaaggaggtgagggataaaggagtaaaaaaagggtgcagtgtatactcttgggtgatgagtgtaccaaaatctcacaaatcactgctaaagaatttactcatgtaaccaaacaccacctgttccccaataacctgtggaaatgaaaaaaaagtgcatattttactatttgctaatgcaaatggcatagtaaatttgcaaatcacatttcattcttatttgcagtggctgacacaaatgtaaaaatctctttattaacaaaaaaaatgtggtatatatacacaatggaatactattcagccattaaaaaaagaataaaattggttgtcagggcttcaagatgccttcttcactaagaagaaccaaaatagtgagtagataataacactttgaatacattgtccaagagagaatattagaattcaagagaaaagtgacagaaaacacctaaagaaaggaaaaagagtgaagcaagccagcctgctcagctggaatcagctgagagccagaagagacttcctgacacagggaaaatgttgagtgagaggcctccagtagtgcacattcctgctgtggactcctgcaagcccagccacaggagaatcccttgatccttgcagaccctgaagctgacacaaggagctgctggaaaactatgcaatggcactgcttcagagagggagcttatattgtgttctacaaactccctgagacctaaggttccatttacactgttctggggcccagaggtgctagggctgaggcacaagcaaagcatggactgctcccactggaactgaactttaagtgagatgtgggctgagatagctggggctgaggcataagcaaggcatggacatgggatactgctgtatggactgaggcatgaacaagttgtgggctactgtctctggctgaggcatgaatgtgacaccttctggcctggacagccaccaatgaaggcacctcctgccacctcctgggtggcagtaccacagtgaggccactgctgcctctcacctgagcactgtcaggtgtttggggatagccccattccttactaccatagctggcacatacatcatagaggtcccacatcatagaggtcccaaggacaagcccactgagctcagcttcactccccctatgccacagcatgcaatctgggggcctggagatttcccggcccagtctaccaatgttgacactggagcactcttcctgggggcccatggtgggcctatcaccctgccactcatgtcacacacaggcctaattattatttcaccaaccacatcacaaccactgacaacacaactgcttaccactctggaaccagcagcttgtcttgccactgctattgccatcacccatgccacaccaactgttcaggggcccaaaaacttacccactaactggctcaccactatcactatccacatccaagctagctacctgaggacccaagtactgggccatctggacccactaacactggtgtcccatgtcaccctggggcccaaggacaggcacacttggcccactgctgtcaacactggggcttgaaaattagtccacctgttgtcccagtacccagcaaacctttatcacagcctctactaataaccacaacctaaaccaccaaggaaatcacatatatcactgatactgtttacagccaaaaaacaaaccaacaaacaaattatacaaagacaacactactgcaagcaagcatacagaagcaaagccatagataaatcttcaagaaaaagttctccacaatgaaagcaaatttaaaaattggaagaagtgaatgttacattagatgcccagatattaatataaggacccaggaaacattaacaagcaagaaaatatgaaacctccaaagggaaaaatgataattctccagccaaaaatttcaaccaaaagcaaatttaagaaatcccagaaaaagaattcaaatattgatttttcagaagcccatgaaatacaagataattctgaaaaacaacacaaagaaataaaaaagccaatttaagatataaatgagaaatttaccaaagagataaatatcatagcagaaaaccaaacagaaattctggaactgaagaattcattgaatgaaatacaaaacacatttgaaagtctcaacaatagactatatcaagtagaaaagaaaatcttaaaatttgaagacagtcttttgaaataacatagacaaaaataaagaaaaatggaagaagaatgagccaatcctacatgacacatgggacaccccataaaggcaccaaatatttgaatttttgaagtcccagaaggcaaagagaaaatgagaagtttagaaaacctatttcaccagataatagatgaaaacttcccaagtctaacaagatacaggagcctcaaagatccccagatacaatacaaaaaggtcttctccatggcacagtatagttaaagtcaaagacagagaatactaaagacagcaagagataagcatctagtctagtcatctataaagaaactccctttagactaacagtgaacctctcagcagaaacattataggctaagagaaaatgaaataatatattcaaagtgctgaaagaaaaaaactgccagccaagattattatacctagcaaaattatccctcataaatgaagaagaaataaagtgttttccagataagaaattgctgagggaatttttcactactatacccattctaaaagaaatgttaaagggagttgtacacctggaagcaaaagaatagtacctactatcatgaaaacacaaggaaacataaaaaccactggtagagcaaacacatgaacaagaaagagaaaagaataaaatgtcaccactacagaggactattaaactatgataagaaacaataaaagaaaaataaggaaataatacacaaaaccaccaaaaattacatgataagaataaactctcacatgtcagtaactttgaatgtaaatggattaaaccttcaacgtaaaaatattaattcactaaatggatttttaaaaaatgatctaaccatatactgcaaatgagaaacttcccttaccagggaagacgcacatagattgaaggtaaagggacaaaagaagataggttatcaaatccatatgcactatgcacaagagcaaagatatggaataaacctaagtgtccataaatggatgaatagataaagaaaatatggtgtatatgtacataatggagtactattcagccttacaaaacaagaaaatcatgtcattgcagcaacatgaatggaactggaggtcaataagttacgtgaaataaactaggcacagaaagaacaataccacatgttttcactcatatgtgggaactaaaaaattgatcttatgaagatagagaatagagtgatagacactggaggctggagaagtgtttgggtggcaaggggcaatgaagagagattgattaatgggtataaacacatcgttaaataaaaaaatatgttttactgtttgacagcaactaggatgattatagttatcaatgatgccttttatatttcaacatagctagaatagagaacttgaaatgttatcgacccatctaaataataaatagttaagatgattgatattacaaatacacttacttgatcattatgtattctgtgtatgtaaaaaaaaactcacatgaatcccataaatatgcataatatatgtattaataaatgaaaaactaaaaatttttaaagaatgaaattatatcactgacaacaaaatgaatgtaattggaggtcattgtggtaagtgacataagccaggcagagaaagacaaatatcacattttcattcacatgtgggagctaaaaatgttgttctcatgaaggtggagagtagaatgatggtactggagataggaagtctttgggagaatcaaaagaggttggttactcttataaagaaacagttaaatagaaagaataagtactagtgttcaatagcacaataaggtgactatagttaacaataatttattgaatatttcaaaatagctagaagaaaagatttgaaatttttctaacacaagtcataaatgtttgaggtgatttatatactaattatctttattttatcattatacattgcattcatgtatcaaaatatcacatgtaccccataaaatatgtatgattattatgtatcaatgatttttttaaagaaataaagagatgggggcatccaggtgggtcttgttccatggtcttgggcagaaactgattaccttgtaaagatatctacttgttctgaggttgttaaagtatctgtctttctgtagcctttgtctgctttggaaaactcccagcagagcctcagtggaggtttccagttcgaatatttttccagtttgaattgctcttgtatttctttagtttttaagcataaatctaaggttaaacaccctgtaatttggtacctgcgttagcccaaataaaacagcataacgtccttttcttctgaactcaagaatagttttcctaaagtggcatttccagaataccagattgcttgcttgtaaattgagtaattgttgatgaggaagctctaaaatgaagacagttctgacttgttgattatagaatttagcatattttattaacccttgacagcatctaaaaatgtcagatagagttaggttaaagtcctccactagccaagataaataatcctcatgggatttcccatgataattccaaaagtgacgatcttatgattcatgtttatggtaagtccaattccttagctagtttagtctgtttggtcttgagaatcccattggatctttctgtgtctcctgatgactgagcatggtaggggcagtggagtctttgagtactgtgtgttgtgttttctatttcctatataattctaccaataaaatgttagcttagagttggtagaattggtagagagtatacctaaagttgggaagacttattacagaaaaactttggcaactgatgttcctggggcattttagcaagaaaaatgtttagctatttaaaacacatgcaggctagagtgagtacatattgctttctgtctcagtccatttgcattgatatgcaggaatatctgtggctgagtgatttataaagaaaataggttttggaggtttttttctggagatggtagactagaagtttttccaacatgcctcactcatttagaagaagcaaaaccctttgtagagatctgcactttgaacttttatccaggaagaaacacagaagagcaaaataaaacttctgagactggtatagagaagatgagcagatagcttgtgcagccaggtctggctgaaaatggtgaatgcccattatgggggagggaggatgaatgtctctctgtgatccaacttccaaccagggaatcatgcaattcagttcacaagagagcatcttgatcctcccaagccttggatctaacgtagaaagcagccaacagactgagaaagaacaactccagggaagtgtctcactcacttttccaggtctgagggctgattgttggatgcccttcttgatcccagctcatagcaagttgtgcaggattcttcaggctaacaatggtggtagccattggcatgagagagacttgggtcaaagattagagagctaggacttgaggtgggaggggctcccacagctagaactgagaaatgagtgtagtatggacatcagctgcttgtgtgagaaccagtatccccttttcacagaattgaagcaggaggaacttgctggggaggcatggtcttaacccaggcagtgagttctgtggcccagagcagctttgcagagtgaaagcaaactcccatgactaaatgtcccaacttgctgccatggttgtagcaggggattaaaccttgaagggtctgcggcaagagaggcaagtaggtccaattcctacttgttaggatgtggtgccaggatctccatcccccatgtgacacatcagtgcagtagcagtcactctgctctttgcctagacatttcttcaggaagcctgaggactgtctcccaatcactatcagggccagtacttgtaactgccaatgggggactcaagtgcaggcttccagtattagtccattcttgcattgctataaagaactacctgagacttggtaatttatgaagaagagatttaattgctgacagttctgcaggctgtacaggtagcatggctggggaggcctcaagaaactttcaatcatgtcagaaggcaaaaggggaagtggccaaggactcctgagccacttgaagcagcctgctactggcctcagcccagtcccctggcccaggccttggtcagcaaaagcgaggatatgggaagcagcacagacagggagttggtggaccacctgaaggtcctctggaacaaaaccaaacacaacatgaagttcccttcggacagcacaagctccaagctaaaagagaaaattcacttgattacaggtcttccacctgccatgcagaaagtcatgtgtaagggactggtccccaagtacaagatattgagaatagaacattgagtataagacccattgagagaaataaaagtgacccgtagggccaagatcatggtggttggctccacaatgcagtgtttaagcagtaaacccacccaaagatactacacagcaggatgcaaatgccaaaaagaacgagaaggagcctctctgcaggcagaaacaacacagataagtgttaaataaaggagaacctgaagatatgatctgttaggtgtgcccaggaacccttccaacactacccctgtctggcaagtacaattagtctgggggaaaagtgagacttcacttaagctagaacaaggccagatcagcactaaagattcctggacagaagcaaacacgcctaattcaccggtttctggccagcactgtaggtattcagagttcaagggcagattgagaaagtgcccacgggcttcattaaaaatgtggtcagcgaaactagggtcatgaatactacaacatggtgatatttcagtagggtcccacaggaggctcttactgctggattccaactcaacatgttgatgcaatcaaaaacactgtgctgggaaaatgacagtgtttttgaaaacactttcactgctggctcaggagactgaccaaagtgaaggatattgccagaaaacatctgcagcgtccctggatatcagagctctggaactttgttcaaaaaaaaatatccatattcaatctaagatgatgtgatgactgcagccagtggtgatgtacttacaccatcagcttaattttatcttgaaatcaccagttccctttcttgctgactgccaatctgactgcttaataccattttaaaagtcaacataacagaaatcaataaatctgaattctgagaaaaagtttaaatataaattaagtttgacgaagcgtgatattcaagagatatattgatcagtgacggcttatagggcctggcaagtcccatcgtgccttctgaggtaggagccatcaacacaaacttgaacaagggggctttctgataaacttagcctagaataaggtaatgatctagggttagtgacataattgtgaggtttctcatcagttggtaaaggaagcaagtggcaaggttaaggttttaaaagtgatgtacagtgatgtgggagggggagaattttaaagtttcataagagatcagtagagatgcagaaaagtgttgtgctttattaataataggatcttggacaaatttggtggttgtggccatggcttgcaggcaacaaggatataccttagctaatgggtctaaggctagactataataccctagatatctctggtgtccattatgcttttgaggtaacgctcaaaggacatgttcttcccattcatgcaaaaacaagtaaaagggcagggagtaattgggaagtctaagagtgagaggtgaaagtagagtccttaaagttttccaaagaatctgattacagggtcccaggctactgggtttggggataaatccctcatcactagtcataaagagtgaggcagtcatacagaaattaggtatttactttacaatatgccacaagaccccccaacattttctatcgtcattttgtttcagggagataaaagtgattagcaggagagactcagcctgatgattttacttgaagatgaaatatcatgacctggatatttaacacacaggcacggtgactcatgcctgtaatcccagcattttgggacgctgggacgggcagattgtttgatgtcaggagtttgagaccagcctgacaaacatggcaaaaccctgtcgctactaaaaatacaaaaaattaggcgggcatggtggtgcgtacctgtagttccaccttctagggaggctgaggcaggagaatcacttgaaccagggaggcagaggttgcaatgagccgagatcatgccactgcactccagcctgggtgacaaaataagactttgtctcaaaaaagaaacaaactatatgtatatacacatatatatttatatacatatatatttatatatatatgtgtatatatatattacaaaatataaaacaaaaacagtgagcataattgaattttttctctagccactttttgacctttgttttgctaaagcctaaagatggtatttctccttgtggtttagtggtagccgaaggcactggacatttacttccctggaagagagggaacaatctttgatgtggagggtactcagttgttgttgtttttttcttgaggtctgcaggatcccaggcacagatattgttttccatataatatcagcaagtgtctaaatcaataggagccagtgattttggagcttcctgtgagtttaaattctcaggttgttttaactgtttcatttgcgatgccataagcttgtggcgtgtggtttccaatctttctgaaatactatttacctaatgctagactaatgtgtggaactcagttatgttttaattttgccggttaatataatttttctttaatgcatcatggatctccagtctgagaccatttacaaagctggtgggcagagcagtaactgtcaagtaagtcagttccagctttaagtgttcttcccatgttatctatagttgatgacgatagcaagtttcatcctttagttgcttacaattttggatatgtaagcaatcaattttggtgggatagacttgagagatggctcctagtaatttttctcttatttgcctcattctctgatgaaaatcagtgatagtccaatatccttgaaggtcttcagagatggtggtccatttggctttttcaaaccaaagggaggcatctccaggtccaaccagtaggtagataagttgtgataagtgaaggaatcttagagagtgtcccctgagaaatattctaaattgtttaataaatctttccctttccttctggggtcagaaagtccttagcgatggcatataatttgaatcaagacctatgtttaaatgtaatttcttctgttaaccttgcttgagaatgtgtaccagcctcacccttattatcagcaagagatggaagcccagtgaaccttatgattacagagaattcaggggctggcgatgcagctggtgagggacattctgggagaaattgatacaaaagaaagctgaagggggagggtggaagagttgtggaggctctaggaagtttatcagcttggaaatttttttctggagacgttgtctaataacttcagtagtttgagtaagatttgaatgatttagccattttttgccttcttcataccaggcaaaataagtaggccaatgtgcatctgaaatttgtgttttgttttgctctaggactccctttcaggtggactaatttgaagagatctcaggagcaccaaaagagccactgttgctcaggaaagttttcagtaaagttttgtccacgggaaagaaagcaaacagtatttagaccatagtggctgactatatagtcagcagaggttttaaacgaggggttttcagctgaccgagtagttctcatgggagaagcaggatccaatagagaaaagagaaagactagagaggcctcacagagagccaggaagaaagacattcagcctaggaaagcagggaataataattcccactctgaacaaggaggcaggaagcccttccagactaggaggcacctttcaaaagaagcccgagactctaacccagcttcagagagtatactcaaaatcttaataattgaaatttgtcctcaccatgcatcagtggacatttatctggagcaatggattttggagttgggctcaccatcgagtacctgaatgagtaagcagacagtctggagacaagggtcctgctgtgtgctgagaggtcctgttgctacatctgagaatccagtggtagttctgatccagatctgcatctcagcaccaaaaactgtcaaagaaaagcagccaggcaagtaaagtggtgaagacaaattttattcgggactattacagtagggagagagagaccctagtatagaactgggctccaatatggcaaggacaagtggggatttgtagccaaggaacagggggtttcatggatggaaaattactaagaagacatatcaagtatatggataattctggctgaataaaccaacctaccaggattcctgctgagggcaggccaaggtgatcagatatcaggggtaaggagtgaaacaatttgatcagatatcaaaggtgatcaggtattgagagtgggggattcttgtgaactgtcttagcagcattattttctataactggattttacaaaaaagtgcacagatgggcctagaagaaggcttagaagtggcctaaagtttggccaaccaaagagtctttgtcactggactttccgtatatattacctaccaattagctaggcattattttttatgcttttcctcaataaaagtctcatactttgaaacatttagtgacttatcagaggcatctattttactatttagcatatctattaagctttttactcaactacattttaatttctaaaaaaacacttttaaaaattaaggtacagaaagattttacaatttgtccgcagaaatacaaaggtggagctcaggaatcaaacccaggctgcttgcctccagaattttgatgcttaaccactaagtcacagtatacataacattaaaaagtgtagcatgagaagaaaacttttccagaagttaacctgtgaaatgggcaggcagatagcacagaaattcaagagagagatggatcaataacattttcccttgaatttatttagaaaaaattaaaacctactgaaaagcccagagaattatacaattaatacccatttttggtttttcaaccaactaaacatttaaacaattgttaaatagttgttaacagctggacacttttaacaactcaccacatttgcctatctacaaatatgtatgtacatacatataatacatgtatacatatatatgtacacgtaatacatatatagttaatatcaggacactttatcaataaataatgtatatctcaaaagaacaaagacattttctacatagtcatcatatcagtattatcccaaagaaatgtaacatcactaatatgtattttacatttgaattttccccaataatcccaaaattgttccctatagcagtttatcttttaattaaacattcaattactggtcactatttgcttttagttattataatattttagtccccttcgatctagagaattatcttacctattttttcccttcaatggcatttaagttttcaagtattttggtcagatatattataaaatatcctgcaatgtatatttttctgatgtttcctcataatttgattcattcaagttaaataattatggctatataggcatgctgtattttcccttttgcatcacaggagattcataacatcagtttttcttcttactggatgctaagtttgataactttggtcaaggcagtgtccatcagatcttttcatgaaaagataacttatttccttactaattaaaatctaatttgtagggtttgatgcattgatattgtgtgaatttactgttctcaataattttttataaatgatgttagcacccattgaaaattcttgcatgaatcaaaatattacctttgaggatataaaaattgagaaatgtttccagttgctatctggattcattctaaaaagtagaactttatctccaagcctttttcaataaataaacagcctcagatttatagaaaattacaaagataatacagagttcccatatatcacacagctgttacccattttattagcatcttaattagtatggtatatgttttatagttcatgaaccaacattgatccattgttatgaactaaagtccatgttttattgctcagatttccatagtttacacctaatgttgttcttctgttccaggatcctatctaagatccacattatatttattcatgtgtctttttagcctctcttggctgtgacagtttctctgccactcctcatttttgatcaccttgcaagttctgaggagtactagtcaggcattttatagaatgtcacttaactggaatttctctgatatttttctcatagttagactagagttatgggtttaggggataaagactatgaacaaactgccattcttatcatattgtatcaatggtaaatattattgtcatgactcataactcttgatgttgactatgaccacctggctaaggcagtatttgccagttttctctaccataaactcaactgattctcccctttccaacttgtactttttggaatgaagtcactacaaacaaaacacacttaaggaatggagagtttatacatcaactctttgaaggcaaaatatttacataaatcagttgaaattcttgtacagaatatttgtttattcaacctatttgtttacttattcaatcatttattgacattagtattgatgcacaatatttattctataacttgagcatatccaaatattacttccttaattttgttgatcaaatcatgtaatctttggctactggaagctgtttccattggttcctgcatccctgtccatatacacgtcattgtgtatatattgggttgtatttttgtttgtttgtttgctttgggcttttcttaaaaaaggctctctttacttttgtcaggtaaaaactgaagttcagtcacttaacataggataaaaaaataagtccagttatactggtaacaaaaggacaacatgttttcttcaaaatcactgtgtctgatttgtctctgtgcttggtcctggtcatctggtatgtttttcccaggaattctgtcttcaatgggatgactgtcttcagggcaaaaaaagtttatcagactctagttctagctgtacgtattttgttcatttatgtacatgtgcccctaccctgtcttgctccattttttttactgcattcttattgaaatatggattaaaatccttctcccaagttctatttatagggttggggttttttagcacctttttatttggtcattgccagatgctccagactcatactgtatatttcttgctccattgctagaatcagccaacgaactctagttccttttattgaagaatggtattagaaaccaagatctgggtaacaggtgtgttcattgcttcttctgtatcattgtttctaggccctctcagctggcagactgaagatatgtatgtgtgtgtctcttgcttcacatcctcattagcgttttgtattttaagtattattggattttgtctagtgtctttttatatgcttgtttcccatctgtgtatcttattttgttagatgcctattcctatattttggtccttttaaatttggattatttatttgcttattgttgagttttagtcattatttgtatatattgaatacaagctcttcatcaaaaatgtgtattgcaaatgtcatctctaagtctgcagcttgtcttttcatactcttcaaagtgtctttctcatagcagaagtttttattttactataacaaacatcaatgttttcttttatagattatgcttttggcattgtatctaaaactcataatcacaccaaagattacctaaattttctcctatctttcttctggaagcttatagttttagttttacatttagatctatgatccattttgacttaatgtttgtgaattacgtatgatgtatatctagctttatagtttttgtatatggatgtccaattgttccagcaccatttgttgaaagccatctttattcaatagattgcctttgctcctctgtcagagatcaactgacaacatttgtgtgagtcaattctgagctgtctatgctgttcccttgaattctgtgtttattctttcagaaatactatgttatcttgatcactgccgctacatagtgaatcttgaaatcagtagtgtgatttccttcaactttgttcttcttcagtgttgtgttggctatacttgcctttttttttttttttttttttttttttgagacggaatctcgctctgtcgcccaggctggagtgcagtggcccgatctcggctcactgcaagctccacctcccgggttcacgccattctcctgcctcagcctctccgagtagctgggactacaggcgcccgccaccaagcccggctaattttttgtatttttagtaaagattggggtttcaccgtggtctccatctcctgacctcgtgatccacccgcctcggcctcccaaagtgctgggattacacgcgtgagccaccgcgcccggccggctatacctgtcttttatctttcattataagctttagcattagtttgtcaattatgaataatgctgctctgaatatttgcatacaactttgcatatggacatatcttttcatttctcttaggtattaaggtaggagtgttattgctgggttttatggtaactctgtgtttagctttttgaggaataacttgactgtgtttcaaagtagctgaaccattttacattcccaagagtaatgcatgagggttccaattttgccacatcctcgccaagacttgctattttctgtctttttattatagttattatatttcatgtgaagtggtgtcacactgggttttgatttgcatttccttgatgtttaataatgctgagcatcttccatgtactatttgaaatttgtataacttctttggagaaataattattcagatcctttgccaatttttaaacagggtaatttgaggtttgattattgagtgataaaagttctttatatattctagataaaactctcttctcataaatgtgattttcatatatcttctccaaatctagttctgtcctttgctttcttgctggtatcctctgaagcaaaaatactcctaattttgatgaaatctcacttatttttgatattttgcctgtgcttttggtgtcatatttaagaaactgtggcataacacaatgtcacaatatttatacttatttttattagagcttatagttttatctattacatttaggtatttgagccatttgagctaatttttgtgtatgttgtgaaataggggttcaattccattcttttgtatgtgaataaccatattttctcctgggaaaatttctgagactacactcccaagcttggcggtgggaacagtggcctccttctctgtgagtgacatccctgctttaggagtaggcattgggtgtggaccatagcctcttattttctaagcttggcttcccagtgtggaacctctgccttaccaatgagggggggcaaaagtgattgttgtttctgcattgatgtcatgccatgcctaaggtatagcttctaccctatgaatgggtagcagaaggaattccccaaacttttgctcacacttacctgaaatttagcttctgtaacacatacaaagagatatatggaactaagtaaaaagtacaaaaataaacccaaacttctttaaaaattatcaatatggtaaagatctaattcaaatgatggtgttgggccaactaggctgtcattaaacaatatagttagatccttacttgtggcaggtcaggtttccattagcaaccaggcggttagtttccattaccctttactataattttgatgagtggataagttaaataaagaactggagaaactggtgcctgagtatgaggatgggaatatgaaaacaaacccattaagatcccacctgggttttctcagaccctaaagtgtgattgaatagtaatagcattcctacacatacacctggttctgtcttaagattaagaaactaagactctaaagaaagctttccagaccccagaccccctagttaaagattagacatagattgaatgaaactcttctgcttgtaggtgcaatcctgcacatagcatggagcttaaaatgtatgtaagtatcagaaaaaaacttgtaactttgagatggtctggtgagttactctgaccttctccctgtaactggttgcagaaataaactcccatctttcctagtttgtctgcgtcttcttattagagctcgagaacaagcagctggaccttcctctgtcagggaacatactcacattttacaccaacatatattttatgtaaactaaaaatgtaagactcaaaattaaatacaaatcaaagaaataatcttagggaaaaagaggactttattaatgccagagccagaagtcataaatagaaataattaatgtatatgattctcttaaacactcgctgtttaccctcaatctatttctcagcttccccttctatttctcggcttcccccggtcagttttgtatcgcaatcaaattgcctttgtatgctatatttcccagaatttctttcaaatgacttctggctagattttcccagtggcagacactaataagaaattggagagtggaggatataagccacaatatttcttcactctttgtctgctataggcagtgtctctagcacttagctgtatccccagagagattccagcttctgcagaataacctctcctatggacagaattctgagttctgttaacaccagtccttccagtaggagcttatcacaggttaccttgtttgaatttttacttttcacaccctttgtaattatttcctgaattgcattttctctatttaaatcgttggcaagggctccgttttcctgagtataccctgatacagtgacaatgtaaaactttaaaacttctatatgtaaaaacaaacaaacaaacaaacaaaaaaaacagttagacaaataatattataagaaaaatattcaggacatttatgggagaaagggaaatattaacacctttgatgtataagaggctcttaacacatcatgatgaaaaaggcaaacatttgaataaaaggaaagatcaatagacatttatcaaagaagaaatacaaatggcaaacaagttttggggttctatctattttaatttcctgaagcaaggaaaaagaagaaatatcagtgtggcaaaaactaaaaaggatgatgttagtcagtttgttggtggtgtaatagagcagagacttttcccagattaactcaatctttctggagagcacttgagcaaagtagatcaaaagcctttacaatgttcataccctttgatgcaaatatttcatttctattagactagagattcaggatatatttaatggatattaattagtagcttatttataatagaaaaattgaattaagccacatacccattaaaagggaatgaatttaaaatagtggtacatattgattatgcttaattatataatttttgcttgctgataaggacagatttctctaatatgttaagttaaaacactctttccaatatgattccaagtttctaaagcaataggagaaataattctgaaaagatatcaattaaaatgtcaataatacttatttttagttagccaccaagtgtgtatatttcatagatttttaagttttttttaatatatttctggctgtgttttcttttgtttcatttttcctatgcatggtgtataaaagttacaattttatgataaaaacttttcattttgaaaaaatgtaaatacataaggaactggtaaatactggctttctttcttctgtccgtaaagctaccttcacctactgttttgaatgccagtgtcagagtgacatgtccagacagatcaggcagcttgattcagcatccagtcctctggtttgaaagccagcttgagtcaatgtgatggaatcagtgtcttgctcatttcttaaaagaggggctggactgtttctcccaaacaccgtgggtacgaaatggccaatcatagccgtcccactttatcctctatagatgtgctttgatcctgggctcaattagagcttcagcaagactctacagcggtgagtaataaaatcaagcaacaggttataaccagcacaggaacttccagatacacctacacaagaggaagtgagactaggtaggagaacaaaagggagaatagaagtggagagcagctgtaagtagagagggatgtagagaaggtggagaaatgggaggtagtagggataaacatagagatgggaagagggaaaatggaaaagaaggtgaggcagaagaaaaggatatataaaatgaagaaaagtgctgtacattagaggatatcaacaactaaggtgattatattacacaggtggataaataacaattcatcgatacacagaagatttttatactatatcccaagtgtattatatcttaatttttaaaaatacataaagcctcagctgtaaactcagggtatgatggctgaaaatgccttggtaattaaagagttgagtcagagagaatccattcctgctaattggaagcaaagtaaaaacaaataaataaaaaaacaaataaataagaaaacaaaaaaaaagaaaagaaaaactatggcttcttccaaaaacaatatcacatggaaatcccttttcagtctttcacctcagggttggatgttatcatcaccatcaagtttatgaatataaataactttatatttatatttgtatattaatataatatattgatattgctattttatatcgatataaatataaataaaagattctaatacagagtaccaaaatacattaaacagcccagtttataggtgcttctttctgtttttgttttttatttttactccagactagaaaaaaaattgaagattttcttgggtactgctcttggaaaagaaattaagctcactgagaattattaaatctgtgtatgacttggttaattttaactttaactggttagctggggagatttgcctaaattaataatattcagtgaaagttttagtaaacctgaatgtcctcactggagactttattaaaagtttggcccctcagagattggaaattggacaagttccataactgtaaggaggttgtgtttcatttgtaagcaatgcacaatggatgtaattaggaactagacagggatttctggtaaagatacattagtgagacagaatgagaagagcatttgaattgagtcatccctttgggccagagacatcattagccagcagagctgaagtttactctttgaggatcacatttttattatatgaaacagagaaccctagaaaatctctccagaaagctgatttttttaaaataatttattttattttaaaaaaaaaccctacaacaatctaacctcagacaaatcaccctagtgccctgtctccaacgtaatctatatcaaatgtttatttcgtaaagtatctctacactcttcagcgttaaaatggtatagcccctttagtgaaggaccttgaattggttttggcctgaattccttttagcaccatcacactgtaataatttagtcaataactattccttgctcttcttctcttatataatgttgtgagggctttcaactacaaaagcactcagtaacaaccataatggctcctcttacagagaacttaagatttttacaaatctcatttaataaaactcccacaacaaaaccccaaagtttcactttcaaagagataacatgacagttgagtaagtaagggttgaataagaaaatataaaaaaacagtgctggtgagtgtgttgtccagtccaatcttactttgagtttctccaaaagcagactttgagaaaaggataggggtgcaagtagtttatgtggttagtaattcaagatgcataatgagcatgaagaagtgagatagaggaaggaggaaagcccattaatgcattaataagtaggttatatctataagaaatcagggaccttctgaaagacttaaaaacacacatcaacatttttcaccatgcagtgagaaagtcaaagtcaaagtacatatccactgaccacccccgcctccccttttttttggaacagagtctcactctgttgcccaggctggagtgcagtggctgtaatcttggctcactgcaacctgcacctcccgggttcatgcgattcccctgcctcagcctcctgagtacctgggaccacagatgtgcgccaccaggccagactagttttgtgtatttttagtagagacggggttctgctgtgttggccaggctgttctgaaactcctgacctcgggtattccccctgcctcagcctcccaaagtgctgggattacaggtgtgagccactgcgcccagccccagcccccatttttattggttgagggtcattccctcagtgttaaatttctgatgatgtcatcctggccctttccaaagcgaagtgaaattgcatggccagagtaaactaaagagcttctgcatggcaaaagaaactaacatgagtgaacagacaccctacagaacgggagaaaatttttgcaatctacccatctgacaaagggctaatatccaaaatctacaaggaacttaaacaaatttacaagaaaaaacaaacaaccccatcaaaaagtaggcaaaagattgaacagacacttcccaaaataagacatttatgcagccaaaaaacatatgaaaaaagctcaacaccactgatcattagagaaatggacatcaaaaccataatagataccatctcccaccagtcagaatagggattattaaaaagtcaagaaacattagatgctagtgaggctgtggagaaatagaaccgcttttactctgttggtgggaatgtaaattagttcaaccattgtggaagactgtgtggcaattccttaaggatatagaaccagaaataccatttgacccagcaatcccgttactgggtatataaccaaagaaatataaatcattctactataaagacacattcacatgtatgtttattgcagcactattcacaatagcaaagacatggaaaccaacccaaatgtccatcaataatagactggataaagaaaatgtggtacatatacaccatggaatactatgcagccataaaaaggaacaagaccatgtcctttgcacggacatggatgaagctggaagccatcatcctcagcaaactaacacaggaacagaaaaccaaacactgcatgttctcactcataagtgggagttgaacaatgagaacacatggtcacagggaggggaacaacacacactggggcctgttagggagtggggggtgggggatgaggtgagggaacctagatgatgggttaccaggtgcagcaaaccaccagggcacaaatgtacctgcaagttctgcctggaactttaaaaaaaaaaaaggcacgaaaagccttagtcaatttgtacaggaacagtgtgcgtgtgacccacagagtaggtccggggcaaagggcagggcaactgtgtctatcataggacctaaaaagtggcacaaaattctaacccagataaccgagaaaaacactaaagatcaatttgacatcaggcagattctagaaggaaatgagtaacaaacaggctaggtaggttggcaaaggcaagaagaggaagcaggaaagcctgtggcctagttgggtagctcacaagtttggctgttgtagaaaagtgtctataaacaaggggcccatataggcagatatcttcagaaggtatgaatatataaaatattttggtttcctagtacgtataaaagttatgtttacactgtactatagtctactgattgtgcaataacattatgtcaaaaaataatgtatatatcttaaagaataatttattgctaaaaaatgctaaccatcatctgagaccagcgaatagtgatcttttgttggtggagggttttgccttcatgttgacggcttcggccatcaactgatcaggatggtgtttgctgaaggctggagtggctgtggcaatttcttttaaaaagacaaaaataaagcctgccacattgactgaaccctcctttcacaaaaggtttctctgtagcatgtgatactgtttgagagcattttacccacagtagaactcctttcaaaattagaatcaaacctctcaaaccctgccgctgctttaacaacttagtttatgtaatattctaaatcctttgttgtcatttcaacaatgttcacagcatcttcaccaggagtagattttatctcaaaaaacaatttctttactcattcataagaaacagctcttctgttcaagttttaccacagtattgcagcaatgcagtcacatcttcaagctccacttctaattttaggtctcgttatttcattatttctgccacgtttgcagtttcttaatccactgaagtacgaagcttttcaaaatcatccatggaatctgcttcttccgaactcctgttatttttgatattttgccctcctcccaccaatcatatgttcctaatggcatttagaattataaattctttccagaaagtttaatttaattttctcagatccatccaaagaatcactaattatggcacctattaccttatgaaatatatttcttatataataagactagaaagtcaaaattactacttgattcacaggctgcagaatggatgttgtgttaccagatatgaaaacaacattaatctccttatacatctctatcaaagatctagggtgaacaggcatattgtcaatgagcaataatatttcgaaataaattgggtgtttttttttgagcaataggtctcaacaatgggcttacaatattgagtaaaccatgctgtaaataggtgtgctgtcacctcagttttgttgttttatttctccatataagcagtaaggctgttttgctcatcatttgtgtgttcactagagaaaaacttttaatttcttttgcatttgcagcttggctaactgacacaagaggcgtagccttcttcctatctcagcttttgacatgacttcctcagtaagcttaatcatttctagtttacaatttaaagtgagagatgtgtgactcttttacttgatcacttaagagtccatcatggggttattagttggcctaatttcaatatttttttggctcagggaatagagaggcccaagaaaagagagagagaaatgagagaacagctgatcagtggaatagtcagaacacacacaacatttattaattgtctgttgtcttataagagtgcagtttgtagcatccaaaacaattacaatagtaacatcaaagatcactgatcacagactatcataacagagtgaataataatgaaaagttttgcaatattgtgacacttacaaaaccatgatatagagacagaaagtgagcacatgttgttggaaagatggtatggatagacttgtttgacacagggttgtcacaaatcttcaatttgtaaaaaaaacaatatctgcgaagtataataaagtgaaatgcaataaaatgtgatatacctatgtataaaatggatgtaagcaagacaaagaaccatcacatgcggcagtattgtaatagtgcagtaatgagacaataaagaaatgattctcggccgggcgcagtggctcacgcctgtaatcccagcactttgggaggccgaagcgggcggatcacgaggtcaggagatcgagaccatcctggctaacatggtgaaaccccgtctctactaaaaaaatacaaaaaaaaattagccgggcgtggtggcgggcgcctgtagtcccagctactggggaggctgaggcaggagaatgacctgaacccgggaggcggagcttgcagtgagccgagatcgcaccactgcactccagccttggcgacagagcgagactccgtctcaaaaaaaaaaaaaaaaaaaaaaaagaaaagaaatgattctcaaacatgtttgtgttttttataatacactttaaatattagctattttagcaccattatctaaaacacgaagacacaagagcattaaataagacatcaataattccaacaaaattactactatagtataacattttataatgtctataaaagtatccatgattaatgaaatcttttctttgttgtccctcatactgtttctgtcttaacagaactgctcactgatatgaccaagctctcttatgtatttatgagacagaattttaatatttttggtaccagttcaatgttatggtactgaacaatgtttgttatggtattttacagccctgaattacatgagatgagaatcacaggatacagacctgaacaacaacacaagtgactagaatgagagacgtttattagggaagaatccatggaacttgatgacaacttgataataagttggatacagggagtgaggataatggcagtgccatagatgatagtatggagcctggagaagttgaatgtcttcccattggtcttagtatacacttgggagtcttgagccttgactataaaaccctatgatagctgaccctgactcctgttctagccccatttgctgctactgttcccataattcacactgacttctcagttcccagaacgcactaagctacttcccaactcaaagcctccaaatgctatcttcacactatttaatccagttgtcatgatttatttaatgtgtctctctcccccacgagatgataagcccaatgagggaagagtccatgcttgacctgctcactgcctatcccaagagagtagcacaatgcatggcacgtagcaagcagctgatgctctttgttgaataaacagattctacaacctggaatgctgtttctctctctgctttccttgctatctggttcactacaaagtacaccccagcttcaccttatgtgagcatcctcagggatgccctttctgactcatctcttatattctgtgacagactagtcaggaagaaaatttcttttattggacaaagtaatttccctttcaagcatggtgaatttgaggcaataattagatattatgggactatcccacatatccaacatgattaggactgcaaatgaagatttgagaaccagctgcatccagctatgagttaatgttttctaacagagaagagatggtcagagataaaacaaatgcccatgttgagatggaaagaaaccattttaataatgaaagaatgtttaagctgttcagtattttagagaggaaaagataaaaagttctggaaggatcatttgacttgatgaataggtcactacagggtccagtttttgcaaaatgatgggaacaaaagttgggttgcagattgttaataagagcagcatgtatagactcttttttaagaagtttaatgttaaaaattgagagaaatgagtcatgaactaaagaattgacagttcagtcaattaaggttttccaaaatatggcagaactacgcagtttcaggggaaaaaatacctattacagcggcgaaggctgaagtcagttgaactttttgaccactcacttcttctaggatatactatctccttgatttttaccacactacactatctctcctcttctcccattttccctctttcttctctttcttttatcctccctttccactcctttccaagacaagtaagtgctgtccaactggtagcactagccatgtagctactgagtgcctaaaatgtatatagtctgaattacaatgtgctctaagtgtgatgaacccaccagatttctaaagctaggtgagataaagtaaaatatcctattaattttttacattattacatgttgaaatgacaatatttttgatatattaaattaaataaatattattaaaattaatttcacatttttattattttttaattaggttactagaacatagtaaattacatatgtagcttacattgtagttctattggacagcactgctctagattttcttatctatacattctccctaggcttcagacaccacctctaaataattgatatgcaaatacatatcttcacatgaaacacattcagacatcattgctatgcctcaaaccttctagacatcttcttttagaagtctcaggaacaggcaatgtggctcacacctgtaatcccagggctttgggaggctgaggtgggaggatcacttggggccagaagttccagatcagcctgggcaacatagtgagatccagtttcttaaaaaatattttttataattagctgagcatggtgatgtgcacctagctacttgggaggctgaggtgggaggattgcttaagcccaggagttgaaggtaaaagtgagctattatcatacctctgcaatccagcctgggcgacagaacaaaacactgtctctggaaaaaaaaaaaaaaatgtacctcatactcagcatgtgtgaaatcaaacttacttcctgctgtcctctttcttcaaacctaatcctgttccatggtccagtctatgtgagtgtcatcaacagcctcttgcataagccagaattttagacccttctttgaactcctgagctcagacaatctgcccacctcggcctcccaaagtgctgggattacaggctgagccactgcgcctggcccagattttttacaaaatgagaatctaattatgtcagccttctttatcaaaaccttccatgggttctcattgctcttagaataaagacccaaattattaatattgtttacaataccatgtattatctcttccctgttcacctctcttgcacaattttccccaactctctttgcctaactgaccctcttgcagtaccttgaacttgccatgttccctccagaaataaagcctttattatataggttctcctcacaactcactcactctacccttccctggtaacttctcttcagtctccagatttcagctcagttatcacttcttcaaggaaatctttctgttaagcaccccccgcaacccaactgtgactcaccataagtaataatggtgatggtgagaacatttagcatttatcaagcacttagtatgtaataggctcttttctagtgctttacacataataatgtagtaaatttttaaaactatcttttttagtctccatttttggaacacaattcattataatatacattattctatgagaaaattaaagctcagacaggttaagtaattttcccaagagcagctagaaagtgatagagctaagattcaaaattaggcatcctgattccagagttcatggggttaactgctacattatatgatcttttcagactaggctacacctctttattacaagttttagatctccagggatcttcataatagagaaggtgtaattccacagcatttgggtgactggttaatgtctttctcttataccttgccccaaattctttaaggggaggtgcagataccacatctacctttgtttattgcttaatcatggtgcctagaattgtggctggcataaagtagacatgtaatatatttgggggaaaggatacaaaataaatgtatgcgtatatgaaagaagaaagaacgaagggaaagaaggaaagaaaaaagtgaaagaaagtgggttccatgtctctagttatgaatttctctactgagcacagcttggtctaccacattctatcttggttcctacatttaccttaggaaatctgacttttactctgcctataataaaatcagacatcctttctggtatgtacctaatgagtttagaacttctcctgagcaattacttgattatgaatagctgattcatttaatatttatttcaggcagaaaatatcaaaattgtatcaccattgagtaatttacccatcacataattatgaataccaagttctctaatacatcctacatccagcaagactggagactacttttcattcctctaaaacttcatgggcttttatgcctctggtatattgcttgttattccatttccaacccttctttgctgagaaaatgtctatgtatctttcaaggtcaagattaaatgtcatctcccagtcttacacagatgctaagcttaattgtaggatattttgatgtgattatactattaaagatatggctacaatcttgttattaaggttggactctcccctgaagagttggccattcctagtgtcaattacacaggggaagagctaagccctaaacaacaaaaaggagtgagtctcctgcctgctcatctgtccctcagactcttggaaatggatctctggagctgagctatgccagatgactaggaaaaggcagcatctgtctttcagaggtagatgtggagatgggtaaggaggtctcactatagtgaaccataagcacaagatgagcaactcagtcatataaatcagattatcacgatcagcagctttcatactattaatatttcaacaccctgacctgtcacaattggttatgagatgtatcacaactaaagtgttactaataataaagttccatagttgaaatatgactaactttttaaaaagtaagtagagtgggccaagcgtggtggctcacacctgtaatcccagctcttagggagcccgaggcgggtggatcacgacgtcaggagatcaagaccatcctgtccaatctggtgaaaccctgtctctaccaaaaaatacaaaaattagccaggtgtggtggtgcacgcctgtagtcccagctactcggtaggctgaggcaggagaactgcttgaacccgggaaaaggaggttgcagtgagctgagatagcaccactgcacaccagcctggcgacagagcgagactccatctccaggaggaaaaaaagtaagtagagtggattccagattacttcaatgataacttcctcactgctctgcaaaacaatatgctctctttgggagaaaatgaagaagaatcagagccagctagctagctagctagctaacgggcgattgttcaaaacctggggggcacatgggagtatgtcataaagtcatgtcacctgccagcttgccagctttctaagtagggtgaaaggattaagtaagaactgttctaggccgggcgcggtggctcatgcctgtaatcccagcacattgggaggctgaggcggacagatcacgaggtcagatcaagaccatcctggccaacacggtgaaaccccttctctactaaaaaaaaaaaaatacaaaaaattagccggtgatggcaggctgtagccagtggtggtgggtgcctgtagtcccagctactcgggaggctgagggaggagaatggcgtgaacccaggaggcggagcttgcagtgagccgagatcgtgccactgcactccagcctgggtgacagagagagactccgtctcaaaataataataatagtaaataataataataaataataaaagaagaagaagaactgctcttctagttgtatattactgaattttgtttccagtggttatctcttagatctagtaaataatccttcctactcttctctgctacaggggatcatccgggccagagtgaatgtgaatggaagagcagtgccttcttgtggtcaccatggtttgggcagcagttgtgactacttccccaaggggaaaacaagtatctgggaaaaggtttgggggttataaggcccatgactcctttcacatggagatttgctctctactgcaaaattaaaagtgttattatggaaaatgaaattatttttacagaaagattttcttaactccccctggcaagttaagtcataccccatctgtcctcccatagttaggaatgtgtgatagtatagattttatcactttgcattctaattacttgtttacatgaacacttccccagtacattgagaagtcacagcaagcagggattgggcctcacactgccttgaattactatttcttatggtcactatgcttggcattggaataagaaccagcaaatatttctttttatttaatttttaagttcaggggtacatgtacaggtttgttatataggtaaacttgtgttatgggggtttgttgtacagattatttcatcacccaggtataaacctagtacccattgcttattttttctgatccttttccacctcctaccctccatccttcaccctccaatagaccccaatgtgtgttgttcccctatacatgtccatgtgttctcatcctttagctcccacttataagtgagaacatgtggtatttggttttctgttcctacatttagtttgctaaggataatggcctccaggtccatccatgtctctgcaaaggaatgatctcattttttatggctgcatagtattccatggcatatatgtaccacatttcccttatccagtctaccattcacgggaatttaggttaattccatgtttttactattgttaatagtgctacaatgaacatacgtgtgcaggttaatgatagaaaaatttatattagctcaggtatatacccagtaatgggactgctggatcaaatggtgtttctgtctcttagtctttgaggaattttcacactgtcttccacaatggttgaactaatttacactcccacgaacaatgtaaaagtgttcctttttctccacaacctctccagcatccttgttttttgactttttaataacaaccattctgactggtgtgagatggtatgtcattgtggttttgatttgcatttctctgatgatcagtgatgtttagcttattttcatatgcttgttgacctcatgtatatcttctcttgaaaagtgtctgctcatgtcctttgcccactttttaatgggtttgtttttctctcataaatttgtttaagttccttatagaagttggatattagacctttgtcagatgcatagtttgcaaatattttctcccattctgtaggttttctgttcactctattgatggtttcttttgctatgcagaagccctttagtttaattagatcccatttgtcaatttttgcttttgcttttagcacctttgtcatgaaatctttgcctgttcctatgtccagaattgtattgcccagattgtctttcaggatttttatagttttgggttttacatttaagtctttaatccaccttgagttgatttttgtatatggtttaaggaaggtgtccagcttcaatcttctgcatatggctagccagttttcccagcaccatatattgaacaaggagtcctttccccattccttgttttggtcagttttgttcaagatcagatagttgtaggtgtggccttatttctgggttctttattctgttccattggtctctatgtctgtttttgtaccagtaccatgctgttttggtcactgtagtcctatagtataatttgaagtcagatagcgtgatgcctccagctttgttatttttgcttaggattgccttgtctaattaggctcttttttggttccgtgtgaattttaaaatggtttttttctagttctgtgaagaatatcaatggcagtttaatgggaatagcattgaatctataaattgctttggacagtatggacattttaacaatattaattcttcctatccatgaaaatggattttttttgtttgtttgtgtcatctttgatttctttgagcagtgttttgtagttctctttgtggagctctttcaccttcctggttagatgtattcctagatatgttattctttttgtggcagttgtgaatgggatttggttcttggcttgactgttggtgtatagaagtgttagtgattttagcacattgattttgtatcctgagactttactgaaggtatcagcttaaagagcttttgggcgaacatgatcagaaaagaaaaccaatattcattacattcaatttgagttcttgttgttttataacaatctcagtttaaagctacttttatttcatagttttaatcttttgtggtacatagaaggcactcaatataatatttgttgattgatttctcatctatgtcatgttaacatgcaaaatgtagcatgaagaataaagcaatgagtcaaacacaaagttgttttcctgaaactcagatttaatggagtcagaaccttgacaaatttattcaagaccaactaaagaaatgtcaagctctgtaactttgcattctggcttcatctgctttagggtacttcctgtaacttctataccactgaattttcctcccaccaggccattgctagacattgtggtctagtctaaaccatagagacccagagggctctgggccagtcacccttctcttttctactttcttactgcacctagatgatctcattcagttctagcactttatatgtgctgataacctctgatctgcagccttgtcttttatattcaattgcctatttggcatccccactcaggtaactgataggtatctcaaacacaatatggataaagtagaactcatatttttacttccccacttccccaaaaagattattcctcttccaatctccttcaactcaataaatgcttcttgacccactttcttaaaaattgacacaatgttcctttttaaaatgtaatgagtgtgccatttctctgctttaaaaatctctcatttggcaggcagaataatggccacccaaagataacctcattctaatcccgggaaactgcaatgtgttgcagatggaattaagtggctaatcagctaactttaaaacaaaaaaattatccagatgggtccaaaataatactttatatgttgaagacagaagcagaagagtttaaatcaaagtgatacagtgtgagaatttttttttttttttttttacttaagccattcactttggctggaaaatgtgaaaaaaatttaaccaatcatttcagggtttgaagatggaagggggcccatgagctaaggaataagagtgactctagaatctaggaaaagataagaatgtaaatttctcaccagagcttccaaaacagaactcagccctgctaacatcttggttttagttcagtgagacatatttcagacttctaatccccagaactgtgaagtaataaatttttgttgttttaaactactgagtttgtgataatttgttagggcagcaataagaaactaatatattctcccaatatactctccctctcccaagtcttctcatttgttctaaaaataaaatacaaatttcataatctatgttacaaacccaaagagatcaagtctccaatcccatcaccaacagctgtggtctgtcttttatgggttcctcaaatatgcataggtgatttctgccttgaggaattttcactgcctctcctccataacctaccgtgtccatctgccatggctgacttcttcctactcatgtctcagcttgactgctcaccttttcctatacatgttttctaatcattgtatctaaagtaactcctaggcattctttatcacatccaccctatcttacctccagcatagcacttagtaatttctgcttttttcttcttcatgtatttatttatatatgcttgcctgctcccctcgattagaatgtaagttccatgagaacagaatctataattatgacagtaacaagtaggcaccgtatagtatttactacatgaattcgtgaataaatgatacaataagtggaagctgatttgtagttctgaatatgaggactttacataatttcaaagaaagcataaaaattttcataaatttgtaggaaaatcagagtaacaagaaatgagttacatgattcttttcactgactcctatgaatctttccactgaccctacatagtttcctgggtaggagcaatattcgtcattcttccattgttcctttggtggaggctttcccccagtaaatcctgatgagctctcctaaacaaatggacacttgaaattggtgggcaatcagttaatcagtaggtgtcatagcaccataagtgggctgggcgtggtggctcatgcctgtaatcccagcactttgggaggccaaggagggcagatcacttgaagtcaggagttcaagaccagcctgatcaacatggagaaacccccgtctctactaaaaatacaaaattagccaggcatggtggtgcatgcctgtaatcccagctactcgggaagctgaggcaggagagtcgcttgaacctgggaggcagacgttggagtgagccaagatctgccattgcactctagcctgggcaacaagagtgaaactccatcaaaaaaaaaaaagaaagaaacaaacatacaaacaaaaaaacacatcaaaatgataggagagtcctgaaagagggatggtattatgaagaaagaaggctttcatgcagctgcttctggatttggaagaaattttctaaagtttattttagtaactaaggtataaagttagcaacattatgaataaaatgtcaaaggaagattctacaaattaaatattgccattaaaaagaggtgggaaacgtgccgctttcatcttcttatcacagcaagcaatcgcctctccgaggccctcaatcctagctcagttcccactttctccatgaagccttggctgaccactgcagtgggaattttttcttcccactaaggatcttatgttcagattggtggtaaggataaatagtataaactcaaatgaataaaaattaaaacatttctgttttctttaaatcttattttaagctccaggaaacatgtgtaggatgtgcaggtttgttacataggtaaatgtgtgcccaaaacatggctcttaaaatttgtttagaaattggaatttgccttactctttaggtctcaaaggagtaaggtctgtgatgttcagaggattgcatctctcagactgtgctcttacaatttagtaggtctctgatgttcaaaggattaggtctctcaggctgtgctctgaagtcaatgccaactaaatccctttagaattatttcgaacatctgaaccattctctaccagtgacataaatattggcatcaacctctttgtaaaactattctcctaaatgatcaagaagatagagcttaattgtgagatctactttaaaaactgttatcaggcaacctactggcccctttaaaactcttaccagggaaaattcaggtgagaaagaatttaaaacttatttttgctagaaatattaatgacatgaaacgtttatttctctaagttatttaaggtttttttcttaaaactctaatttttcaatgttttaagctggttaaattatttttaaatctaaagtctattgtgtaagctttagacaaatgactatcattcatttgtatcacttctgaattcaacagaagtctaaatttatatcaagagataaaagcacacttttatagtaataacagaatacattaatgaagactttgaaacttatttgaataatgtagtttgtcctattacttataaacttgatgaaatgaattattaacctctacaatgaaatagagtttaaaatttttgtgttgggcattcctatgtattaaacaaattatataagtaaggactataatttcaaaccagtctttcaaatcccaatataattttgaggaatgttctagtttcttttttattcttagagaaataaaatatcaatgtaaaatttatttctatctgaccaatggacaactgggtgaactgaaggaaattttatattatataacttcaagctggcaagggcaaggcagttaatgaaaaagttattcaaattacataagtttcaaacgttattttaaaaatattgatcttaaaggtacatcagccaggtgcagtggctcatgcctgtaatctcagcactttgggaggctgaggcaggaggatcacttgaggtcaggagtttgagaccagcctagccaacatggtgaaaccccacctctgctaaaaatacaaaaaataaatagccaagcaggtggcgcatgcctgtaatttcatacttggtaggcagaggcaggagaatcccttgaacctgggaggtggaggttgcagtgagccaagactgtacctctgcactccagcctgggcgacacagtaagaccctgtttcaaaaaataaactttaaaaaaatatatatatacacaccaacttcaagtaatctgagatttgaaagttagtaataccttcagaaaccaaaaaggagagatcttcttatatctttccaaaatggttttcctctgttcccaaacttcggagtatagttgtggtcaatgaatatccagaaaactgtctatctagaaatatctaggagggtcagtcaacctttcaaagcaagtaggtagcataaagcaggcatccaatgactatcagttcaattaatacatgattcccaaagtaacaaagataaataaggtagattgaaacaaaatgctccccgataggtaagaactctttgtctataagtacatataatgagtagataatgaaagtttttaaaatatcccaaaattttaataaatgtgaacaccctagaatctaggaatacagtgaaaacacatgacatttgaaagagtaaaagttgacaccaaagagatattgcttccatagaggaggtgaccttaagattgcattaccacatgatgtggacatatgcctgaatagtttgagatgcaggattgccagcaaattcctattatttataactggtgatgccattatcataaaagtggagtaggcatttgctcaatgaatccattgtaacattattcacagtagaattgtgaagtgcagaaaacattagttaaattcccatgattattgtgcacttaatcaagttataaaacactgcagacctaagagcatgccattttatttacttaataaaaaatttctatcctgattattgaagcaatagccattgcagacaatttgaaagaaatggaggaaaatataaagccgaaaaataattgacctctaatttttattgcatagaaaaaactagtaatattttgatgtattgtcatgctactttttttaaccttcatatgtaagcatttatttggaaattgcaattattttgtttataaaactttctattttgttttttacataacgtatttctatctattttatcattacaataatcttcaaggtaaacagcatttttaatgattgtacgatatgccatcgtgtgaatgattcacatttatttcatcataacttactaaatggttataccaccacttttagatgttttgaatttttatgattatgaatgaaattacaatggacatcattttatgtcaatctttgtagaagagtctaattatttctttctggtcaattcattattattggccaaaggatgtgaatgtttaagagtttctttaatttattacaaattattttccagtaattgcacaaattttagataacactatatattatcatttctttttaaaaacatcttgccattttaataggcaaaataaatatagcctcatagctattttaaattatgtttctctgattagtaatgaggttataaatttttaatttgtaaaaaattatatttccttcatatttttctgttctgccattgacctattttctagtgattatttgtactgcttccttcctaaaacacaactagagaaacaatatcctatttattccagtctcccagtttttgtttgatgcttaatttttattcatgatttttgacttatataaataaatttgtcttttttttttaatttttttttattatactttaagttttagggtacatgtgcacattgtgcaggttagttacatatgtatacatgtgccatgctggtgcgctgcacccactaacgtgtcatctagcattaggtatatctcccaatgctatccctccccggtcccccgaccccaccacagtccccagagtgtgatattccccttcctgtgtccatgtgatctcattgttcaattcccacctatgagtgagaatatgcagtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctactgtgaataatgccgcagtaaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctgtgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccgtttgtcagatgtgtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaaaggtaatgcctaggttttcttctagggtttttatggttttaggtctaacgtttaaatctttaatccatcttgaattgatttttgtataagctgtaaggaagggatccagtttcagctttctacctatggctatccagttttcccagcaccatttattaaatagggaatcctttccccattgcttgtttttctcaggtttgtcaaagatcagatagttgtagatatgcagcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgggcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttttacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctatcttgtgccagttttcaaagggaatgcttccagtttttaacctttttcttgaatttttgatagcatttaaatttcatgcacacatgaataattcttaattgtatgcataaattgtattataaataacctggatggtttctagtataggcattttttctcatttcccctaatctctctgtctcctccccacttccgtccacattccttttcctccccaccccagaggggtaaaaataccttaaaaatagcctgcttccaaagcatgttatgtttaagtgtacactccagcagtattggagatagttaattactaagaatatacaactgaaaataggcatttaaattttttattgtgatagaaaatacataaaatttatcatcttagccatatttaagagtgtagttcaatagaattaaatacatttgcaatgttgtattaatacagccatcaccactactcatccagaactttatcttcccaaactgaaactctgtaaccattaagaaatagctccctgtgcccacctcccactaacaaccaccactctatattctgtctttataaatttgactactctaggtacctgtaaatggaataacagaatctttgtccttttttgactggcttacttcaattagcattatgtctccaaggttgatccatgttgtaacatgtcagaatttcttccctttttagggttgaataatgttccattatatgtatataccaccatttatttattcatcatccttggacatttggtttgcttccaccttttgactattatgaataatgctgctattaacattggcatataaaaatactcttttaaacaacattgttaatcagtacatatatattcattgaaattttggggaatgttgatactaattgctgacatttaaattatgaatcagctttacttaacccatatagagaagtgttgttctctggatctttctgtcaagacctcaaaacccatctttgtgaagataatctgatgtatttcttcctcaaaatgtgctggaaatattcacaatagcagagacatggaatcaacctaaatgcccatcaacaattgactggataaagaaaatgtggtacatacacagcatggaatactatgcagccataagaaagaatgagatcatgtcctttgtagcaacatggacagagctggaggccattatcctaagcaaactaatgaaggaacagaaaaccaggtattgcatgttctcacttatgagtgagagctaaacactgagtacacatgtacagaaagaatggaacgacagacagtggggcctacttgacagtggagggtggaaggacagagagactgaaaaactactattaggtactattaaaatggtttaaaaatgattttaaaaggtactgaaaatatgtttcatcactagccaaagaggtaattcctttatggaaattcattctccccatgaatggggcatgcaccaaagtccaggcaacatgaggaaacattgtggaagatgctctccttcctttaagccaaagagacctaaataactgtggcatattataaattagtgccttctttctccacaattttttttcagacaagtcaggaatggctgaagaaaatcataccatgaaaaatgagtttatcctcacaggatttacagatcaccctgagctgaagactctgctgtttgtggtgttctttgccatctatctgatcaccgtggtggggaatattagtttggtggcactgatatttacacaccgtcggcttcacacaccaatgtacatctttctgggaaatctggctcttgtggattcttgctgtgcctgtgctattacccccaaaatgttagagaacttcttttctgagaacaaaaggatttccctctatgaatgtgcagtacagttttattttctttgcactgtggaaactgcagactgctttcttctggcagcaatggcctatgaccgctatgtggccatatgcaacccactgcagtaccacatcatgatgtccaagaaactctgcattcagatgaccacaggggccttcatagctggaaacctgcattccatgattcatgtagggcttgtatttaggttagttttctgtggatcgaatcacatcaaccacttttactgtgatattcttcccttgtatagactctcttgtgttgatccttatatcaatgaactggttctattcatcttctcaggttcagttcaagtctttaccataggtagtgtcttaatatcttatctctatattcttcttactattttcaaaatgaaatccaaagagggaagggccaaagctttttctacctgtgcatcccactttttgtcagtttcattattctatggatctcttttcttcatgtacgttagaccaaatttgcttgaagaaggggataaagatataccagctgcaattttatttacaatagtagttcccttactaaatcctttcatttatagcctgagaaatagggaagtaataagtgtcttaagaaaaattctgatgaagaaataatctcaagaaagatggaaacaagtgacatctactatagcttaatgatttaaatgcagcaaaaacttccatgtgaaattacacaggggaaatgcataaattataagtaaaattttaatatataagaatacattcaaattaagtggcaagaggtaagggtagaatatacaaaaaagagtaaactgtggtaaatcttaattcaaaataacaaaaatgaaattctaattttgaactcattcaagtaacaatgtagtatgttgtcaagctcttggtctgtgttggcatcagggatgataagcatccaaaagaacacagcaaaactggaagttacaagttcaaaggaccattccattaagcattgataaccagataagttattttaatagcttagagcatgagcattatggttaaactgaaagagtttaagatcatatgatggtcaaccagtaaaatcacttacatccatgagcaacaaaattgtgacaagcgaattttgagaaatcaattttaatagcattatggggacattactgtagttagaaaggaagtattaggaaaacgaaggtgtcaaataatagtgaatatcagatttccaaatttaaattattactgagttaaatattaaacacagaatgtcaattttcaagtcaagctacattaagagagttttatctactcccatatctacctgcataaatataccataacacaaacttccagaaaagcagttcaaacctcatgtaggatttgaagagcttctttgttagtgagttaggtgcaatgtctctgtgctcctacttgagaggtgaggaaaggtttcaacaatagagaccactaccctgggtatattatatatagaaatgtaaaacatagtgttgttaaactgtaggtagagtttatctaatttttttttcttttcactattgcaaaacctgaagttggtattgtgggtagagtaatgatcttaatgtgatatcattttaaaaattactttccaattattcactcaacatatatttattgaaatcctgctataggtaggcattgttctgggtgttgggccatatcagttacaaaaaatgccagtttttccatcttctcgaagaatagaatattgccacaatttttattactaacttctggattaagaaggacctatgtcacataatagaaaaacatctcccttccacctcttgctctgaggacctgtctaaattcccagaaagcaattgtcaagtgctccaggttagccagccaccagaggctggcatcacaggaaaaatcaatatgctgagtctgtacagaaaaagtaataggagagcagatgaatttccaattccctaactcatcaatgcaaaaatataaccacctagtttttctttgtaacctccaagaaaatctaacctagttcattccaattatacttggacatgtgaagatcttgtttgtttcaaattaaattccatcaatttaggatttacccaacactacctacatccttccttcatcacatataggtccttgcctggtatcatggcactgagcacaggtgccagattatatatgagctctgtccaagctatgattctgtgagatgtttgagcctatttgacccgttggttatttcttcatgccaccatcacttcaggtatctacgtccatgtctactcctcaggctgcattgattttcagctaaaatgtctatttatccaacccacaaggctttgggttggctggctctctctctcttactcttcatctgctaatttctgagtaaattctcttgacctcttcccagtgggtccaggaaatgttgaaatgcatcatttttgcacttccgatgctacacaataccagtacaatgtaggattttgaaagcttacatgggtcccttttgaaggtcccttttgcacataggtcaccaaacctccctgagcaattgtcaccccactcccatgccaggacaccccctgggaattgaaaccacagaaccttttccaggcaacacgaactcttcccttcttgatgttgctttttttcccaactgactgaatccttaattctaggatgatacttagttttcacatcattacaaatgtttcccaaatgtacttttatggagtaaaattggactcaaaaatgagactctgtcttagtctattctctctgtctggaatatcaaaggtatgctcagaaataaaaaaaaagtgagggataacactgttgtatggctctggcctccttttcttatatcaaaaaatgtgaactgccctggttactgtctgaaacggcaggcatagttattgggtaagacagaattacaggcaggctttatctgagaattactggttatgggagaaaaatatctgataaaatgaatatttttaaaatctcgactcattttatggtatgcagaggaaaacagacatgtttaaaacaatattttgaaaaataaaattaaaaattataaatattttatctcatccttaatcaaagtttacttataatcacaaatgtgtacataattttttaaaaattttaaaaagagtgaatcaaatataaaggattttccttggtattatttttcagaaaattaaagtatgaaaattcaaaacaacctttatttaactttttacttcaaggaataatagtaataataataataataataataataataataataattgattttttaaaaaaacggtgacactacaggggcatcacttctttattgtacagatttttctcttttgaatttgtttatatttttctcatttgttcttttttcacattttaattgttttatgtctgcaaggacctacttgtcaatagggctttacatttcattcaagtggcaatccaacacaattttcatccacttcatgaaatcgatcacatctttctcaagatcatttcacactaaagttcaagcatgtttactgtatcagaaaatcagtgggtgagatattggaacaatggctgaagatagacactagagtgaagcatggagaaatggttaaggggaaagtaattctagaagtggttggttcacttaggaatatttgtgttctgacaattcttacttgcctagacagcattgtcacttcaggaactgacatattgaatgacatgataacgtgaatctccttgttgactcatcagttaatatcataattttacctcattatgtatacaaatattaacacttgggttaatttgtaggtatttctattttatttttatttcaataggtattgggggaacaggaggtattttgttacattgataagttctttagtggtgatttctgagattttgatgcacccatcactggagcagtgtacactgtacccaatttgtagtcttttatccttcactcccctcccacccttccacctgagccccttaagtccattgtatcatacgtatgcctttgcgtcctcatagcttagctcccacttataagtgagaacatacaatgcttggttttccattcctgagttacttcacttagaataatggtcttcaactccatttaggttgttgtgagtgccattatttgtttcctttttatggctcagtagtattcaatagtatacattttctttattcattgattgatggacatttgggctgtttccatatttttgcaattgtgaattgtgccgctataaatgtgtgtgcaagtgtcttttttatgtaatgacttcttttcctctgggtggatacacagtagggggattgctagatcaaatggtagatctacttttagttttttaaggaatctccatactgctttccatagtggttgtactagtttacaatcccaccagcagtgcataagtgttcccttttcaccacatctatgccaacatctaattttttttatttttaaattatgagcagtcttgcaggagtaaggtggtatcccagtgtggttttaatttgcatttgcctggtaattagtgatgtcaagcattttttcatatgtttgttggccatttttatatcttcttttgagaattatctattccttagcccactttaatggtattatttgtttttttcttgctgattcgtttgagttctttgtagattttggatatcagtcctttgttggatgcaaagttgttaaaattttctcccactctgtgggttgtctgtttaggctactgattatttcttttgctgtgcagaagatttttagtttaattaagtcccatctatttatctgtatttttgttgcatttgctttgggttcttggtcacgaagtctttgcctaaaccaatatctagaaggatttttctgatgttatcttctagaatcgaatttttagagtttcagatcttagatttaagtctttgatgcatcttgacttgattttcgtataaggcaagagatgaggatccagtttcaatcttctacatgtggcttgccaattaacccaacaccatttgttgaatagggtgtctttccacactttatgtttttctttgttttgtcgaagatcagttggctgtaagtatttggcattatttctgggttctccattttgttccattggtctatgtgtttattttcataccagtaccattctgttttggtgactatagccttgaagtcaggtaatgtgatgcctccaagtttgttccttttgcttagtcttgctttggttatgccagctctttcttggctccatatgaattttagcatttttttttctaattttgtgaagaatgatggtggtattttgacaggaattgcattgaatttgtagactgcttttggcagtatggtcattttcacaatattgattctatccatccatgaagacaggatgtgtttccatttatttgtgtcatctatgatttctttcagcagtgtttagcagttttgtagaggtctttcgcctccttgttaagtatattcctaagtgtttgtttgtttgttttgttttgtttttctttctgctattataaaagaggttgagttcttgatttgagtttcatcttcatcgctgtcagtgtatagcagtgctactgatttgtgtaccttaattctgtatcctgaaatattactgaattcatttatcagatctaggtactttttggaggagtctttagggttttgtaggcatatgatcacatcatcagtgaacagcagcagtttgacttcctctttactgatttggatgtccattatttatttatcttatcttattgctctggctagaacttctagtactatgttgaatagaagtggtgaaagtgggcaaccttgtcttgttccagctctcaggggaatgctttcaacttttcctcattcagtataatgttggctctgggtttgttatagatggcttttattaccttaaggcatgtctcttctatgccgattttgctgagggttttaataataaaaggatgctggattttgtcaaatgctttttctgcacctattgagatgatcatgaatttatgtttttaattttgtttatgtgatgtatcattaattgacttgcatatgtcaaacaatttctgtatcactggtataaaacccacttgattatggtggattatctttttgatatgctgttggatttggttagctagtattttgttgaggatttttgcatctatgttcatcacggatattggtctgtaattttctttttcttttttttttgttatgtcctttcctggtttgggtattaggatgacagtggctccatagaatgatttagggaggattccttctttctttatcttttggaacagttccaataagattggaggcaattcttctttgaatgtctgatgaaattcagctgtgaattcatctggtcctggactttttgttattggcaattttttaattaccattttaataacactgattctcattggtctctttggagtttctatgtcctcctagttttatttaagagggttatatatttccaggaatttatctatcacctctaggttttctagtttgtgcgtgtgaagatgttcatagtacccttgaatgatgttttgtatttctgtggtattggttgtaatatctcccatttaatttctaattagcttatttcgatctctcttcttggttaatctcactaacagtcaatcaatttcatttgtcttttcaaagaaccagctttttgtttcatttatcttttgtattttttgttattgtttcaatttcatttatttctgctctcatcttggttatttcctttcttcttctgggtttgggctttgtttgttcttgtttctctagttccttgacgtgtgaccttaaattgtctatgtgtgctctttcagactttttgatgtaggtatttaatgctatgatcagtcctcttaggatgcttttgctgaatctcagaagttttgataggttgtgtcactattattgttcagttcaaataattttttaatttccatcttcatttccttgttaacccaataatcattcagtagcaggttatttaccttccatgtacttgcatggttttaagggtaccttttggagttgatttcctattttattccactgtggtctgagagagtacttgatacaatctcaattttcttaaatttattgagacttgtgttgtggcctatcatatggtctatcttggagaatatttcatgtgccaatgaatagaatgtatatcctgcagttgttgagtggaatgcttgtaaatatctgtgaagtccatttgttctagggtatatttaagtccattttttctttgtcaactctctgccttgatgacctgtccagtgctgccagtagagtattgaagtcccccactattattatgttgtcatctatctcatttcttaggtatagtagtaattgttttataaattttggagctccagtattaggtgcataaacatctggattgtgatattttcctgttggactagtccttttatcattatataatgtccctccttgtcttttttaactgttgtggctttaaagtctattttgtctgatataagaatacctattcctgcttggttttcatgtccttttgcatggaatatatttttccactcctttaccttaagtttatgtgagtccttatgtgttaggtgaatctcttgaaggcagcagatatttggttggtgaattcttatccattctaccattctgtatcttttaaatgcagcatttatgccatttatattccacgttattattgagatgtgaggtactattctattcaaagtgctagttgttgtctgaattccttggggtttccttcattgtgttattgttttctagcccctgagagagttatgctttaaggaggttctattttgatgtattttaggttttatgtcaagatttagaactccttttagcagttcttgtagtgctggcatggaagtggcaaattccctcagcatttgtttgtctaaaaaagacagtatctttttttcccattccttttattattattattattacactttaacttcgggaatgcatgtgcagaatgtgcaggtgtggtgcatagatatacatgtgccatggtggtttgctgcacccatcaacctgtcaactacattaggtagttctcctaatgctatccctcccctagccccccaaccccctgacaggcctcactgtgtgctgttcccctccctgtgtccatgtgttctcatttttgaactcccacttgtgagggagaacatgtagtgtttggtttactgttcctgtgttagtttgctgagaatgatggtttccagcttcatccatgtcctggcaaaggacatgaactcaccttttttatggctgcataatattccatggtgtctatttgccacattttctttatccactctatcattgatgggcatttgggttggttccaagtctttgctattgtgaatagtactgcaatagatatatgcatgtgtgtgcatgtgtctttatactagaataatttataatcctttgggtatattcccagtaataggattgctgggtcaaatggcatttctggttctagatccttgaggaattgccacactgcttccacaatggttgaactaatttacactcccaccaacagtgtaaaagtgttcctatttctccacatcctctccagcacttgttgtttcctgacattttaatgaccaccattctaactggcatgagatggtatctcattgtggttttgatttggatttctctaatgaccagtaatgatgaacttttttcatgtttgttggccacataaatgtcttctttttgagaagtatctgttcatatccttcacccactttttgatagggttgtttattctttttcttgtaaatttgtttaagttccttgtaggttctggatattagccctttgtcagatggatagattgcacaaattttctcccattctgtaggttgcctgcccattctggtgatagtttcttttgctgtgcagaagctctttagtttaattacatctcatttgtcaatttggtgtttgttgccattgcttttggtattttagtcatgaagtctttgcccatgcctatgtcctgaatggtattgcctaggtattcttctaggtatcattttatggttttaggtcttatgtttatgactttaatccatcttgagttaatttttgtataaggtgtaaggaaggggtccagtttaagttttctgcatatggctagtcagttttcccaacaccatttattaaatagggaaccctttcctccttgcttgtttttgtcaagtttgccaaaggtcatatggttgtagatgtgtggcattatttctgatgcttctattctgttccattggtctacataactgttttggtaccagtaccatgctgttttggttactgtagccttatagtatagtttcaagtcaggtcatgtgatgcctccagctttgttctttttgcttaggattgtcttggctatacaggctcttttttggttccatatgaaatgtaatgtagttttttctaattctgtgaggagtcattggtagcttgatggggactgcactaaatctagaaattactttgggcattatggccattttcacgatattgattcttcctatccatgagcatgcaatgtttttccatttgtttgtgttctctcttacttccttgagcagtggtttgtagttctccttgaagaggtcctttacatcccttgtaagttgtattcctaggtattttattctctttgcagccattgtaaatgggagttcactcatgatttggctctctgtttgtctgttattggtgtataggaatgcttgtgatttttgcacattgattttgtatcctgagactttgctgaagttgcatatcagcttaaggagatttggggctaagatgatggggttttctaaatatacaatcatgtcatctcaaaacagagacaatttgacttcctctcttcctatttgaataccctttatttctttctcttgcctgattgccctggccagaacttccaatactatgttgaataggagtggtgagagaggccatccttgtcttgtgctggttttcaaagggaatgcttccagcttttgcccagtcaatatgatattggctgcaggtttgtcaaaaatagctcttattattttgagatatgttccatcaatacctaatttattgagagtttttagaatgaagaggtgttgaattttgtcaaaggccttttctgcatctattgagataatcatgtggtttttgtcattggttctgtttatgtgatggattacatttattgatatgcatatgttgaaccagccttgcatcccagggatgaagccgacttgatcgtgttggataagctttttgatgtgctgctggatttggtttgccagtatttttttgaggattttcacatcgaggttcatcagggatattggcctaaaattttatttattttttttcttgtatctctgccaggttttggtatcaaga

SEQ ID NO: 316 - DNA, 34389 bp, Homo sapiens
gccttttccagaatgttccagagttggagtcatatggtatgtagcctgtttggattggctcctttcacttcataatatgcatttaaaattcccccatgtcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaatcccccatgtcttttcacagcttgacatgtgcagtgtttgactctccagaatgacagttccaaatgggaatgctttgatggtctttgctgttgttttaaactaaatgcttttaaaaggaaaaatgatataaataatttttgagaattccagctctttaaaatgactgttatcttcacctgatctctcagccgcttggatactaaattgggggtgcaggtggggaatgcccagctcatgccagcatttcagatgctgatgcccatctgtaacagaatcctctgaattaaggctaagtgacggctctgctgaatttttggaagtaatttctgtgtttgcctgaatttggaaaaattctgagggacactagaaatgactagaggttttatgaagacatgcaacattaacaacaacttccagtcgagactggtcgtggtttccaggcagatgtggaatcctctgggtcttctttctggaaaagggtgggtgaggggcagataagacaagattgaccatgcactgacaattttgaagctggatgagaggtaactaggggttccttatgcctttctttcttttctttttaaggattgtggtaaaatacacataacataacatttaccatctgctatggtttgaatgcttgtgtgacctcccaaaattcatgttgaaacttaatccccaatgcaacagtattaagaagtggggactttaggaggtgattaagtcctgagggcaaagccctcatgaatgggattaacaaccttataaaagggctggagggaactagctaggcctctttttgcgcttccatgtggggacgcataaagaaggcgccatcttggaagcagagggcagccctcaccagacactgaatctgttggccccttgatcttggactttccagccttcagaatggggagaaaatttctgttctttatgattttataagtttttgttctttataaattacccagtctcaggtattttgttatagcagcgcaaacagactcagacattaccgtgaccatgtttgaggggatggttcagcagtgttaaatatactcatattgtggtgcaaccaatctccaggacattttcattttgcaaaactgaaattccactcccattaaacaacaactccccattttcccctccccacaggtccttgcaaccaccattctactttctatttctatgaatttgactactctagatacctcatataaataaaatcaggtggtatttttaattttgtgactggcttatttcacttagcatgatgtcctcaaggtttatccatgttgtagcacgttgagactggatttccttccctttaaggcctgcacaatattccattgcgtatatataccatattctgtttatccattcatctgtcaatggacatttgggttgcctctatgttttggctattgtgaataatgatgttgtggatatgagtgtacaaatgcctctcgatatccttctttcagttattttagatgtatacccttcattacactcctcattctccagctggaatacaattagttttgtgatttgtttcctgccactgtggtaggctacatggtcagtgctgtggatgggtgaaaccagagggttaaaattccttgaatttgacaaagtcatacacattaacttgtgtgtgtctgtgtgtgtgtttgagatggggtttgtccttgttgcccaggctggactgcagtgatgcaatcttggctcactgcgacctccaacacccgggctcaagtgatcctcccacctcagcctcctgagtagctgagatgacaggcgtgtgccaccacgaccagctaattccttccttccttccttctttccttccttccttccttcttgccttccttcctccctccctccctccctccctccccctctctctctctttcttttttattgtagagacggggtttcaacatgttgcccaggctggtctggcactcctggactcaagtgatcggcctgccttggtctcccctcaaaacatttgtttttttgtattgagtaaaggctcttcagttgttagttgtatagcatttaagtttgaggtatttgaaaatggatgaaatagaaaatcaagcagtatttctctcaaatgcaatgagccaatatttttttcacattctccaacatatagatgcagagatgaggctaaagaacatggagagcctttcccatctggtagcaatatatatatatatatatatatatatatgtttttgagatggagtctggctctgtcacccaggctggagtgcagtggcatgatctcaactcactgcaggcttcacctcccaggttcaagcgattctcctgcctcagcctcttgagtagctgggactacaggtgctcgccatcatgcccagctatttttttttttttttgtatttttagtagagacagcatttcaccatgttggccggcctggtcttgaactcctgacctaggtggtccgcccacctcggcctccccaagtgctgggattacaggcatgagccacctcgcctggcctcgtagcaacatgaattgaaggtaagtgattaattttggccacatccattcaatgggaaggcagggaacctctttttgggaaaaataaacctgcttaatgttttccagaaaaatagtttatagtatcttgccaagagcacaatcattgccagtcgtacccggaggcacagaggttgtgaaaggtgccaatgtcatctgttttgtataaccttgaataccttatgtgtgaaatgactttgtgtgtttaaatgtgtagggctttttgatatggggttattcttcatgtattctgcatattatgatatgtttggtgaatcccaatcttataaaagagaaaggaaaatcagcactgctggtagcacttgaaattcaataggtgtagagattattattattaacaaagtgactaaaataggaggactcaatttggaaaatttgagacgtgaagccttactggttaaaaagaaatcaatagataaaaggtcattaatttagtactttcatttttgtattttttgaaaaagaggccccccaagttctataagcttcaagctccataaatcctggatctacccctggtgacggctcggccccttcacttgctgggaggggaaggtagttttatcaatagaacattccctttgccacattgaatgccacttgattgtctccccaaggacagacccttctcctcaatttcaagggctccgtgtgtgtgtggggggggcgtgggggggaattatgcagtcattgtcccctgtgtctcattctaaagcagcaggggcttgagcacaggcacgggtgtctctgaaatagttgtgcgctggggcctcctcctgccccgtcagggagaacgtggtggtggtggggggaggagccattatggtggtaatgtgtgtgtgtgtgtgtgtgtgtgtgtgtgtgtgtgtgtgtgtgtgtgtgtatggctcacaccgacccctgactttgcagtgtctgcctaaagtactcggcattttcggtgactcctcatgttgctgatttgttccctgggggctgcaccctctgcctttcccaaccacggtgtctctctgcccttgctgccaggtgtgtgggcccactctgcccttcactgggtaaatcctcttagtgggaggccacacctgaggcaggaagggctctcagccctgcagcatgggctacgtcagtgcccagcagggctcccagctctcaccacctggctgcctatcaggtgccctgacgctgcagctgcacgctcttgatgcttatggggccaattttccatcctccatccaccacaacttacgtatcccgctgtcccatgtccctgtagggctaatgagaacttctccaggccaagcagtggcaaagtggtgccaacagctccatgcgtattggggctcccacgtcacgtgagggtgctgagggcctcaaacgcctttcaccagaggcctgactagtgcggcaggtcaggaaacaagaagagactttagaagagggaggccttgccttgtgttcctcagaaccgggacacttggtcctcaccggggtgaggctgggcagagtgcaccctccagccgcctgtacctccacagccctgcaggccgagagatgcaagataaactgtggatggcacccactttggagtcaggaggcctgagactctcccccagctggttccttcacgaccttggggaagtcacttcctttctgggggctacagtttcttcactgaagaatgaggaggttagatgggaagtcactacttccaaagatttgttttttttttaatgaaagtaaaatcttattttttcaaaatatcactaggaagacccatggatcaccccaggagtgttccagctacagcatgggatgggtctccctctccccagcaaccttgtctgctgggcccaccccttaggtgtccgggggcccccactagaacctgcagaaaacatttggaacccactggacttgcttgcaggtcccgtagagtcccaccctctaggattctctaaggaattcacaggtaccccctccgacccccaaccacactctccacagacacatgcacagaaacgtaagcactgcccacagctgtgtgcacacacagggactttcagaggcatgattcagaagccacactgggcaaagtgccctcctgctgtttgtgttcactcacgcagcccttggccgccttcttcctgtcttctttatttgctgctgtcactcccacctcctgtggagtagaccagatggccgcatctgcccaaggaagtgtctacagaggaaatggcaaagtgcattccagccaaggtagaaatcactggcaggcaagctctcagggccaaggcactggggctttggagtcctggcctgggtccctacccaaacccttgtcccctcagatacatccctagaccccttcctgagcaacctggaaagaacccgcagacccattttctgcacattcctcagccccacagggagaggaaaatgctccacctcctccagttgctgcccaggctgccggctacgaggggctgtggcttccacattcccttctccagtgcagccaggcttgacctttcagaaaatccttgacgatgggaaggactcccaaggatggcatagaatagccaggcccagcccctggacctgcataaagcaattgtttggaggcagagagtcggatgcctggtgaatggggggctggtactcaatatagtcagagaaggcagtgtccttactcagctgctctcagagcgaaggcacttgccctctgcaggctgccccagaagccaaaggaaagcaactggaagctaaagggaaggtttggggactttaatagctgatatagtttggatatttgtccctgcccaaatctcatgttgaatgaaatgtaatctgcagtgttagaagtgcctggtgggaggtgtttgggccatgggggcagatctctcatgaatggcttgggccatcctcctggtgatgagtgagctcttgctctgagttcacatgagatctggtcatttaaaagtgtgtggcaccttctacctcaccaaccccccacctctccctctttctctctctgtctcatgctgaaggagacatggaacagtgagattctcccttggagcctccagaaggaacctgccctgtggacaccttgattttagccctgtaggttcatttcagactctggacttccagaacgctaagagagtaagtctgtgttgttcaagccactttttgtggtggtttattatgcagcaatggagaacaaatacacccggcatgtcctgggacaaagcctggggacggcggggggactgagctggacgcccataccccaaagcacgaagggaagagaccagcagctaacactcgaagaggccgactagttctcaaaagggagaagaggtatggcctgaaagccaaggagcaagggagatgctaactctaaccgcattatttttttggagacagggtctcccttggtcacccaggctggagtgcagtggtgcaatcatggctcactgcagcctcgacctcctgggctcaagcgatcctcctgcttcagcctccagagcagctgggaccacaggtgtgcaccaccacgccctgccccctaaccccattttctgtccctggggtacatggggtgtgagataataaacagtccccactggagagagattatttaatcctcatcctactccacaagaccattatcgttacgatcttccttctatagatcaggaacctgaagtacttgggggtggaggtcacttgctcaagttcaggcagttaggaagggcaaagcagaggtttgaaccgtgcctgcacctgtgaagtttggaaaccatcatcgcattcccccaggggaatagtctaggatctgagttccagcttctccatctgaggcagcggtccccaggcgctggcagcaacgtgcagctgctggggtacgaggcagctgcctgcagagaccgtgccttccccttggtgcagatgcagtgggcagcctgcactttgctgctcctgtgtccgactccttggggttctgttctggagacagagctcagtggactcacaagacggtcactttcttctgttgagtccctgagtttatttgatgaaatccagaactgaagttcctggaataagtcatcttaccaccagtgttttgaattaacgaactcaaatgtcatctcctcccacacaaacatttctctttagacatacaaggatgaagatgaagagaaaaagccaggccatatgctgggctgtggtgcggattacattctgtgtccggggtgcttgttcgaatgtcctacttggacgagctatttgtggggcataagcagagaacccagacacagatgacttgggagggggctcaggatgcttcagtttccccagacactcctggctgtgccattgctctgcccactgggaacagtttatatgattctcagataagaaccacatcagcagagaagccaaaaaggagatacgacccttgtttcatcgtcccttggttccaatttcctcaggggattgggctactctaaacttttcttgaagtgaacaagtcttgagatacatttttttttttttgagatgggggtctcactctgttacccagactggagtgcagtggtgcaaacacagctcactgcaacctcaacctcctgggctcaagtgatcctcccacctcagcctcccgagtagctgggactacaggcatgcaccactacaccgagctaagtttttattttttgtagagatggagtcttgctattatgcccaggctggtctggaactctggagttaagtgattttcctgccttggcctctcaaagagttggaattacaggcatgagccactgtgctgggttatgaatatttttttaaatgacgtgcattccaaaacagtttcacagggctataaggaaaagaagaaaattaggcaactattttgtatactgcttataaaaaataccgttgattttctttcctaggtgtaattagcttttgagtgggaaagcttgtattcccactttgaatattctattcaaagtcgaggacagtcaagtacctcacattctagagagaacatcaacagtcctcttggcagttattgaaaagggacagaccaactctgtcaccccactctcccttcatcggcccacactcaataccaacaccagtctggagtgcatacttggaagacttgaagggggaaaaggagtgagaaggaggggctgttggaaccttgagctgtggggaagagaggctttgcttaggtgctggggagactccagctcccacttcagccctgtgtctgggcctgctccatggtggtgctgaggcccttctgtgcctgtgaagctggactatgagaattttgtctttcttgtgactcccttttccacagatcttggagttcaacaggacacacaagtcctagaacatttaaaaacataagtaaatccccctccttctcccacctggagaacttagaatcgtcatgccaacttctggaggcaatggtcttcagatccgcttggctgtggccaaactacagggtgtcatggagaaacacagtctggtgggagggggcagatgatgaaagcagaagacaggaaagacaaagacttcttggtgttatcttccatggtgagtgtgcagtttccatattctccagctatgaacttgaactcaatgggagaaatctcccagtaagatgttatgtgggtggtggccgagtaggggtgggttggtcgctgtgaactgtctgagactctcctgtcttaacattggagaaatggagacttgaagaggtgaagcaaatttccctagatgacttgggaacgttgggttgtggggagttgggtttgaacttggacattcagttttgaatccacgtgcttacagaggggtagagaaggctctagggcatgagagtcaattactcagcagagaagggaaagggagaagatttcacacattcctgcccttctgagttgatttcaatcctatctgagtaatagacatcattatggttaatatttgtctctgattggtcgtctttgttttgactccccctgaattaaggattcaagggcaagtagtttatttgagagtggatcccgagaaaccctggtgggggagtgggaaagtgagaaagagaggaggccactggaggatgactggtaagttcatttccactttgggccactgagcttgatcctgctggggaaccctggcaggtacgtctcagatgccaaccatggagcaagaacacaggggtgttctttccatctggccttggtggcagcatctcccaggggcactgtgtccctggtgctctggtctgtggagagtcataggtgctcttgttaagcatctgtgtgcacggagaggagagtgcttgggagggatagggggtggcatcaagggcatctgcaaacctcaggcagctggaggatggccaggtggctgcctctctgtagctcgtgtcctgaagtgtctttctgtgcccacttatttgtgctcgaccttgggctgcaagtttgttgatagttacagggggtggctccagccaccgtgttgggtgtctcaccctgtccaacccctgatctttattgtggaccaggctatagacagatctttgtcagctgcccctgtgagtcttctgtgcagacaccttcctgtggaagagttggtctctggtcactgtttcaagtctctgctgcggccacagctttcttatctctcactttggggatctcaggaaatgagacaccaggaggtgtctgctgtacaaaatcctatttgctcaaggaacctgcatatctcagctcatgtttcttaatcatttttctgattctaaaaagtcgatgacaaaacttcgatagaaacacagttctagcatttgggattggaggaagaagtgtattcagcattctaccttcttcctgattctgtgagcttagacctgcttccactttcaatctctctcattgcaggctgaagaggactggcctttcagtggccctcgtggaacggtaggaagctgagctggactctctgccacatcgttcggttcccacaacagcctggtaggtcggggtagtcacttccatttgggagatgaggaagtcgaaggagagagctagagtgagccagaacttagggctgatcacaaattggatgagtaattgagataactaggatggcccctagctaaggctgcaggcaatgccccaaggagactgtcacctttttgttacaattttccagggtgtgataggacttaggaggatggtgtgtctgtccctaggactgtaggttgttctagagaaaaacaaaattttaaggactttttctttgtgcatatgcctcaggtaggcatcatgtgggcctaggcaataggacctaggaaggagactcccctgttcccaggcctgccgctcctactcaggaggctgaagggtccccaccccaactaaccacagagtcagacacattcttcctaacacaccttcctcccgacctcccagcttccctctttgtcactgaagtcatagacttttttttttgaagaattatcaacctaaataacaaacagaagcgattctccaaagatgatgaatttatttggaaatgagcagcatgattgtgatgcggagtgcccgtgccacagcagccatgggcgcatccaggaggctgaggcaaggggaagcttttaagggcacaaggaagactgggtgtggtgactcacgcctataatcccagcactttgggaggctgagtcgggtggatcacttgaggtccggagttcaagaccagcatgataaacatggtgaaaccccatttctactgaaaatacaaaattagctgggcatgatggcacatgcctgtaatcccagctacctgggaggctgaggcaggagaatcgcttgaacttgggaggcagaggttgcaatgagtcaagatcgtaccattgcactctagcctcggcaataagagcgaaacttggtctcaaaaaaataaaggcaaaaggaggagtgcacaggagttgttgagttgtttttgaacaaagagaacattggttacttgggcacaggagttgaggtcagattcttagtggagatggcatgtgaggtgagagtgctccaacatgtggccggccgtccagtgactcctgtggcaggctgcagttgggaaggcccttggaaatagtccttattacaggcatatgtgtgtcacagccttcagagagtctttgtaatagtccttttttttccttttctttttagaaatggggtcttgccttgttgcccaggctggagtgcagcaacgtgatcatagtttactgtagcctgggctcaactcctgggctccagtgatcctcccgcctcagcctcacaagtagctgggaccataggtgtgagccactgtgtttggctgtaatcgttgttattgtaggcgcatgtgcatgaggaccctcccttcttaggctcctgactctactttgcttgggtttgaaacaagtgactccatcttgaaatggacaactggcacagaatagagcatttcaagggcagattagatggcaacttaaaaaaaaggtaaagaaaaattaaagaaaaaattaaaggtaaggaaaaatttacactttctaggaacttcacgaaggaagggaaacatgagacaaagaaagagaagtggttatcagaaactaaactgcacgaggcttgtgaggtttctcatgttcctcctggaacttcctcctagactgtattctgccatctgctctggggtcacgagggaaagggcccctctcctttcatggcctagaaagcgtggctctgagccattctttgggctgaggtgggtgtctggggtgctggtggggacagccaggccctgccttcctgggtacctcttgctgcttgtcaacagaccctgccctccatactgtgagggattgaaggattaactccaattctttcctgtcctccattcatacccatgccattgctcatcttgggcggactgtatttccctgcccattgagtttcggtttggtcttgtgacttgctttggccactagaatggggcaaagtgagagggttcccgttctcagcctgccccttgtaagaccctgcaggcttctgctggcctcctgggtttctgcccttgcctgggggctttccctgggtggtttcggttccttctacttggtacctgaaatgaagacatgtgggacaaagccactccagctgacctagagatcaacaagatgaagccagtagacccacagatgactgagaaatgtgtttattgctgtatctgtgccatgtcgatttttgtggttgtttgctgtatgtcactattttggcaatagctatatattcccttttccttcttctctgtgctctggtctgaattaatgcctctttgtttcatctcatttcccattgcttttcactttattataaaagcactgcaatttatacattgaagcagaaaagaagggtggaatccccataattccatacccttctgtgaatacactggtgtccagactgttggaatatattcatttattctctcttcatatgtacatttaaaagatgaatcaattcttttttttttaaaagcaaattgtttcatttaacaatacatggtaaatatacttggtgttagtgctgtcttcagggttccgtggagcgttttacagtcttctttttagcaccctcctaaagatgttgaaggaggtgggtgatggggttgcctgactccttcaccaggagcatcctcacatccatctctttcacacattggggtttcacatgcgcgtttatttgcaaaacagggctctgctacaaaaatcaccagttgaaaatcaccaatctaaaaactgctttttatgtgttttaatgatataccatgcaacattattataaccaatcccttatttgaaaatttaggttgttttgggttttataattaaaatcacatgcttatggcatatatttgtgtatactcttaattatttccttacaataaattattagaagtggacatataatttctataagtgtaggtataaaatcctggcagtagaatttctaaaagtggaaagcatatgttcatgtaaaggctgctaaattgccaaaataccctcccaaaaccttatcagttactcttccactggcagtgatgccaggtagaacctctgactgtttggcaaatgaatgtttgtatcttgtggctttaaattactgttctttactaattaaatgaggctatttcttcatatagttattaccatttgcatatcttgtcttgtgaattttttgtttatgtgctttgagcattttttttgactaggatgtcatctttttctcattgatttataataccacttatatatgctatgttagaaagaatgctggattataatttgatgtattaagatggtctggctggcattacagattagtagagagtagaggatgaaatatccaataagcagtgctaggacaactaattatttatatgaaaaaataaaattttatatatataattttttaaattataaattttataattataaattataaaaataagaacactctgttgctcaggctggagtgcagtggtgcggtcttggctcactgcaacctccacctcccaggttcaagtgattctcccggctcagcctctcgagtagctggtaggtgagccccaccatgcccccactaattttttgtatagagatggggtttcaccctgttggccaggctgatctcgaactcctgacctcaagtgattcacccacctcggcctcccaaagtgcttggattacaggcgtgagcctccgggccggtcataaaattacatttttatctcactctattcacaaaaaattccactgtgaaaaaaaataaagcttccagaagaaatatgaggaagattttccagtttttaaggtacacaaaaaaagcacaaatcataagagaaaatattgataattttgaccagatcaaagttctgtataatagaagacattataaactacatcaaaatacaagccacagactttgaaaagacacctgcaaagcataaaatagtgaattattagtacagatgctccttgatttacgaagggattatgtcctgataaattcattgtaagttgaaaatataaatggaaaaggcatttaatatatctaacctatggaacatcatagcttagcctagcctaccttaaacatgctcagaacaaccacccgagcctatagttgggcaatagtcatctaacacaaagcctattttataataaagtattgaaaaatctcatggaatttatgaaatactgtggagcgttatgagaaagtattgtactgcgtattgctagtctggaaaaagatcaaaattcaaaatgcaaagtacagtttctactaaatgcatatcgctctctactattgtaaagttgaacaattgtaagtcaaacaatcctaagtgtaagtcagggactatttgtacatagaacatagaaaaatggatgtggtgtctcacacctataatcccagcactctgggaggccgaggtgggaggactgcttgagctcaggagtttgagatcagcctgggcaacatggcgaaagcccatcttacaaaaaaatacaaaaattagctgagcatggtggtgcaagcctgtagtcacagctacctgggagattgagttgagaggatcacctgagcccaagaggccgaggctgcaaagatccgagattgcactactgcacactagcctgggcaacagaatgagatcttgtctcaaaaataaaaaagaagaacatataaaaatgtggaacataaaatataggatataagaaacatacagcatatcaaatgcctataacttaataaggaatgtgcagacaacccaataaaaaattgggcaaaggatatgaacaggcaagacacagaagacatttaaacatttaaagcatgctcagcctcacagctaatcaaacaatctgataccatctcacacccaccagtctggcaataaagtctgataataccagctattggtgaagatgtagagaaatgataactatcaaccactgtcaaacacaaatgtaagtttttataaacaggacagcaatgtgatgatatccagtgaatttaaaaatgtgcattccctaggacaaagaaatttaactttacagtatagactccaggggagctctcatctgtatttgtgttaattgtaaccttatttgtagtaggaaaaattggaagcagcctgtaggttcatcactggaagggtatataaagggctacagctgtatctgaaatattttcacttaaaaaatctggagcaaaaatgacaaactgcttagacttaatgagctgggtgttgagtacacgggttattttccatgcttgttcacacactgtgcaataccttgttttaaaaagatgatattgtattaggaacccaggaataccctgatccagctccagaccacagtcaatcctccttattttgtctaggctgaccctggggctggaatctgtggcaccttcaaaaagagtgatgtggagggtagaaagaagcgtcacctgtggcaggaattgcagagcagtaaggaaaatgggcatagggaaatctcatttgttttatgacagttttgagatataattcacatgccacaaaattcaaccatttaaagtgtacaagtcaatagtttttagtatattcacagatatgtgcaacccagcaccacagtcagcctcataacatttctatcgccttgtatagaaactctgtactttaaggatcactcttcatcctcccatctcctcccagctctaagcaaccactcatctactttctgtctctataggtttgactaatctgaacatttgaagtaagtggaatcatataataggtggcctaatgttttcaaggttcatccatgttggatcatgtatcagtacttcatccctttttagggccaaataatatcctcttgtatggaaatactgcattttgtttatccatttatcagttgacgttgagttgtttccactttttgcctattataaataatgctgctacaaacatgcatgtactactttttgagtagacatgttttccttttttgggtaaatacgtaggaatgtcattgctggatcatttgattatgtttcaccatatgaggaactgctagactgttttccaaagtgactgcacaattttacattcccaccagtgatgtatgaagattccaatttctccacattctcacctcttccacattctcctgatcctcactctcttgttatctgactttctgattacagccatgcttgtgggtatgaagtcgtgttctcttttggttttgatttgcatttcctttatgactaatgatgttacacatcttttcatgtgcttcttggctatttgtgggacttctttggagaaatgactatccatatcattttcccattttaaaaaattgggtaatttgtctttttattattgagtcataacatttctttatatagtctagagacaagttccttatgagatatgtgattttcaaatgtttctctcattccgtggtttgtattttcactttttaagtagtgtcttttgaagtacaaaagttctgattttgataaagcccaatttatctattttttcttttgttgctcatgcttttgatgtcatatctaagaacctattgtcaaatccaatcatgaagatttgcgaccatgttttctaaaagttgtatagttttagctcttatgtttaggtctttgatccatcttgagttaatttttgtatatggtgtgaagcgagagttcaatgtcattattttatatgtggctatcccattatctcagtatgatttgttgaaaagactacgtttttcccccattgaatggttttggcactcttgttgaaaattaattgaccatatatgtgagggtttatttctggactcttagctctattttattgatttatatgtttatccctatctcagtatcacactatctagattactgctgctttgtagtaagtttggcaatcaggaagtatgaatcctccagtttgttcttttgtcagagtattttggctagtctaggtcccttgaatttttatatgaattttagaattagcttgttaacttctacaaagaagccacctgggattctaatagggctttcttgaatgtatagatcaattttgggagtattgccatattaacaatcttaagttttttgatccgtgaatatggtatatttttcatttatgtagacctttaattctttcaactacgttttatagtctttaaagtataaattttaaacttttattaaatttatttctcttgttctttttggtgctattataaatggaattgtttcaactttattttcagattgtgcattgttttgagatataattggttctgtatattgaccttgtatcctgtaagctcgatgaaattacttattaattctaatagttttatttagtagattccttaggattttctgtgtagaaaatttctatgtaatttgtgaatagagatagttttatttcttcctttcaaatatggatgccttttttgtgtgtgtgcttaattgccctggctagaatgtctacttaatgctgaatagatgtggcaagaacagccatccttggcttgtgtctaatcttgagggaaagcatccaatctttgactattaagtataattttatctgtgtgttttttggtagattccttgtatcaaattgaggaagtctccttccattcctagtttatgaagtgtttcattacaaaaaagcattagattttgtcaaatatttgttctgtatctgttgagatggttatgtgtgtgtatgtgtgtgttcttaaaagtcttttgatatggtgtagtacattaattgattttcagatgttaaaccaaccttgcattcctgggataattcccactttttcatggtgtataattctttttctatatttatggatttggtatgctagcattttgttgaggacttttgcatccacacatctatattcataagagatatttgttgttcccttcccttccccttctccttctccttctgcttcctcttccccttccccttaccccttgcaggtcttcaggagtgcctttcaccagtccttagtcctggcccactggcctcttgggtctgcctttcttttcagcttccacagggagcttggggtgtgggaatctgcgctgaggcccctgtgctgcctgcccaggatccctggggagccacttctctcaggggtctcccagcacctttgctgtgctgctgggaagtgggatgcggccccttctctcagggcttcctggcctgcctctcacttgcctttctcattccatcaagtatgtgggtagcaggaaggggaaactctggggcctgagggtaccccctaccttcatcttcctggccatgtgtgttctcacatcccctcctctggccatctctctgaggctgatgctgttggaaacaaggtcaaggcgcctctcaggccttttcttcttctgattctatccctctcttccggcaaagagcaggagcctgctagtgcctacatgggagggcagggccaccagggcgacagtgttgtgtgtgcgggtggaagcacagggagctatctattgtgatgaaccccagcaaggagggaggaatgtggctacgagcgatgcctggattgctgcttgatttttctaacactttcctacttctcgcctgcagatgaagcagcagcagaaaaaatggaagccattttggttaacgggtcacatcttagcagttggcagcgtaagaagcggaaggatccactggtcagaaatggagattgaggagaagctgagagcacggagggcttcaggggagagcctgtcctttggaaaagcgggcaatttgcactcgtggtagatgagtggggaggccgctcagtctctctgcccctttgcacatgctgcacccgtttagtttgacgtcgtggagagctcctccaggcacgggctgtgtgaaagggtttaaaagtttgggggcatggctgggggtccccgcatgaggggtgctgtgtaggctcccatcttttctgccggtcatgctgggagccaacagcaccggctcctgacgtggggacttgccctgtgccatgacgtggggactcgccctgtgccctgcgccccggttcctgctggttctgtgccttctggactcatttcctttccagggtccgcaaccgcttccgacacaatcactattttggctgcggccacggcttcattcgcttcagctgcgagcttttctcagcgcagagagcacagggaagctgggaggagtccgcctagatgggtaaggacggtatttttggcagcagttccggggaccctcccctgatcagcctgcacttccgccctgggttgaggggagcatttccagcgagggggcgaagaggtgagagcagctggggagagccaggggctgagggccctttgctttctgaagtgtggcgtcatcacgggtgctgaaggagacacagggtggctgcgtgatcagtctctgccctggaatctctgtgttcagcccatgtcatcttctcaggagtgatggaagctcccactggagaacactttctggtcttgagccccccgatctcttgatccctatggcagtgagccccgactcttgctctggtcgccactggatcatctgtgggtgttggcaggaacctgaaggtgttggaaggggttgagggtaacgcatagcctgtgctagaatatgtgggggaatgtccacaggagacgggatggaagagagagaagaggacgcccctgcttccaggggcaagtgggtacaaccagaggacgggacaatgttcccctggagaatggcccaggctccatctagacctggctggtcccagtcccaggcttgtcctaggtccttggcatccgtgctggtagcaaccccagggccaccctcagcgtctcatgacgtctacccttctctggcccctgtagaaattatgttcaagagaaaacacccggggggtcacaatgataacaataacaccaccacctgtgccccgtgggtgtgaggctgtcatggagaaagcagagctcctgaaggggcctcagctgagaaacggctagaatttcctgtgtgggttgtggggagtgactatggaattcagaggcagagcggaatctacttgggctgttgtggcaggaacctagactccagagggaccctggttaggctctcagagaagggagccccggaaagtgagccaaggaacgggcctttgtccccaaggctggagccacaggctctgtttccctggccagaggcaaggggggccctttggggtctcatggttcaggtggcctcttctttcttaggcctcttcctccagatccccactccccccacggggcacagccccatgtgtggagtcggccttgactctgcccttcagtctccctgcccagagccggctgcaccggctgtcattccccagtcccgcttcccgcaggcccctacccagatactgatgctgtggcacccaccaccacatgggggaccctgggcaaagcgttagtgcttgacagacattgggtcctccggtccccctccagtgccatgagctaacagttgtatccccatcacacagatgacaaaactgggaggcagcacggttcatgagcttgtgcaagttcacacagggcgtgattgacggggctgggattcagatgcagttaggacactgccttatctcaggctctgctgctccccagacttcttggccctgacgctcctttcgaggttatggaactctcttgaatgtctctgttggctgcagccagccaattaattaccctgcatgaatggggactatgggtgacagtttccgctgtcccaagttctggctgaagtctccattctattgggttaggggccagatgcctgaggacctgcaggaggccagggctgcatgctgaatgagaactttacctgggccaccaagtccttctgagcacaggtgctgctccctgcagtcaggacatgctggccggggtctctgaccttcacctggaatgctcctggaagcccctgtgtgacaatctccaccacagtcagctgcagcctcacaggccttgtgtcatttcccactataggaccagggaaccaggctgaccagaagacctacgaggagaaatagaaagcttgggaggttgaagtggaaagccaggtgtccatttctctgcctgcagaatgagtccccagggagcccagcggccagggcaaggtgtcaggggccccgtcacagctgcgggaaggccacatggggggcagctgtgggcatggggccagagcccaggaagctgtggctctgggggagggtttgtgcccctgggatgtctgaatgcagctctggggtggggccagcctgggcctggagctcctgcaggctggtctagtgccaggcccgggggaaggcagagtcagagactgggggactttgcttctgctcactgtgtctccagtgtcaggagctggctcaggactcgtgaatgtccacatcagaagaggggcttaagccatgaggattgaggcttccctccagacctgagtgggtggggaggggagagggtgagggcaatggccacacctgctccatccactccctggaataaaggagtggtgtttttttcattcctcactcactcattcttccatccctggtgtgccaggccccgttttggtgctggaatagagtcataagcaagacagacatagtccccaccttcagaaagcttttgtttggtgcaatggtgtggaaatgcatcttgaatattacagaggaacaatttggagtggagctcaagtcattccagaaactcccactttttaaaaattttattttattttgtatttttacatacattttttgagacaaggtcttgctctgttacccagtctggagtgcagtggtgcaatcatagctcactacagcctatacctcctgggttcaagtgatcctcccatctcagcctcccaggtagctgggaccacaggtgcatatcaccaagctcagctaattttaaaactttttttgcaaagatggagtctctctatgtttcccaggctggtcttgaaatcctggcctcaggggatcttcccttcttggcctccaaaagtgttgggattacaggtgtgagccaacacatccagctgtccccacttaaaattttttttttttttttttttttgagacagagtctcactctgctgcccaggctggagtacagtggtgtgatcttggctcactgcaacctccacctcctgggttcaggtgattctcctgcctcagctacccgagtacctgggactacaggagtgccccattaagccaggctaattttctatttttagtagagacggggtttcaccatgttgaccaggctggtcttgaactactgacatcaagtgatccacctgccttggcttcccaaagtgctgggattacaggggtgagccaccgcacccgaccctcactttttataggtgaaaaaatatggagaatttggggaaatcccaggaagaagaatgagtagtgaggtgctgggaaaaccctgggatcatatgaagttgctgtggaattttacaggaattgcccctccctctctgtttgggtgatccttctcttttggtggattttttcatttcaaaatcaggtctcttgccagcttttaactaccattgactcatagtttttaccttcacaaagctgtttgctaccactatcaatcactcagagtttaagaactttctatttccactcctgattattgtctgtgggcctcttatgactgcctgtatctctctagaatcttccagaagcaacatgactcttttaggcctttgctgccagctaagaaggtgaagaaaagtcaccactgcaataaaaagagggcactttgtcttacttggcaataaaccaccaccagcagcagcagcaatagcagcacccccacccccaccaaacccaaaacaaacaagaaaagcaaaaggaaacctgtaagcaaagcccaggggagctgtgttgaatgtaggtccagagtggggttgagggctgcagctgggcacagggtgcctgcgctccagcaagagtgcaggctggaagaaagtcattctttatcatctcattggcccttggatggtgtcgagaagatttagaaatatttttatcctctttatttttagtcgttttcagtgagaggattggcatgaagaatccttgggacacaggaatcaatcaagacctttggatgcccctgcctgctctgtctctagaagcctcaagcccagcatccccatgccgacgtgctcatctctagcaaaacaccagcctctcagccctctctccataaaggccactagaaagtactgtgatgccaggctgctccacatccaggcagcctgggtgaccactgccctttatgagaatcagaaaaagctgtctcccgagtagttggaattacaggtgcatgccaccatgcctggctaatttttgtatttttagtagagatggagtttcactatgttggccaggctgctcttgaactcctgacctcaaatgatccacccgactcggcctcccaaagagctggaattacaggagaagctaaacgttttaaaataagtatattatttctgaattactataacagacatggactccatttgaacaagatacttaattccatcaaaaacttgtcaaaatatacaaatttagtcacaagacactttactaccatctaccaaagctgtagtaaacacacacattttccatctttgaaatgaaataacgtataataatgttttccaaaataacaaagatgtctgcagtgaatagcactccctttgatgtggcaactgggtcaatcgtgttaacaactgtgaattcatctttttaagaaattcttttattgtttcttttcttttccgcgacagtctcactcgtgttgccccggctggagtgcagtggcgctatcttggctcactgcagcctccgcctcccgggttcaagcaattctcatgcctcagcctcctgagtagctgggattataggcacgtgccaccacacccagctaatttttttgtatttttagtagagacggggtttgaccatgttggtcagggtggtctcgaattcctgacctcagttgagccgccggcctcggcctcccaggaagtgctgggattacaggcatgagccaccaggcccggccttattgtttctatttgtaataaatctgttccccttgctgctgtctctgcgttagttctcctcatttctagcttgggtgctgcagcagcctctgaccggtccttctgtctccagcctgactgcgttttctcgcacctgctgggctgtcttagggccccgatgccggtggcgtttgccattctccgtctgcctgaggcgtcctccctccgtcatctgacaggcaaatgttacagcccttcaagacttaggcattacctttcccgcgcggccttcccttcactgtgccttacaatcttctccatggcaggacatagtgaaactccgtctctaccactccgtcagtacctgccacaggaaatggcgggtttacggatttgtttataagtttatttccccaattggttgtttttccatcttgcggggtttacatcgtctcctcctcacttgcgtggcagcctggacgcatctctatcacagcacattacctcgtttcgtgaccacagcgtagtctcttccccatcctcagactgagttagggcccctttgagtcaggtatttgccttgctaatctttgtgccctctgtgtctaatacggtgcttggtcctggtagatttctccttgcttgcataacatgtgtcttcctggcttattcgatttctggaagtctagaacttctccccagtgtttcacctgcctgctgagtcagggctctcggcccgctggggagcattttgctgcacttgtcattagccacaaagccactagggggcagggagcccccatcctgcctcagatcggtgccaaaccagaacccggcagcctgccttctgcacggaaatcaattctctaggagctgatttgctgaaagatcattttgcaaaatggtcaactcagcaaataatcgacttgctgaatctttgaggagttatttgcagcttcagttttacttagagcaatccctggatgcttaatatttcatttaagaatgagtgagccttttcttctctattttggggaaacagtttcttgctgagcctctgcctctgttagtaccccagcggggatgaactgcagtacctggcttcgggtttttgtcttttcattataatgagttggttttatgtgcgttgacctactgtaaaggaagggtggggttcttccaaaatagatcctctttcaatgaggagacaggtagagtgggacatgggaagggctttgtcagctttccccatcaagatgtgtcctgtgtgtccccaaagctcttcttgagccatcccagcataaccagggtttccctcaggttcataacaaggtagagcagtcctcaaggctggcgcatgaagaccagtccagggggagggtggatccctcgggatgtgataggctgacagcagctccccaaagcctgtggttttgactactgtagagacttcatatctgaagcatgcccctctacttcagccacccccactgctcctccttctgcggggtccctttggaaagcttagcaccacctcagacatttggaaaactaacttgagctccagtccctcgaggccctagcctctgcatcctgtgaagagggccctgctgtgcagagcgcagagggtcccgcactcacttggatgaacctctagggcattctgctcagtctcaggagggcagacactgtgggactccactcacatgagtatctgacgttgccaaaaatcatagaaacaggccgggtgtggtggctcacacctgtaatcccagcgctttgggaggctgaggcaggtggatcacttgaggtcaggagttcaagaccagcctggccaacatggtgaaaccccgtttctactaaaaatacaaatattagccgtgtgtggtggcgggaacctgtaatcccagctactcgggaggctggggcaggagaattgcttgaactcgggaggtggaggttgcagtgagccgagatcacaccattgcactccagcctgggcgacagagcaagactctgtctcaaaaaaaaaaaaaaaatcatagaaacggaaagtagaacggtggttacccgggctggggttcggggaggtgagttggggtgtaatggggagagtttgggtgctgcaggatgaaaagtcctgcagatctggcacacaaccatgtgaatgtactttctactgtgggctatacacttagaaatggttaggatggtactattaatgttacatcatttttaccctagtaaacattttttaagaagtcttcctccgtgtttgacttccttatgaagtagagaccaggtagtttggacactatgttctttcacaaaagggatttcattttgtgaaatatttgaaagcatcgaagtctagcatttcacgttttgcaagctggggaaaagcattcattccctgagaagcagcgttggtctgtcaggcttggagttccccgggttgtgggttttagggaagggaagggaagcgaggaaggacttgtgagaggaagtcctaaaggccacttaagggcacacagaggcccggagctggctttgctcagagcttgtagcggcgccacaatctctgtcctctcaggaacaggaactggcttgacgtccttttcctgccctatccaagcccctgttcttgcagcccttctgaagctcagcctggcaccggccccggcgccccagcccctggccaagcctctgctgtcatttctcctccctcctctcagtctgcagctgcgggacgggccgggctcctcagtttctgctgtgttgtgaccccacgaggcgctcagcacccagggaaggcgcgtgtgtccccgatgctggctcctccctgagccccgacggctctcgaggttctgagcctgtggcctgcacagggaacttcctctccgactgcatttatgcctctgtggatgtgaaggctatttctagaaatctcttcctttgcagaaacacccgaaaccctcctgccaggaagaccagggcctgggaagagggtcgctctccggccattctcccctcaccctcctcaccttcctcacatcctgtgccctgggggaccagcagctgcttccacccaggtgagagatggagggatagagccaggtggattgcggagcctcggagactgtgggacgccgtgggaccccatgggacacgaccgcagtgcatgtgtgacatgtgcactcgtgtgtagatgtgtgtgcactggtgcatggctgtgggggaggatgggcttggcaccgggaaggcagcctgctcagccatgggagaggaggctgggttgaatggcagggttgaatggcagagttgaatggcaggggccctgggaagctttcctcctggtccaaagcgtgtctccccagcctgctggggagtagattcggcaggatggggacagaggcatattcccagacatctatgagagtggctgtcctaaaagaaggcgtgtcggggagtgggtgtgagccctgaagaggaggagggctgagactggcagaagggaggaagaagcaggcggaagcagccggtcagatgccccatgaagctagatggtgccgcagagcagcccccaggaggaagccagcggagctcctcccgcaaagcagggggtgggggatgctgatttttccacgtctgcttttctgatctttcctgccccttgcacagttaggattctgtgaactgggcattggagggattggaggggtcaagaccttaccaaaagcaatatttctgatttcacctacatttcagccaacctggtcctcagcagttaacctcttcccttcctcttgatggttgccctgctgggctgggtctaaggtcttccccacgctgggctctggaggcatctccaaccaccctgctctgtaagtgggaactgcgattagatgtgggatgaatccccgcatggctggatgctgtgctcagatgcctgagtccacgtttgccttgggctgtttcctgagaaggaggcagaggctgcctttacagtcttcagtgaattataggaagaacgctctctttttctctcagttgctctgctggggtctccagagtggcctgggaaattgagcagagggaaatgtgggctggcagagcgtgagtgagggtgagtttgggtacctttttgtccttaagtgcactttctacatgttggggtgaagtgctactggctgggaagctgtatgtgtggtaggagtgtgcatgtgcgtgtgtgtatgtgggtgtgtgtgtgtaggtcctgacatcatgtggagctgcaggcaggagtccagccaagactcattggtttggtcatactctgctggggaaccatgcaaggctgtgtcgcttaattgggaaagaaatttctttcttcttcagacctgtgggaggcctctgcttccttcagcttgctgttttctcactagtgtctttttttcttaaattaatttacagagacatctcacttcacttgcatatatatgtgtgtgtgtatgtatatatgtatatatatgtatatatgtatgtatatatgtatatatgtgtatatatgtatatatatgtgtgtatatgtgtgtgtgtgtgtgtgtgagatatatatatatatatatatatatatatatatatacatgcgagtggaactacaggcacccaccaccatgcctggctaatttttgtacttttaataaagacggggatttcatcatgttgaccaggctggtctcaaactcctgatctcgagggatctacctgccttggcctctgaaagtgttggggttacaggcgtgagccactgcgcccggcctccctctcagttctaaaaaccgtttttcttcttttcttcacatttctgtctctcctgtgatcgttcattcctttacctccacgtattgggcatatactacatgccaggcacaatgttagggcctggggacacagaacaaaacaggcatgtttggagtttcagcacatgctgttatggagctttgtaccaagggtagtacagagaacatttagacatttaaaaataaaattaataaataattataaaatataaataatatcagatagaatcaatgttatgaagaaaattgaggagagagaggagatagggcattagtgtgagagcttctctccatagggtgtatctgggtgaaagatgctcttagaagatccccggtgctgattaggtttgaacccaccggaaatatttttcccctggtggaccggttctgaggttctgaggtgtctgaagctgcggtgggctctgccccgtgccgtgcagccatccagatgattccagagagaggcctctgccaaggcccttgtgggctttgcctcgcccttttcgaaagtgggccctgccactgcctttactacctccctgggtcattccctgcagtgcagcctctcccctgagtgccacagaccccattttttgaaaaggtatgaaccaccaaattgctgcacagaaaaagggctttcccactcttcactttcttcggcgtatctgctgcattttgcttgttcttcaagtcaataaccatcaactcagaaacaagtatttatcagatactttctttatgttgtagatacagtggtgagaaaaacagagcaagtccttattctcatggaactcacctgtagtggtggcagactaaaaagcactaagcaactaaatgcagatgtgaagggtgacagtagtgggtgttgggtacggggcggggggcacagaggagtcacgactcttagggtggcagtggtgggtgctgggtatggggcgggggtgcccgtggggcatagaggggtggacagctcttagggtggcagtggcgggtgctaggtatggggtgggggtgtcagtggggcacagaggcatggacagctctttaatagcgggtggaggctggagagggcctcctgtactaaggggacagtgtgatagagacctaagggaagtgctcaggcacatgtcttgcacatgtctgcaagggacaatgccccagttcagatgaacagcaagcatgtttgaagtacagcgcaggctgatgtgactatggcacacaatgtgaggggaagggggtgggagatgaggtcagagagcagctgggcacaaggtagggtctcgtgaccactataaaggctttgccttttactttgaatgggtggagagtcactgggggtggggggaggtttagaatgaagcgtgacattacctgtctcttgttttaacaggagaggagaactgtggctattggtggacaatagacagctggagaagggtggaaaccggggagcagtgttaatattactgcaaaagtccaaagaggagctgatgaccagttcaatctggaaaagttaggaaaggcttgacatggagcctcagagtccttgggctaagtgatggagaatgggtaggaacgttccaggcagacaggaggatggggtgcaggcaagggtgtgctggaccatctgggaagctgtagctaaggtgtcagtggagagatggggccttgattgtggaaggtaccacagtaacaggctgcacattctttttgagcctacaggaacacttacaaaaatttcactgagccaaaaagcaaatctcaaccaatgacaaatagtttatacagacattgttctctggccacaatgcagcatttgaaataaaaaggtagtagatgtctcaatacatttttaaatttagtaatcacttacttttgggtcaaaaagaaatcatacttgaaattagaacatatttaaaactggtcaacaggccgggcgcagtggttcacgcctgtaatcccagcattttggaggctgaggcgggtggatcacctgaggttgggagttcgagaccagcctgaccaacatggagaaaccccatctccattaaaaatacaaaattagccaggtgtggtggcgcatgcctgtaatcccagctactcgggaggctgaggcaggagaatcgcttgaacccgggagatagaggttgcagtgggccaagatcgtgccattgcacttcagcctgggcaacaagagcgaaattccatctcaaaaaaaaaaaaaaaaaccaaaaaacaaaaaactggtcaacaaaaaagaatggaggaaaaaacaacaaaaaatggagggaaaacaacaacaaagctataaatgcaatgcaatggcattcagcatttcaacaggacttaaagaaattgacagctgatttttaaaagtcctataccagattaaagagctgagaggagccaagacagtttggaataatagcaaggtgttgggagttgctcagtcagttaactaagacttattttaaagttatactaaagttacaggagttaagtaatattggcatttagaaatgaagatgttctggttcaggaatacactaaaagtccaatggacaaaacagagaacctagggatagaactgtggacctacgggcacttggcgtctgatagaatcattggaggaatcatggactatttagtaaatggtgctgggaagcttgactcttcatgtgggatcatttaggaatgctcatttttaactaaaggtggcttaaaccagagcttgttaaatttgaatgtgcacgaggataacctgggtcttgttaaattgtagattctgattcagtacatctggggcagggtctgattctgcagttctaatgagatcccagttcttggcgatgttgctactctgtgaattgcactttgattaacaagctcttaaatcatcagaatattaagtgctcatttaacaaagagttggtctctgggatattctgggagctcagtgacagcagcagaaatccaggtgccttttatctttctgcttggtggcacaggttgactttttgttttaatatttgtgaccttattgccccatactatctgccacaattccagatatcacacttcaatcccatgcaagaagtgggaggagatgacaacaggaactgtctacttgagtctgtctctatcaccaaggaaatagtactaatattcccagaagttccaagcagactttcatgtaactgtcatctggtagagctgggtcacatagacaaccctagttagaagggaagctgggagacagagtgtattagtttcctattgctgctgtaacaaattgccacaaacttagtggctaaaaccccaccaatttattttacagttctggaggtcaaaagtgctgaaatcaaggttttctgggcagcaatatggtccttctgcaggttctatggaataatccatttcctcaccttttccagcttctagaagccaccttcatcccctcaactcctggctcctgctccttcctctgtctttaaagctagcaatgtggcatcttcaagtccctctgtctctgtgacctctgcctctgtcctcctgtctccttctcactctgactttcctgcatccctgttataaggaccctcctacagaccactgagcccacctggatgatccaagattatctgtctcaaaattcttaataacattggcaaggccccttttaccatgtaaagtaacacagccacagattctagggattagcatgtggacaccttgggcgaccattctgtctacaacagaaagtacttagattccccctctccagcatttatagtgggcgatgtgtaaaagagaaggggattagtttgtttagccaatcaacagtgtcatttttttcaatatggaaaaatgttaaaattagttgcctacctcatactatacacaaaagcaaattccagagagattaaagttctaaattgtgtaagaaatatttagaagaaaataaagaatatctctttgatgtcatgataaaaacagaatttttaaattaaaaaatgcacagtgtgctgagaccagctcagtcgtggagaccccaacccagtggtgctagaggaatgaagacacagacacagaaacagagtgcagagtgggatcagggggctgacagccttcacagctgagagccttgaacagagtttcacccacctatttattgacagtaatcccgtgataaatatcttttctgcagtttatagattaactaaaagtattccttaaggagaacaaagggacaggctctggcttgttatctgcagcaggaacatgtccttaaggcacagattgctcatgccattgtttgtggtttaggaacacctcgagcgattttccgccctgggtgggccaggtgttccttgccctcattcaggtaaaccagcaacctccagcgtgtgtgtcataaccatcatgagcatgtcacagtgctgcagagatcttgtttatggccagtttctcatggcctgtttatggacaggcttggggcctgttcccagcaacaatgcttaaattatgaaagaaagggttgataagagtggattaaaatttagtgtttttgtgtgtatgacaaaagacatatttagaaacctaaaaataggccacagactgtgaaaagatctatgagatgtgtagaatcaacaaaggtttagtaaccagaacatatacatcatttctacaaagcaataaattatactaaatatccatagggacaactgggaaaagaatattaactaaaaattcacagaagggccagtccaaataaccaacaagcacatgaaaaaatgtaaaacgtaaactctgacagctgaaaacattcgtgaaatactgttttacccctgtcagattggcaagatcttgaaggtctgatgagattaaggtctgaagagatgcagacatcctgaggccaaagccccagcaagctccacaggctccaccttgctcatgggcagttctttgagctgcactcggccactctccactccagctgcactgccttccctgctccttccccaacaggccctggcctttgaacttgctgctccctctgcctgcaacactctttcctcagagagccatatgcctggctccttcacctcctcaccacttctgtcttgcttagatgtaaggcactgagcactttagcacctttcccatgtgtgttagccagggttctctagagaaacagaatgaatgatgtgtgt

SEQ ID NO: 317 - DNA, 42376 bp, Homo sapiens
ctgtcactttttaattcaaaaacacatttttctttatccacaaaaaataattttttactgcttgttaattcttgcatctccatccagttttactcctttagggcattataagaattatttttcttggatctgccttccaattcacatatattttgtcttaatatttctatctaattgtgtctctgatttttatactgataggtacttttcccattttttattcatgatattaattggttttgtggcacaagtttttaaagttttattttcttcaactcctattttgattctttttttcccaacatcctacttctctttgcttgtttatttctttggtctttttgacatttatcttggtctctagaagtctcccgcgaacacacagaggcccaagactgcttacacacttctatttaaaagagaggcctaggaaggtaattaaagcttgcgtgaataaccgagtcttaacagccagtgtgtgtcatttaagggtaatcaggtgacaaccgccatctggccgtttcatcgtggggtgggggggggcccaagcatcagcataagtatatatgttctcagtgatggttaagtttcagcaaaaaaatctcatcaaccttctgctagggtgaaaggtatatgactggttgacaatgttccgaggccccattggaaggcggaaacaaaggattttgtagttcaggatattaactttcagcccatcaacctgttttgagtaccgtattgcatgcctgcacccaacgcccagagtctggggtgttctgttttaatttctcttgacaccccggctcccttaggggagaaggggatgttgagggagactcactgacctgcttcacattccttcagtcaacttttgtgttcttaccttcactccttatttccaccatgagagtttcactatgctttgaattactgggatttccacaattaagcaatgcaaattattgaattattttgtttatcttatttctcatttgtaataacttgttatgtgaattttctttgtcatcagttatcacaaatacaccaactttattgttaaatattttttcatcatcattcatattctggggtctcttctgttttctttagggtctactgttcttggatgaattatacatacgaggcttcaatggatctcatacgttacccatagttttcccatttccttcatggaatttctaagtgtactagttaaatttgtttttctcttcagttcttaaagccatttgggcactgcagttgtatcttactgagtttgcctttgttgtgtaaaatatctttttttttttttctccctcttcagtgtaagccacctcttccagatgtctttccttcctctgtagatagtcggttctcctttgaggatggaaaccacccacgcagcttgccatttttattaacatgattttataattccctgttttcaagaacataactttacttgtgtttcgcttaggatcctaggagatgcttgcaccagaagataaagttgcaactaactttattgcttactccaaagactcatccgttcttcaataggaaaatcaaaagccagtttaaaacagtctaagactttctgaacaattcggcctcaaaattcttggcattgtctggccacaaattctaaacaattatatcataatctttccccaaattaaccaatatcctgaattgaaagatgcaccataagtcagatttttcagtctcaataaatatcctgaattgtgttttacctaatggttcagcacggattccctgtgggagtactgctggccctgggtgcataagcagtgaacctggctttgtcttttcagcgggctttttggtgatactttgcagaaccagcgttgaatatcctcatggaatagtcccttctctgccgactgatagtgtttcgctttgtcagcacccttgctggggaccaaattgtgtcctgccgcaagtcatacggtgaagcctgaagccccagggtgactgtatttggagacaaggcctttaggcaggtaattaaggttaaatgatgccatagggtgttgtccaacagacttggtgactccacaaaggaaatacaccaaaggaaggccagatgaggacacagggagaagttggccatttgcaacctagaagaaggcagaacctgaccgtgtgggcgccctaatctcagacttgcagcttccagaactgcgagataatacatctgtgctgtttaagtcacggggtctgtggtagggtgttatggcagccacggctgtaagaccacccatatggtgggtgcggtcggtgcccctggggcagtagccaacaggtggttaagagtgatgctgcttttttgccctcttttgggaagaaggaaatgatttgagggaatgttaccctctgctagtgaattgggttgaggcaccactacttcctgatcaattggcttcaagcagcatttctccctatttttgttgttgttgttgaaacagagtctcactgtatcacccagtctggaatgcaatggcattgcaacctcagcctcccaggttcattgcaacctcaacaacctcagcctcccaggttcaagtgattctcctgcctcagcatccctagtagctggaattacaggcacacgccatgacacccagctttattttgtatttttagtagagacggggtttcaccttgttgaccaggctggtctcaaactcctgacctcaagtgatctgctggtcttggcttcccaaagtgctgggattacaggcgtgacccaccacacccagcccatttatccctattttttttaatttcaagagcaatatgttgagatattgtcatcgcctttcctgctgaccaaagtcctggttggcacagcagatgcaggctccacccagtgcttggtattaaatcatcttaagccttaaaaagagacaggttttctcccctgacattagcccttcagtttttgcctggcaaggaaaaaatgaagaagtgctgatgacttttttctctagaattcctgaaaaagtatgtagtattaccccaacttttctgcatattctctacacttctcttcttgaatttatgatttctcattttctttctttctttctttcttatctctttctttctttttctttctttcctttttttttttttttttacggagtcttactctatcatcaaggctagagtgcagtggcatgatcttggctcactgcaacctccacttcccaggttcaagcgattctcctgcctcagcctcctgagtagctgggattacaggcacctgccaccacgcctggctactttttgtatttttagtagagacagggtttcaccatcttggccaggctggtctcaaactcctgacttcgtgatccacccgcctcggcctcccaaagtgctgggattacaggcatgagccaccacacctggctatgatttctcattttctttcctgagaaatgcatccatcccagactttgatttttcaaaattttgtgtattttttcattgcccaccaagtgaaagtcagcatagattattgattaactgtaaaaaataaaataatatatgtactagaaataactttatgagaaaaagtatgtaattttgttatggagatgtctataccagtcatatttacttttctctgcctcctactactgttggttgtttaatttccatacacttaatttttaaacactggtgtagatcatgctgatatggtttgctctgtgtccccacccaaatctcatcttgtaactcccagaattcccacatgttgtgggaggtatcctgtgggaggtgattgaatcctggggttgggtcttttcagtgctattctcgagatagtgaataagtctcacgagatctgatggttttaaaaatgggagtttctctgcacaagctctgtccttgcctgccaccatccacataagatgtgacttgctcctccttgccttctgccatgattgtgaggcctccccagccacgtagactgtgagatctccattcagcctttttcctttgtaaattgcccagtctcgggtatgtctttatcagcaacgtgaaaacggactaatacacatgccatccatttttccttctctggcatagttttttttttttcagttatttcatctgtatatatttcagtattcatctctaaatatagtgattttaaaaaacatcattttgcaatatgaaaaagataatttctttgtatcatcaagtacccaactgtgttcatattaattgttcatattatgaacacatattaactgtgttcatattaattctttcatgaaaagacgttctaaaatgtaaagttcaatctctcgaaactttcctttttgattggtgctttctttgtctgattattgaaatctttctataccgtaagggcatgaagatattcttctctattttgtactagaactattattatttgacctttacatttaggtatataatgtgctagtaactgatgcttatgtattatgtgtaattggggtcaatattcattttttctacttaatatccaattcactcagcatcatttattgaatatatcaacctttccctactgaacttctgtgtactctttatcctaaatcacataatttttttccccatatacttgtgggtctatctctaaaaacagaattttgttatgtctgggaaacagtcaatgtccccatggggcagcctttcttatggaactgacatttttatcagaggcagatagtctttcttttataagcagaaaatattttattgtcctcaaaattgctaagaatgaattaatcctcatttgctattaatttcaatgtactgttcccacacccagtaataataaatgtataattatgtttcccttgaccattgatttcagttgtgttttctcacacctgaattattttattagttatctacttctgagaaacaagttacactaaaatatctcaatctaaatattttaaagtactagctatattgtttgctcgctttgcttatggccagtaatttgggtttgagattagtttggctattctgctgcagtccttggaaaacagctcactggatggcagtaacctcaattctccacccagactgggtggtgtaaggtgtccacactcgtgcctgtgctgcttgggactggcgcccagctagggttctctccacatcatctcttatcctccaggaggattacctgggcttattcaatgcgaactcccagtggaaaccccatttccggcaaaaaagcacaatagaagccattagccatgagactgtaaaataagaaaaagaaaaataatcgacagaagaataaaggtgttccagggcaagaaactaaaacatatttctaaaactgagctgcagatagaattcctggtttcctggtagttaaagaaagagacaaagtgtaaggagttacacagttattgtcattagctaaaagaaatttcatatttgtggcctaataggcatggaaataaaatgctagaaggagcagggcatgatggtgcacacctgtagtcccagctactcaggaggctgaggcgggagagtggcttgagcccaggagtttgaggccatagtgagctatgattgcaccactgcactccagcctgggcaacacagtaaaactctgggaaatgaagagacaaaaaaaaaaaaaaaaatggcatggaagaaatgtcagatggaataaccacaaagtaatgaatattccccaaataatgaatgtcatgaaaccaaaaagttaacttacttcccaaatggtacattgtgtggaagctattcactgcacactaaaacaatagtaaaagcaatatacctctgaattgttacataaaacatacagttctaaatgggtgtgtttatttttatacacaaacatgaatataatgtatgtagaaaatgtgtggtatatagaagattaagatatgttaggactctagctccttcaggaactcacttctatatagtgccttttaaattattgtcacacctcctttaactatagatatagtaatagcaatcttcagtgatccacaatgggttatataaatctcccacttcaaaaccttaatacagaattatgtttctgtgaaaaagttaacttggtgttgaaaacaaaatgtattttcatttttccccttttccctatattacttaaaacataataatttattgttagagggcattcagtggaccagtgacactatttactttaattcaggtaaaatagaaatattagcacaatttatttattgaaatatcaaattgaaaacagacaaaaagtcagtgaatttgagatctattacattttccagtgtactaagagttaaacatgtattctgttgtaatattactctaatacttgatacattatctattcctcgttcaagtgattcaatacaaattttattttgtagcattatgaagatcagtaatgtttcaaacagtggagtttcaaactttaaaaatgtgtgtgtgatgtttccctgaacccatatgcaaaatgtctgagaacagaatagaactagcattcagatcttggttctgaatactcttctccagtataaggaatcagcgctctttgaagaaatgcctgattccacctctggggcaggacatgagcaagatgagcctggggcatcttacagtgcctgaaaggaagtgctcaaaaaataaagggatggggacatggtttggatctgtgtccctacccaaatctcatgttgaattgtaatccccagtgctggaggtgaggcctggtgagaggtgattagctcacgggggcgttttctcatggcttatcaccatccctccccctgctgctgtcctcgcgatagtgagttctcctgagatctgcttgtttcaaagtgtgtggcatctccccactccctccgtctcttgcttctgctctggccatgttaagtgcctgcttgttcttcaccttccaccacaattaaagtttcctaagatctccccagaagttggcagatgccagcatcatgctttctgtacagcctgtggaactgtgagccaaggaaatgccttttctttattaattacccagtctcaggtagttctttagagcaatgcaagaacagattaatacagaggggagcttgtcaaaggctgtagggcccaactggacagagcccccagaggccaaaaccagaataatctggattatgaaccaaagcatgaaacacattcgcatgagtccatggagatatgaatacatgattgccaaaatgaataactaggggagaaaaagatcccccataggaagaattccaaataatgtatgagctgctctctgttccaggaggtggagatttactccctgctgtggcctcctgagtgcttggagacctgtttccaaagagcaccacgtgagcggggggaaaccacagccttgcctcgagcagcactgccgcggccaggccaccaaggccgcatcatcagtgactcgggacgctgatagcgcatcctcttggcatggcatgttgagaagggcactttacctctttagtctcccgaaagcccgtaaccccagtctaataaggagaaaaactatcagacaaacgccaaattaggggcgttctacacaataccacccacctcctcaacactgctaacgtcatcagacacaaggaacatttgcaaaactaccatgaaacagactaggctaaggagaaatgaagaccaaatgtaataaagtcccctggatgggatcctgcaagagaaaaaggacattacgggggaaactcatgaaatgcaaatgaagttacaagtgtagttcataggaactgccattgtcggacccatggttgtgagccgttgcccacagagacctaggatgcaatgaggcaagagtggaaaccaggcaagggatgaacagaaattctctgggccgcctctgcaatgttgggcaaatctaaaattgttctaaaattaaaagtttacttaccccaaaacaaaacaaaaatcacaatagattttaaaacattttcatacgattgcttggatacaatactcagcagtccatccaagtttgcagcacagtaatacaagctcaggagtggaagccaaaatgaaaaaaaaaaggaagcagagcatgtacagtggggttccatttccgtaaagctcaaagccaagcaaagccagtcaacctcccacttaggaagaggccggcgaactagcaaacacctctagttatacagcaaagcccagatagctttgacctatggcggggtgatcaaataagggtgcagaggtagtgtgaacatgacgtatagcattctatgtctaaatttggagttttaaacattgctttactatcatcttattcgttattattatttacccatatacatgcacatatatatttagctggaaatgtgatttactatgcataagttttatgtatatatgcatatatatattcagctggatgtatatgttttatcattgttgttttgttagttactatacatttatttattaaacttttatatttgtatgtataaatacatttacacacataaaatacagatatatttttgtatattatctgtatagttttatgaatatgcagatagattttttgtatttcacagatttctattatttatatataaatttgtaatggtcatgcatttataaatatacaatacaatttagctttatttttgattgcacatattgggttggatatagtcaatacaatgttttaatggaaacaaggtgccaaaagcaatatcactgggctgaacagaattcagaccagactggcagcatcaagtaataagcaaaaatgtaaatctattgtgcaattattatacaacttttttatttttaattttattacttttacttattgagttgaaagttttttaaacatcatcagacatatatatgatttgttggtactgtccaccaatatttagcttgtcttttcatttccttaggggcatcttctgaaaagcaaacatatttaatttaaatgaagtccatttttttttcactcatggtttatttggtgttatgtcttaatcatattgcttcaaaatcacaatgcttttactctatggtgtattagagaaggttcaaaattttaatccttagatttagatctgtgatccatttaagttaattttgtgcatagtctgaagtaatgatctaggattaatttttccacgtgtataagcaacttagaaccatttgctaaaacactattatttccctattgaattgtctttctatgtgtgtaaaaaatgacctgatcataaacataagggtttattcttggaccgtgaaatgtactcctttggtctatatgtcttaactttacgtaaatactagactcagtgatatgggttggctctgtgtccccacccaaatcttatctccacctgaaacccctgtgtgttgagggagggaggtgattgaatcatgtgggtgatttcccccatgctgttcttgtgatactgaatgagtctcaagagatctgatggttttataagtgtttggaagttgctcctttattcttctccttcctgccacctcgtgaagaaggtgcctgcttcccctttgacttctgccatgcgctgtatcatttttcattccaatgaattatgtatatgagtaccaacactccacatcttcctactcattcgtctcattgttttcaaatgttaaccatattagtccatctgtaggaaaatatagtttgcattttatttatgatgcacattttatttatgatgtatagctgctttcatagctataaaatctggctggtggctcatgcttataatcctaatactttaggatactgaggtgggaagatcacttaagctcagtagatttagaccagcatgggcaacatagtgagaccccatctctacaaaacaaacaaacacataaatatacatatatatatttgtacatctgtataaaatgtatatatgtgtatatacaactgtgtatatgtaagtatatacacacatgtgtacatataaatagatatacacatgtgtatatatagatagatatatatacacatgtgtatatatagatagatatatacatgtgtatatatagatagatatatacacatgtgtatatatagatagatatatacacatgtgtatatatagatagatatatacatgtgtatatatagatagatatatacatgtgtatatataaatagatatatacatgtgtgtatataaatagatatatacatgtgtatatataaatagatatacacagagggagagagagagaaagaaagagagacagagaggaaacctataaaaccagtagatttaacttcatttgtcgaacatgcagaatgagacgtggccttcagcttatagattgttatgagaataaaaaaactggcatagttcaagagataatgtctcacatagaaaggtatttaataaatttgagtttctttttttatttcataaaataattctacggtatttatagcatgatatgaataacagcatactgactccagtgacatttatcttacatcttcttatgaaatgaaaaccttcactttcctcatatatcaccaaaagttattttagaatttttctgagattccttccaactttaatattataactcattgaacttatgagtttgatgttctgctagattaacttttattttctttaagcagctaaggaatataattatgatttccaaaaatattattaaaagcttgaaatcattccaggatatgactatgtgttatgctttggggaaaaattgctaatatttttcagtactctttatgtgacatgcactatgctaagcacatgcattaggtcattaaatttttaaggaaaccagtgataaatacttgtgattatccccttaagctgacaagaaaactgatatttacaatagtatcttgcccagtgttgctaaactagtacagggagaggataggattttttttttttttttgagtcagagtctcactctgtcacccaggctggagtgcagtggccccatctcagctcactgcaacctccgccccccgggctcaagcgattctcatggctctcagcctcccaagtagctggatttacaggaacacgcctccatgcccagataatttttgtatttttagtagagacagggtttcaacatgttggccagattggtcttcaactcctaacgtcaggtgatctgcccgcctcagcctcccaaacggctgggattataggcatgagccaccgagcctcgccagaatgataggattcttatttgagtaaattaaaactaataggaacaacatgactgaaagaatattaagaaatgtaaacttaaaaaagttcttattattcataaatactttatagtaatttcagaatggttgagttcatggaagtttgtaaggttaaaacgactaagagaaattcttgtggtagcatttggtatcacatgaagaaagtctagccaagatgatgtatacatgtgtatatatgtatatataatgtgtatattctacacatcataagatgatgtgtagaaatgttagtgaaaggtattgaagaacaggctcaattctctgcggggaaaattctaatattaagaaacatcgccaggtgcagtggctcacacctgtaatcccagcactttgggaggccaaggtgggcggatcacctgaggtaggagtttgagattagcctgaccaacatggagaaaccctgtctctactaaaaatccaaaattagctgggtgtggtggcacatgcctgtaatctcagctactcgggaagctgcggcaggagaatggcttgaacccgggaggcggaggttgaggtgagctgagatcgcaccattgcacccaagcctgggcaacaagagtgaaaccccgtctcaaaaaaaaaataaaaataaaaaaagaagaagaagaaacatcaatagcaaaaatgataggtaacacctagcacatggcatgtattaagcagtgttttaaatacttacatgttaacttattatgtttctacaacattctacggaggggctattctcgttatctccattttcagatgaggacattaagttgtaaaatcacacagctgccttgtgcaagagaagctctttacccaaagtggcatgtcctctgattcctgacttttaacccgtctgctatgtgcgtaatgctgaatcatttcttcaaaagtctgcttttgaagttaaaaaaggatttaaaaatgtgtagcagtatgaccagtataggcattgaagtgaagatttctcaaaatgagactaggaagccgcacaggagtgaatagtatgaggtgaaaatgcatctactttcaccgtgaccattttgggattttgatagtaacgcttccctgtggatatatcttataaacagtgactagatgacatgagataaagtgttgggcaaataggtggcactctggcctagtatctctttttgtgatgtctctccattttgggggaatggacccatatttaataaattcctactagaataaggaagtgcaagattctgaaggaaaaacaaaatagtaatgtgtccatgaatttgggagacttctgaacacagaggagacagagaattgctatgtgaggtgggcatggacaaaggaaacactgacttttacagaagtataaggcgagatatgatgattcctatattcactgatggtagtaacccatgcatatttgtttactttaatgtataactcaaatagctggaaggcaaggagaatccaagagttggacagacggtacattgatgagcatattatgagaggatgatttagcagcagggcagcgttgccaccgacctgccatccccagcatggaaaacgttcatcagagtcccacacactccactgatagccttttgagaaaactgaagggccagagagccaacttccatgttccatgccattgctgctatttcagataaaattatttttagcacctaactgtctttcagaactactgtcataaaaccacaggttttgagaatttaaagatctcattgtccacccttacaagcttaatgcatgacgcatctgagacctagtgaaatgaaataatgaaataagatgcctaaggctgcagagatattccacgaaggaaccaagataagaactgcattttgttctgtttgtgaaatagttacctgagtccaaaaacaactcctgtaaataagaatgaatacagaaacctatcatgtctgaaggtgtacaaaaccactgtgtgtggttctagattgtgagttacaccagaaacaggagacagtgaatgaaaagacaggtgattaaggaaaaaagataattatttaagtccaaaggtgatactagaattgctgtttttaagcagacaataaattttgctgatacatagtcgatgaattttttaatctagttattaggattgctaatccaacttttaaataatttcaaagcagaagaatttacagacatggtggattaacacagtgtagctagtgtttatatacaaaacctgcaggtgggttatgagggaatcgctgttgctacggaaaacgctgaaattaaccactaacataagtagaagtagactcgactttaaaaaatgaaggctcaaagtaacatgactagagacgaagttgtcattgtttttccttgaaatttctcctgggcaaacatcaaagggcagaacaaggctgaagtgcaacaactcaagagaaaattttcttccataacaggctcaggcaggtgcccagacctggtttataaatgcccaacgttggccgggcgcggtggctcacgtctgtaatcccagcactttgggaggccgagacgggtggattacctgaggtcaggagtttgagaccagcctggccaacatggtgaaaccccatctctactaaaaacacaaaaattagccaggcatggtggcatgcatatgtaatctcagctactcagtaggctgaggcaggagaatcgcttgaacctaggaggcggaggttgtggtgagccgagatggtgccactgcactccagcctgcgagacacagtcagactccgtctcaaacaaaacaaaacaaaacaaaacaatgtttaggaacttatggaatatttggtgtttggggattaatgaggtgaattcgaagtaaataaaactgaagatacactacaatttttaggtatctgtttcagctctgtgatttcaaacctacaaggcaaaaataatgaaaatcaaatgttggttatatcttagcattgcattttatctgaaaagcatacatactgaaaagttttatcacaaagaaaagatttcaacgttattctgccaaagactaatgcatttcgtggaccagttgctgttttccacttggaatccacgcacctgacaaatactcaatggcttcgtcctctcgcctaaggcttcgaatctctgaagcatatgtccagataattcatattgaatacgaccctttgaatgtggagaaaaagaactgatgacaacctcaaaaacatcataaccctgaaaattgtaaataaaacatgaaatatgtgaaggaggcatggtaaaaatatatagaaaccaaaagcacaattacatatatgcatttcaaaacacactcattagaatagtccacaggttgtctgtcctcacaagcgtctcagtgttcattaacatctgcccatggactacagcttatctctgaaacagtcagaagtctaaagggaatcggcaataataggactgctttagcattttttaaatataaagcacaatgaagtcaattgttgaacggtgtctatccttacttctctgggtgtgtgactatattttacctggatgttggctccataatccacagatattttatttttctctccattgctgtattcccagcaaagaaaaaatagtagttactaaaaaaaatttattgaatgaatgaatgaatgaatgattcgactgtacctggtgggcatgtgtgtgttcttttatttggtaaaataagaatttttgggaggctgagacaggaaaattgcttgaaactgggaggcagaggttgccgtgagctgagatcatgccaccgcgctccagcctgggcaacagagtgagactttatctcaaaaaaaaaaaaaaaaaaaaagaaaaaaaaattatcacctttgaatcagtatccttttttacaaaaacacttactctactgtgaatcacacaaaaggctggtagtcactgatgtatagcatattttaattccaaacttaaggtaatacaaacaataactctatgggaaattgcactattgagatgccaactattgacagtgtttaaaaaaaagtatgcccatataggaaattgcatattaacatattcagtacacatataatattatccattttctttaaaaaaatgccttgaaaggaatttttcagttcattacaagttatgtttttattccaagaaaaataggattttactgtgagtaggttgggtgattaaacaaagttccagcttaggttatcacccatttttcaaacaatgctgcagggcgtgaggctaactggagaggcaggaagaatgattgtgtttattaggcactgggcaggctttccttttcttacctttgagttgcccgggattttcactctatcccttcttagcaactccgcatttcaattaggcatccaaagggaagcagagaaaatacagaactctctggactcaggcaagcagagcctgtggtccccctaggacactggactggaatcggctggaggagaatcacgtggacctcaaagctcagaggtgggaagaaggcttcatcctagcagaagctcaagtgttctgaatagaatccacagccaccacacctgttaatgcaagggaattccgtgtcctcggatgtctcattgcacctttgcccacatgtgtctcccttttaggcataactgttaggacctgggttggaaaagtgattccaagaaaaggggtacagtgggcatttctgcctctggaataggcagacacagtgccaatgccaccatcggggctgtcttgtgacgcctcaggctagaggtaagtggggaagggaagctgctcctgtgactttccaaccgaatttataatggaaaagtcgtgtgtttccttgttctttacgcttgctgtgtgtgaaccattctaccttgtttcttaccatatggactatgggtttcacatttagatcctgaggttaaaaggatgatttttaattacccacagacgggctggggtgatttttaattacccacacaatacagtgtgtattgcatagcattccttttcttagaaaaaaaaaattccctagtaaaacttggttgaaaatgccgtctcttctgcatcccagtctgcactagatggtcagagggctcactcacacaagcatgggattcgccaagaatatatactcagttttgctgaaaatctggtgttttcaggacatttcaataccaggtcagtgagagagaatacttgagttctggtttatcaaaatagtttcttttgagtgggcaagttaatgggtacagccaactaaaattgtttccaagccctgggttatatgcacacataacgttaaaatgttttagagaaatatagtttcagaatgccacgttataggaacatatttatgcagggagtaaagcaaaagagaactcggaacttttgtgggttgcaggctgcatcacgctgatgagtatactctaaacaagggaggttagagggcaggagaaagacctgagccagtcctacaggtgagaaaacgcaccaaccctcagtggaaactccaaccaacaaacattatcaaagtccttaaaacgcaccaaccctcagtggacactccaaccaacaaacattatcaaagtccttaaaacgcaccaaccctcagcggaaactccaaccaaccaacattatcaaagtccttaaaacgcaccaaccctcagtggaaacttcaaccaacaaacattatcaaagtccttaaaacgcaccaaccctcagtggacactccaaccaacaaacattatcgaagtccttaaaatgcaccaaccctcagtggaaacttcaaccaacaaacattatcaaagtccttaaaacgcaccagccctcagcggaaactccaaccaacaaacattatcaaagtccttaaaacgcaccaaccctcagcggacactccaaccaacaaacattatcaaagtccttaaaacgcaccaacccttagcggaaactccaaccaacaaacattatcaaagtccttaaaacgcaccaaccctcagtggaaactccaaccaacaaacattaccaaagtccttaaaacgcaccaaccctcagtggaaactccaaccaacaaacattatcaaagtccttaaaacgcaccaaccctcagtggacactccaaccaacaaacattatcaaagtccttaaaacgcaccaaccctcagtggaaactccaaccaacaaacattatcaaagtccttaaaacgcaccaaccctcagtggacactccaaccaacaaacattatcaaagtccttaaaacgcaccaaccctcagtggaaactccaaccaacaaacattatcaaagtcctcaagcacttactgaaaaagtttctgacttttttctgcctgagagagtatcgtaattatgtgactcagaagatgagattttccccctttggatttcgtaggtgttcattcctggtagtttttattttttgctttgaaacaagcaattgccttttcctgaccttgacataaataatcaacgtctctgagaagatcgtgggttatagtagagttacctgaaaaactttgctgaacagtatgctgtttgacaacgtgcatctgctgtttgcattatttaaaatatgcaacaggatggtactgtgctctgtttacaatatgcaaacgtaagatgcttcaaccttgacaatgctgctcaaattattcctcagtgtcaaattctccagtttatccatgtaaattacacataataattttatagacagatatttgtggttaagaataagctgttaaatctattattccctattcccttctcaaacaccttagcaagtgtatgccattattattatttccattttaaagactaaaaagctgaggctataaaagctgaagaaatttgccaacaatctttgcaacttttgcatggctagtcctgtggtcaagttctaatcattgaaactgttgtgattttcaggggaagcagtatgaaataatgtttgcaattctaggtaaatataagtaatatatgatcaaattaatacgcaataatccaataatcaacagcagctcaaaacttgtatcctacagcttttaggaagaatgtacgtaagaaaatagctctgatttccctgaggaaggaactgcatttctcctaaaaaagaattcttaggtatcaaggaagaatatgcatctatattctttgtaacaaatgtatattcactttttttattttttatttatttttgtttttttgagatggagtttcactcttttgtccaggctggagtgcaagggtgtgatctcggttcactgcaacctccgcctcccagattcaagcaattctcctgccttagcctccctagtagcttggattacgggcatgtgccaccacgctcgactaatttggtatttttagtagaaacggggtttctccatgtttggtcaggctggtatcaaactcctgacctcaggtgatacacccgtgttagcttcccaaagtgctgggattacaggcatgagccaccacgcccatcttcacattttaactatataatttttttattcacattttaactgtataaataaacaaaatcctagtaagcaattctccccgatatatattaaagagtttgacccactaatacaatcaaaactggttgattagaatcttagtttctgaaagtgtttagtttgggaaggaaaaaaatgtgctggagggaaaagaaaaaacaaatgcaacttgattatatgtagtttgtaccaactgagggaacaatcataatgcccccaagatattccaatcctctcaggaaaagtaaccttgtacatcacaattagaaaatgtgtgggtaggctgggcgcagtggctcacccctgtaatcctagcacttagggaagctgaggtgaatggatcccctgaggtcaggagtttgagaccagcctggccaacatggtgaaaccccatctctactaaaaatacaaaaaatttgtcaggcatgatggcaggtgcctgtagtcccagctacttgggagactgaagcagaagaattgcttgaacctgggaggtggagtttgccgtgagctgagatggtgccattgcactccagcctgggcgacaagagagaaactcagtctcaaaaagaaaaaaaaagagagagagaaaatgtgtgggtatcaaatctcgtcgaaatgcaccctcataactggtccataacatttcaataacacatttgctatgacttatcttgagtgtatttaataaatatgcagttttaagaagcaaattcacaacaagatgtagaccaagttaaatgcttctataaagatgagctagtgtattaattctccttcagcaattttggggggcagtctttatataccttccattatggaagacagggtcaacaagccatttatggtagctgatttggggggaaaagtcatagtcttcatcacctgaaattggtaatatatgtatactttaacgttttatgattccaatttacttcatggaggctggctatttgtatatttttgtactcaagaaatttaaagaaagtttttgacatgatccaaaaataaccaaagtaaaaggagtttgtcagccagtgtttatctaaattaatatttattgcagaagaccaactttcacccacccactcttcactaatttgtatgaaaaactcacacagacaataatgggaattccgctggcatttttctggataactatgattttctcacatcttttgaagaaatggaatcatctaagacaacacttctgtcaaattagtagcctgtagtatttgcttgtgattttctatttcccagtggttccaaaagctgatagatttttctttttgcaaaacatattgcaaatatatgtttctaaaatctccccatgttgacatatgacaaatagtgagtcttataagaacaaatctcctacagatttacagacaaatagaaagatatatccacatggcttattaaatacagacaatattagtctctcacacttttagttttggtagataaaactgtttactttcgcaattaaagctgttctgtctacttatattaagtgaataatagaaacatatcaccttcagcataaaataaaatatgtttacgtaagtgcattcaaagagagaaccatgtcctaaggcatcaacagaaaagggtaagattgagtgttacggtagtctgaatgtggataatgatgcatagtgactgacattgaagagacaattaaaacgaatctggccataaaaagatacacaagaatatatattttatttttattctcgtttttagtctacaaataattttaaacagatgataagtttttcagttgtttctatcaataatagagtttgtaaactatttagaaaaagtttttgcatgtttccacaatctttgttttgtattcagattccactgtttatcatcagataatatcctataagtgtttcttatattatactttcaatagaaatactggtaatattaatatacattttctagaatacaaatatctgctttcctgaatatacattgaattttttatgcaaacttcattgcaaaaataaaagacagtaaagtagcaaattgttgtcaaatatagttacaatattcaatattatcatttggtaaataatactatctataaactgatataatatttcatttatttactatatatgagccaaagcttactgtccagcaaaacttgtggtcttatacctgacttaaaatacaaagtactatgatagatagtgctggaattttatgaaggacttccaatttcttctattaacctcagtagtgtctgctacttatgcaagtatttcagcatgcaaattacttctgataaccaaaaacatttcttgagccgtgtagcattgcataacaaaagctttagtaaatttattttattcattttgggaacagaagagtatactggctggacatcagtcatgcaatgatttccagttttgcctcaactggtgtggctggtgggacatgtgcatgtgcatttataccacttagggaggctgcaggacacgcctggtggctcacgcctgtaatcccagcactttgcgggctgaggtggatggatcacttgagatcaggagttgaagaccagcgtggccaacatggtgaaaccccatctctactaaaaatacaaaaatgagcttggtgtggtggcgcacacctgtaatcccagctactcgggaggctgaggcaggagagccacttgaacccaggacacggaggttgcagtgagccaagattgcatcactgcccttcagcctgggtgacagagtgagactctgtcgccaaaagaataaaaaaaggggaggctgcagggagtcaagcagcctagattccccctgttgtgttcatcaaggaaaggtaacagctttccaaatgaaaccccaaatctaagacaattaagaaaaaatatgtgtacttgtttctatcttagccacgtgaggtccaggtcctgcttcaacagcaaggtcctctgtgagtcacaacacaggacttggatgccataggttctggggctcatttattttcagctcatggtccgggggtgctttgcacgtcctcttctccattctattggccccgcgatgtgacaggagacaggagatgcgatgtcacttttttccaagtaggaagaactatgggcttaatgaatagcttgcaagttgccacgccggggttttcagtgacatgtttgtgtgcaggcgtcagttcccaaataacgaaggccaagatggcttcaggacattcattgttacacatccagggaccagggatcgtatagaaaatcagatcacagttctggattctcatcccagaaaagtgtgtgaatgtgcagacgatgagggcccacctagattatagacacatattccagtatttctctgtatagttctgctgatttgatggtgttctgattgtcttcttgttgcttgcagttaaagagctcctttttagtgttgccacatcagttctctaaatcctgatcgtctgagtcagaatgaggtgtgcctttttcattctgtgtctttcccaatcgatgacagagattagacacctttggggaactctttccaccataacggatgccacatgtaactctcagggcagagatcctcaaggagttcacacaagagacaaagactctttgccatcctcattctcaacagacaaaaaagccacttatggtcaaagtaatctattttatagaatttaatttagaagtgagataggctaatgactagttttattattaaaatgaccttactgttattcaaccacgttcattgtttttattccttatgctatgtttgttctagtcagcattatcctgagtaaatttacacagcctggcggaatccaccgtgcatttatactcaacccagctgacagccttcattatttatgtccttaaggatttattgcctttcaaccctcttgtaccagtttctgtatcagtgagtatcctaaatctagtttaagaaggcagggaatgtattaatgtgcattaggtcacagatctccagaagggtccatttgtcaagccatgaagctacacagtgatatgccatgttcaaagcccagggtcacaagcccagaccctgtggagcccgctctgggaagagatacagtcagtcctacagctggtactgaacaccgggaatcacaccccacactctctgagcttgggtcacctcgatcatccattttggggataaccatgtgctggtttctgaattagagctgaagacgcttcaggctgattattgaagactcaaaataaagtctcaggattcatgactttttctttggggaggtgtaacaagggaaatgccccaaacatagaatgttcaggacccatgtcacaggagaaatgtccactgtaaggattcgcatgaattactgtatcttcctggggtccatccaatgtgtccatcaatacgaggaaagaaggccatttcactgggcatggaggaaggttgacagaccgtgcattgacaaataccaagtacttgttctctctctctctcgctcgctcgctctctctctcgtgtgtgtattaatatatatatacacacacacacatatatggggttggggggtcaggcagactatgttttgggctgaaaaccccaggatatttaatgtgtgcttctctttgcttaagttcagcaaagagcttatctatctatctatctagctatctatctctatatatacatagatttatctatctatatctatctgtgtatctatctagcaataggtagcaaagaatttatatatctatatatctatcaatagatatatgtatctagatacatatatctatatgtatctacatcaatagatatagatacatatatctatatgtatctacatcaatagatatagatacatatatctattgatagatagcaaagagcttatatatgtatatatcgatatacacacacgtatataatgtatatacgtatatatttgtgctaaattattaaacatggatgtactttataaattaattagctcttatagacacttgctactttcctctttcccaaattggtgttttcttctttctatttatcttcatttcctctagtgtccagctgaaactgtaattcttcctctcaccccaccccatgtcttatgtagagggtttccaaatcctatcaaacttcctttccaagtgtctttgaagcccaactcttcttttcatttcgatatcactatcttagctggcccctcatcacctcaagtgcagattatttcaaaagccactaaataatatgaaggcttccagcttaatttttctgtcttttcattataattgctcttgggtgtatatttaatgtcttgtaaagtcagaaagagagttaccctaacatgagaatattttcataatgttgacttcttaataaataaataaataaatgtgattttccattttctaaatgagaaacttctcggtttttagcaatttttataatctagttttaatctgcctttccaaatatatcactttttccatcaccactaattgtctcttatccaaccaaactgcgctttttgttttcaaaatcacgacccgttcctattgtaagcccatgatcaccaaaatgtaagctcctcccacctggaatgtattccttgcttttccttctacctaaaaccatagaaatgattactatttctcagaatccttttccgacaccccagtggtgttatgtgtgcagcatgtcaactcatggtcctaattatctgtgctattcgttctgctagcacctgcagcattgctcatcgcctccttcatgtatgcacaccgtactacctcaagtacattcttatctcttattgaacagggcgtaaaacttctttcaaaattctaaaaatcatgtatcatagaaatcaagagactctatcaaaaacaagtttttacaacttcatttcacgaatttctttattctccactcaacgtcaaagctgaaaagtgacaaacagtgctttatgcacacaaagttcatgagtagtgcactaaatttcaaagggcaaatatcaacattaatctgacaagctaaaatacctcataaaaataaatgaagtaaataataatggaatctaaaatgcgtgagcaatctcaagatgaaaaatggcccagcataaactattattttaggatcctgaatagcttattgtacatttatttttagtattaaagttgtgaccaaaaacttttttatgatattgctatcagggaattaataacatataacatagacactaaatatttcttacatgcttcgtctgcatttaaattttgttctgaggaaagtgatttgatccatcatctgtcaaaattgacaggggagacccatgtttaattttttgaatgtcttcctttatcctattagttactacataaatgcatgttgggtaatacagtgactatcagaccttcagctaattcaggcatgaagtcccaactgtccctgggaaaacagaactaaaaatggaggcatcactcctaagtgagcagtgaagcttaagcaaagacaagaaggatacataactgtgtatgagagttggctaatggcatcagaagactgagataacactgaagcagactttgtacccagatgtctaatcagctgggtgggtgacattgatgggcattccaaaggtccagtctcagaatcagggatgtagcagacacaggctcccacaggaggcatttggccctggaatgacagactcaacacaatagaaaggagacagagctctgaacctggaagggaggctacagttccatgcaggcaggtcattagagctaaaaaatgaaaaaaaattcctatctaccactagcacacacttgttagaagctacataggcatcaaaatctcatttaaggatgagagattgttaatgcggttatctcaaaagtaattcacaaaatacaaaggaacccaacaattttataggcacaaaagtgtgtgggtcacaagaatatcttgttcaaaatgtcaccagatgaaatgatgcagatttgtttcttttaatagttttaactagggaataacacagtaaaatatatgaagcgtacttctgtaaatcgtgcagcttggataaatttgagcacacatacacagctgtgaaaacaccacatgaatcaaaatacagaacatgtccagcactctcaagctccctcttgatttcgtttcttccagtcactgactctagtctccataggagttaaccactatttcgacctctaactctcagcagatggattttgcctgctcctgacctcatacaaatggctttatacaattgttgctcattcatggatggcttcttttgatcagcatgatgtcttagaattgtgtccatccatggtttaatctttcttatttataatgttccattgtttatgaataaaccactttatttttattctccttttgatggggaaattttatttcattgtttttttcctttgctacggcattagggattgaagcctctgtgagccttcttatacgtgtcctttgcagacttttacagttctttctgctgcatgcacacaggaagagagtctctggaacattggataaacccactttcaacgtaatgcctaccgcctaaagggctcgggcacaccagcttctgcccttatctgcaaactatcagagctgcagatcctccacacttttcaattctttgtatcgacaactttgctttggttggatagcttgttccaagtgtagccgttctcacggatctgtaaagataatgcattctgacattaaagtgcacgtcctttgtaagtaacgctgttgagctcctttcaatgcttgctggacacttggatattatattcttctttgaattatctggtctgatgttttgtccattttttatatttttcaaatctttttcttattgattggtagaaattatttaaatattcagaatacaagacttctgtcagaaacgtttgacgaaagtcttgcttctgtaagggatgcctccgaatgctaggcaatccttagctggtagctgggggtctgtgttaacgaggccaagccacatcaataaattgctctaggttcaaaatttcttggaaacaatgacttggattctaacttagttgcctcctcttcttttttacttctgacccaagaaacaaatagtatgaagtgtgcatgccctgccctaagggacgaggcggatctcctcttcatgtccctcagctctctcaggtcgtgcccgatgctggaaaatcctggccaccatacgaagggaagcagaagcctggtcaggggtcccgtgtcataaccactgggatcggggacaccagtgctcatcctgttacagtgtaactcattttcttttacaccatagtcacatatttttgtgtccctttccttcatgtgatagctttgttatgccacataaaatacaacttctgggctgggtttggtggctcatgcctgtaatcccagcactttgggaggccgaggtggggggaatcacgaggtcaggagttcgagaccagcctgaccaacatggtgaaaccccgtctctactaaaaatacaaaaattagccaggtgtggtgatgagtgcctgtagtcccagctactcaggaggctgaagcagaagaatcacttgaacccaggaggcggacgttgcagtgagccgacatcatgccactgcactccagcctggaagacagagtgagactctgtctaaaaaaaaaagaaagaaagaaaatacaacttctgggagctgaggaaatacaaggtggaggaggaatgagtcctggagcgacacagccttgcaaaccgtctctgattgacattccgtaactttatcctttatatgacgtcaagagtaatgctgagaatagagtgcaatcctcaacacagtaggcaggggcagggtcaattatgcatttatttttcacatttgcaaagataatatttgtattatataattaatatttaccagagtaataattattatactttcaggagaaataaaaacaggataacgattttcatacactgatgacatttcaggaccaaagcactttagtcaaatttgttagagggtctttgtatctgaatcataaattccatcaccaaaggtaatcgtggtcataaaggagggtcccgcgttcgagcaaaaccgatgaagtttctattgatttgagattatgccttacactaaaaaccaatagtaattacatcaaatgagctaaattaatgaagttaatatttgctgttgggagattgttagaactcgaccaacctagcgaacattctagcattactaaccactgcctggcataagtaatttctaaaatttcaaagcccacgttagttagtgaggtgcaattctcaacggcattttgacattttggttgtgttccagaaacatgtgcatacatcgtgagtgtgtgactgaacaaaaactatggctctcctcttcatgttattttcacagttggtgtaggtcacagtagatgaaagtgacgggaagtccatttctatgattttcttctccaggctacggcaggctttatggtgctgtctttctagagccatagctcatatattctctttggcctgggagggtttcattcagatgaacatgtggtaggatgttggccttgtgggacgaagcccccaaaatcaatagatgaggtacctggatctggccctgccatgttctaccattgtgattttgagagcctgtcaacctctcccagacccattttcctcatttgtaaaatgaaatgaatagattttggtggttttgagacttttggactatggaaggctttcttcagaaaagaaaaagaaataacacatttcccaaagcccaacatatacaccaaatcccagtgtgcctgccactccccttggctggatgctggaggcctgttctccacgtctctctccccttcactctgtagttgctcttgggacacagttgtaaaacccacacaaggtttcttggaaagacctgaactaaacagtttctaagatttcttctttggccaggcacagtggctcacgcctctaatcccagcattttataaggctgagacgggaagatcacgtgaggtcaggagttcaatacagcctggccaatgtggtgaaaccctgtctctactaaaaatataaaaattagctacgcatggtggtacatgcctgtaatcccagattactcagaacactgaggcaggagaatagcttgatcccggaggtggaggttgcagtgagccgagattgtgccactgcactccagcctgggcaacagagtgagactccctctctaaaaaaaaaaaaaaaagacttcttcttcctctgactttcttgatggacacttttctcacatgggatccactaatgtcaccaccaggggatggcaggaaaggtgggacagaagacccaagggccaaggcagaagcaagcagaagagagtttcaccctcaggatcgcagtcaggaatcacaccacgcaacatcgcacccagccagggagatgctggctgagtaaaggcacatttaaagtccacagactccacactcaggggccaggccatacgcgccaggagctcatggtgcttggagagcctgagagccatgcaccatgggaagcatggaaaggatggagaggacagtgatggggcagccgctcagggttccacgggccttccatttattgttctttgccatcctcacaatgggcttcctcctcctggtccaagatgccctttgaacatcctctttgcagctgtcagttagaaataagggacaaagggtccattcctgcttcttgcgacacagtggaaaccattttcatgcacatacagactgttcagaaagtggccctgcagctcctctccactgcaactgactttggcaaaagaatcctagttcacacagtcatgtgctcagccacagaccgtggctctgatccaggagagagaggagaataaatgactagcactaaccgtgatctctgagaagaatctgattttccttaagggcagttggaataacactcacctgatcacggacctagtttgagcctggacagggtgtcctagtcctctctgtgctcactttttatcctatcacctgtttataaggaacgaaagaacatgccatgcccagtcctggcatctgggattttgggactctaggatgtaagctttggagggcttttggttactcactcattatcattttgtatattaatgaaattgtggcttcattttatcatcagaaacctgactctgttattacataagatactctcttttacctgtgttgggctaggcagtctgatattcagagcaattcaaccaataagatctttgataactcagtttccctattttttcaatgatgagaacaatcacagcctaataccagacaggtgtgctgaggctggaactagaatgggaattgtcccagaagaaggctctcacaagaatccaagaaaggatgaaaggagaaggagttggaggaggaggggaagaagaggagagaatgtttcaaatcaatcaaagtcatctgtgtgtaaccattgcaagaattcaatcgcactgagaaaaaattattaacacagaaaactatcttttcttggactgatttccagttgataactctgggccagcatctttcatggaacacttttcctcttcagaaaccaccataaatgtggctaagggcatttgtatagacaccttcttaatattaaaaacgtgggaggaagagacgagttacgattattgcaaagaaaccaatccatctggatttaatgtaacagttgtaagctttcagtctgcacctatgattttaagtagaaaagagaaaattggaaagcaaactggaaaaccaccaaaatttagtataaatttaaaatcagagcagtaaattttcaaaggctgtgtgaacagttcacccttctggttgtcttttcttcatgtctttaagccagcacattacttcagttagttctagcatccgtttagtgccaagcttgcaaagggaaggaggaattaattttattcagaaaatggtgcctgtgattaactgaatggtttaggaactaaccaattttacaaatacacactgcagctttgtatgtatgtgtgtatacaaatttaagctttaatccattttatgtgaaattttaaacatggctttgaaatataattttattccagtgtttaaatacaacaaattcgacaaatgtgcatggagcctggccagaagacagagacgcagcagtgagtcgggcaggtgcagcctggccatgatgaatcacattctatggggcagggagcagataattaaacaaatagttacacaccagttgttcagttactatgtaacccttgtgaacacattccaagccacgtgtgttatatgtgtcacgtctaggcctcatgatgcaggaggctgtgctatccaccactacccctgctttaccgataaagtaggagacactgaaggcacatgccccggtactgtcagaggcaagattgttactgagcagggagggactccctcccagccttttccaattttactggaaatttgtcttcagatttttttttctattcccagaccaatatatattttacaattacataaataatatcaaacatattttttctaagcaatttttgtggtagtatagagtatggaaccaattttgctaaatgcacaagcgttttgaaaacaaactcttgctgaatggggtctggttagaaaacagacttccaatacttgtttgattcaagattccagcactctgtgtgtgtgtgtgtgtgtttgtgtgtgtgcgcaccgcagtactcaactgtctgcataaaaaaagatctatgtgtttatcattgtattctgctgaacaaaaaaaaatggataaaaatgcattagtggaaatcaataccttgttgagaagcttcaagcacatgtctctgcctcttgactgcagggggctgcaccctcttcctgccaaccatttataatcacatacggatgccaaaattagcagcagagaaagcaattactttaaaggctttgagattggaagttaaaaaaagatatatattgtaaatcattttaatccaacagcaagaaaatagcaagttaaagttcataaataggaggtaggctaatgagacaatattttaaacattaacagtgcctttgatctatagtgtgttcagtaggaatttgctttagaggactgtattagactgttctcaggctgctaataaagacatacccgagactgggtaatttataaaggaaagaggtttaatggactcacagttccacatggctgggaggcctcacaatcatggtgaaaggtgaatgaacagcaaacgcgtggtggcagagaagagagcttgtgcaggggaactgccctttataaaaccatcggatcttgtgagacttactcactaccacaaaaacagcacaagaaagactcacccctatgattcatttcctcccaccaggtccctcccacagcacatgggaattatgggagctattattcaagatgagatttgggtggggacacagctgaaccatatcaaggaaacaaatggaatcttcaatattgacaaactccaaatggagttgaggacttgagtaggaacaggttgggttaagtggaccaagaagaaagtcatgataggttgttgatactgatggtgagggcaggatatctgcagtctatgtggacaagtgttttttgccagcttaaacccaaaggagggaggaaattagcatggtttgaacacctacctggccagcggctcttttctgtaatctctgataactgatctccatgtaaatgaggttcaatatgagatctttctactcggtaggtttccgtgtaatttacaatatacgtgactattcatacatgagtcagcccaacacaacagattcaatattaattgcagaatgaaatcttggattgtgttatgaatagacataatggagatcactgggacatacagttaatgtaaaagggatgtagatgataaggatgatttttttttttttgaaacagagtatagctcttgtagcccaggctggagtgcagtggcgcgatctcggcagctcactacaacctgtgcctcccaggttccagtgattctcctgcctcagcctcttgagtagctaggattacaggtgcccgccaccaagcccggctaatttttgtacttttagtagagacggagtttcaccattttggccaggctcgtctcaaactcctgacctcaggtgatccgcccgccttggcctcccaaagtgctgggattacaggcgtgagccactgcacccggctgataaggatgattttacccccacagattagaaagaaaaatcatcagctgaaagagtgaacagcttctctgtaggtaaatcaagatgagtgttgagtatatgcaagtgggtagatttgtgtgtgtgtctatatgtttgtgaatatgtgtgttagtgtgtttttgaggagggggcagatataagagagggaagacaagaaaattaatgaatcatagcccctcccgtataaaagacaatctcaatacttagtatctaagctcacaaaggctcttggtagaaactcgttccagactcctgctgaaagccagctctagctagttgaatacctaaatgtaaataacaaaggcagtaaaaatatcaaagcatgcccaaatgctggaaataaaaagtatttaaagaaaggaaacgtaagacattgaacggtaagactttaaaaccaccaaggaaagaaatgagatgcagcagatttatggaataatctttatttaaaacattgcattatgttggaaaacaggaaaaattggctgtctttttttaaagcaagaggagttcgtgtgcatatctatttatcgtttttttccaacatccagcatatttcttatgcttattccaaaaatatattgtatctacttatggtagctcttaacaaactgctgagtttcagtgagaagaaaccttgtttgcagtggactgtggcatacagaattttttctcacattttttttctgtttactgttgttgttttttatttttattttactttattttatttttgagacggagtcttgctgtcacccaggctggaatgcagtggctcaatctcagctcactgcaacctccgcctcccagcttcaagtgattctcctgcctcagcttcccaggtagctgggattacaggtacataccaccatggctggataatttttgtatagtagagatgggggtttcaccatattgtcaagcctggtctcaaaattctgacctgaggtgatctgcctgcctaggcctcccagagtgctgggattacaggtgtgagtcaccatgcccagccacttttctgttttttgaattagatccctacggaagagacaaagggaatagcatgggctaggtctggccaatcataataacgtacctcatggttacatcatggctctgacattgggcacgtactccaggcagggccatatatctgaaattaatatatagacactggggaaaagaaaactatttcctccgagatcctgacccaggatgacatggatctagatccatctctctttggctacaaggtgaaaattgatgtgattccagagagagtaagttcaacacacacaaattaagagaatccagaaatgaagagaaagaaagaagagaaacacagagagagagaggaagatgggcactgagattatcatgcaatgtccttgaccaaacaaagtctgcatcgtgaagccaataagttccatttttgttttagcttgtttcaagcatatttctgttgtttactgtcccacaagttactgggatataattctccatgggtttcttgtagtctgcacctgtgaggtacggatagctcataattctgggttatcttttcaatcatgttcgtgtcataaacgtgcttagaagacagagagagtatcttccttcagatacacttaatgtccagtataataaagatagtgtcttgctcaggagcaaaaggcaggcatgctcactgcccgttataaatgattcgagttttctaagttcaggatttctctcctgcaatgcaaacttctgtgggtacaggtgtgatctggttcattttctgtctctctgcaggaattggggctcagggaaaccacactaaaccgtggatactccactaagtttaattgctctgaataacacagtgttcttgtctctgaccaagagtttcgtgtctcctcccagcacccatgaaactatgacaagataacttgtcttgtgagcttgcagttcttgacactaatatgttcctctaggtagaaagtagaatcttagagtggagagaaaagaaccccacacaatttggaaacgtgaaatcaatgtgtatatagctgtaaatttagggaaaaaatatttttttcaatataaataaactttttattgtctgctagataaagataaagtaaaaatcttggcacatagtttcagggaaaatatataatgactcaatatttaggccatggtacatataatttaaagagactgtgtcattatatagggtaaaacacatttttttttaaagtttacctaaagaaggtgagttttaaaatatttgagatatagacagttgagttttccagaaaggaaatttggaaatgatagatcagttagtaattagaatgtcatgttccttgagcaactttaatagataaatttggttaaaatgtctttgattcatccaacttatattacaaattccaatcatgtatggaacaaacattaattacactgaaccagtgtatccaggacttctttagacaaaaagcagactggtgaaaagccagacaatattcctaccctatatgtgctggtaaatgtttaacaactggctctctcagagaaaatgtatggctaaataacatttccattgatttttttccaaaattgtgcatctgtagtcaacctggggttgcagttggcaaaggcatataggattgtaatttctatgcaatgctgactgatactgtcaggtatgttaaagaataaaatagaactgtggctgggcacggtggctcatgcctataatcccagcactttgggaggccgaggtgggcagatgacttgaggtcaggagtttgacaccagcctggccaacatggtgaaaccccatcactaactaaaaatacaaaaaaattagcaaggtgtggtggcgtgtgcctgtagtcccaggtactcaggaggctgaggtggaaggatcacttggacccaagaggcggaggttgcagtgagccgagattgtgtgactgcattccagcctgggcaacagagtgagactccatcgaaagaaagacagacgaaagaaagagaaagagagaaaaagagaaagaaagaaaaaaggaaggaaggaaggagagggagagaaagaaagaaagagagaaagaaagagggaaataaagaaacaaagaaagaaaaaggaaggaagaaaggaaagagaaagaaagagagaaaagaaagaaagagaaagaaacagggagggagggagggagggagggaggaaggaaggaaagaaggagggaagggaagggaaggaatgatgacttacaatacaactttgtcaatgacataacccgtcttcattctacaggatgtcgtggctggttttgagtagattaaggggtactcagatcgttcattctgcaggatgtggtggctggttttgatgggattaaggggtactcagatcgttcattctgcaggatgtggtggctggttttgatgggattaaggggtactcagatcgttcattctgcaggatgtggtggctggttttgatgggattaaggggtactcagatcgttcattctgcaggatgcggtggctggttttgatgggattaaggggtactcagatcgttcattctgcaggatgtggtggctggttttgatgggattaaggggtactcagatcgttcattctgcatgatgtgatggctggttttgatgggattaagaggtactcagatggctggtagagctcatctcagtggttcagtaattactgagcccatcctccttctgctgagtgggagcccaggtggtttggcatttggttagaatggttgggttgccctaggtctgtttgtctgcagatgtttccagaagagactggcctgtgagtgggtgggctgagaagggaagacccaccctccgtgtgaaaaggcaccatccaatcagctggggtccagatgaaacaaaaagagtagagggacagaaaattgttctctcttctggagtaagggcagccctcgggcatcggaacttcaagtcctgtgacctttggaattcagaacttacatgagaggccttgcagactcccaggactttgacccgaactgagagttatcaccttggtttccttggtgctgaggcctttggacttgaaccgagccataccagcagcttccctgggtttacgccttgcagacggcctgtcctgggacttctcaccctccataatcgagtcagccaatcctcgaatcaatccctgcccatctctctctgttgctctccgtctctctgcagaaccctgattaaagctaatgatgtttgaacactggaaaaacattgcttccattttttaaatatttttcacaatgtacacactataaacgtgacatattttaaatctatttaacattttttcatgactcttctaattctagtcaaacaacaaaacaataaagccctgactgtggtatttgctgatttctgtcatttccgtgctgttgatcttcacgccatggccagggtcaagccatgcacgtgacttcactgaccgcaaaactgggaagaggctgtgcagaaggaagagccttgcacggtgcttccttccatccgacagatgccgtcggcatcaatgggctcaaacacatcgatgatagcaacgtaatcaggaagacatgaattctgagtacttgttttatttgtttttcatatagtttatgtagtttttcatttatataattttttttctttttctttttctgtctttctttttttttttttttttttttttttgagacgcagtttcactcttgttgcccaggctggactgccatggtgcgttctcggctcactgcaacctccgcctcccgggttcaagtgtttctcctacctctgcctccagagtagctgggattacaggcgcatgccaccacgcccggctaatttttgtgatataatttttaatgatgattgtgcttaacaactgtttcacaaaattcctgcaaatcagtcagctctttctgtttgagagagtaaacttgagcctggtccagtgcatcctggccccaagccccaggagctcagattctcttgggaagacataggaatagaaaataaacacatgcgttttttaaataagaaaagtttattttcacatttgacataaagaaaattggctgggataatagatgcctctttacatctgatgatgagacaaaaaaaagccacctaacaagagggtatttagtcctataccttgtgagtgagaagtttgtccacctccaagggaagctccgttacaaggtgtctgagaagtcataagaagtgggaagttgccagatatctttttatgtgtttgaatactcaaaacaaatggctgtgctgaagattcacgagcactgtatgggataggaaacgggagaaaggcaagtggtggggtggagggtcactcagaaccaagccatcaaaatgacaacaaaagccaaatcatatttagagttctctaagctcaagttcctgcttcagttggtttggaagcattaagtcattcattccttacaagaatcttatggaattgtactattgctaacccaattacataatcaaaaaatggggcagaatgttgtcaactctgaggctatggcagccctgctgcctggctaggtttgtctctttgtctggggtgtgtattgagcaaggtaaaatggtaaagctatgttttgtggaacagcaaaccaatcttgaaggattagatgtggagggagggttaaaggaaggctagcacaaagtttaagctaacagctgtaaaaacaaatacaaagatctcaacatccatgatttatatagtttctttacttgctgtgtgtttgtggtagagcagggggtgttagtttggtaaaattattccctgaaacaagttagatggggatctcccttaggtcagtcattttttaatttaattaattttattttattttattttgagacagagtctcgctctgttgtccaggctggagtgcagtggcacgatctcggctcactgcaagctccgcctcccaggttcacaccattctcctgcctcagcctccacagtaactgggactacaggcacctgccaccgtgcctaattttttgtacttttagtagagacggggtttcactgtgttagccaggatgttctctatctcctgaccttgtgatccacccgccttagcctcccaaagtgctgggattacaggtgtgagtcaccacactcaatcaccagcaggtcaatcatttatttgaaaaaacaaacaaacaaacaaacaaacaattgtccacccaccccgtcctccaaaaaagaaaaatccaaatcaaatgtgtagggaaactataaagagatatttttttttgcagttgaaatccctagtaaatttcctttttaaaaaaaattcattgaaagaaagtgtggacaataataaatcattcaaagccagactgaactgaattaaccttgttcataaccttagcctctctttagcgatgttaactttttcattcctttagcgaaagaagggaagccttcaagcagatacgatcttttagaaaaactcattgaaaagtgaatttataacaaggaaaatgcttggaagttttccgtttgaagatgctctttatttctggcgtgcagtttttatgagacgaatggtcttaaaaggttaaatccagccaacgacagttactttaatctgcaaatcagatcagtaaattgggtttcttctctttgccttatctttcaacggaatttgtgttaaaaaatgaaccatctgttaccatttgctttgttagagggagtttaacatataaaagggattgcagttataagatataaaagaaaccaactggatcctactgactgctgggccacaccgggctggtgagggctccatcctgatcttatctggggaacgcattcctgagccatagcctcaatgaggactgctaggtccctctctaggaaactgggcctccctcctgtcgcagacaggagaggtataaagaaacgttttggaatcagttaacctttgtttggaagcctcctgcgctacatttcagatgtgtgactttgcaacttatttttccttcctgccatttggtttgcttttgtgttaagcggagacgtaacattcaccgtcatggcattgtgaggactccgtgagaaggctggtgcagtaatcagcacactctgagtcagcaacaaaagcacagtcatcagacagtcatccgcgatggcagcttgtcagctgatctaacacggagatccgggggaagactcagttttgaaatagatgtgttcagaggagaaatgatgttaacagacatttctagggtttgtgggttgtttgttttcatttagtttcatgagaaagatatattaacaatcacgtccatttaattgttgatccttatggtttgactttttttttaaataatgtttcttccacaaaatagtcttcgtcatttagttggtttgctttgtttcttgacctcctgagatcaaggcctctctaactccgatgtgtccctgcctcagctggacagcttgttacagggcagctcaggccaggtgaggtggaaggggacgcctgagcatctgcgttcctagccatctcccagctgacgaccctgcagcccggcgggacctgtcctcctgcacatagactcccatgtctaagaaggtcaggaaagagtatttctggcagggcgcgatggctcacgtctgtaatcctagcactttgggaagccgagacaggcagatcactcaggccagcctggccaacatggtgaaaccccatctctactaaaaatataaaaattagccaggcatggtggcatgcgcctgtaatcgcagctactcgggaggctgaggtaggagaattgcttgaacctggcaggcggaggttgcagtgagccaagatcatgtcactgcactccagcctgggtgacagagcaagactccatctcaaaaaaaaaaaaaaaaaaaaaaaaaagagtatttccaggtcatattgaactgtcagtttccacctgttaagtttagcctgaagctgccttcttacacattttaagttcggcctaaagtttctctttctctggcgtgggtcagaggcaaggcagaggagagtcatcgacctcgggtgttctgcaactttgcaatgcccttttagagcactgtcatggaatcctgaacattcagagaaagagacttgtgcgttttgtttcatagtttccctcctgactttaaatagtccggaaacaactccacccaggattaaagtttctatctcactatcttaagcattagaatacatcgatttgacttttatagatcattttaccaattatgcacatgatttatttaacaatgctaaacacagtattatttcacagctaagggcttttgtttttaggaatcaagtgagaatctctgaaatagaaagtgagattttcatcgaaagtttggaacctcattggaaacagagtcttccataatctgagcaggtagtgtgatctttcacacatcattccttcaagggctctgaggccacatcttggtgggctattgtctcagaaaattcatgcccctctgccgaggctgagtccacgtggagttaaatgaaatgcagtgtatgactgtatcctgttaggtaaaaatgacatgtcataatcacagcaagcctcgcaggccatggtactgcatgatgccacccgtccagaggtgcgaataggctttcagcatcgtgacgtcctgggtggaacttccattaaagttagcatgatgaacagagccctgcgcagctctaattggggagctcacaatagtgacttttgtgctcatgttttctctagaatatccaatatggactcgccagagaaataaccgtattcttcccctgaaagacgaactttagtggcagacttggagcttaggtgatagtgctaaatattgtttatacaatcaaaatttactcttgtctttcccccaaattcagtttctgctcattacctttatcttgccttagaaatctattcttaaaagcagtaactatgcaagttactaaagataattctgtccctcaaactatattgtggacttgcgaat

SEQ ID NO: 318 - DNA, 21717 bp, Homo sapiens
actcaggagtgatgtatccatgaatttgatatattttctcatgtgttttaatgctccaagaatgtgtggataaattgcagtaagtacatagaaaactgagtaaagaaaaaaaaaaaccaaaaagtatacatgaatatttgtaatatatgtaatatacatgtatatacatgaatattatgtataatatatgtaatatacatgtatatacatgtaatatatgtaatatacatgtatatacatgtaatatatgtaatatacatgtacatacatgtaatatatacatgtgatatacatgtacatacattatatatacacaaatatatcatagtacatgcatggccaaactgtaagtaaaatctgcatagtcataagaatatatgttaatatttaacctataaagagtggaaaattatgtatgtgggggggaaggggcagaagtgtgtttttttttgttttttgtttgtttggttggttttttctttatctcctacaggaaagaagcagtgtgtttaagagagctaaatcctaatattcacaggacaaagtcaacacataatatctaaaactgaaaaaataaaaaaagtgtcagctgggcgcagtggctcacgcccgtaatcccaacactttgggaggccgaggtgggcggatcacgaggtcaggagatggagaccatcctggctaacacggtgaaaccccatctctactaaaaagacaaaaaattagccgagtgtggtggcgggcgcctgcagtcccagctactcgggaggctgaggcaggagaatggcgtgaaccctggaggtggagcttgcagtgagctgagatcttgccaatgcactctagcctgggcgacagagcgagactccatctcaaaaaaaaaaaaaagtgtcaacataattaggaaataagaggaaaatacacaaaggaaaagtgaaagaggtaaaagtagttaccattggggagcaaaaaccgtggggcaggaatcattctttaataagttttacaaaaatatctcatttaaaatcgtgtatacatttgattaaaataaaaattattactattttaggaaattatgaatggatatttctgctaaaatatggaggtttgcacccatgtcttttccccttctcggtcctactggttacagcaaataaacttaaaaggacaaagagaatgaaagaagaaacaagagctagggagaagtttatactgttagtgatagagaacctttgtttagaaaaagactacaaaattaggtatgaaagtaaatatagttagaataagaaaagatatcacaacaaattactaatttaaaaaagtggccgggtgcggtggctcatgcctgtaatcccaacactttgggaggctgaggcgggcgaatcacgaggtcaggagttcaagaccagcctggccaatatggtgaaaccccgtctccactaaaaatacaaagattagctgggcatggtggtgtgcgcctgtagtcccagctactcgggaggctgaggcagacgaatcgcttgaacctgggtaggcggaggttgcagtgagctgagatcgtgccactgcattccagcctgggtgacagagtgagactccatctcaaaaaaaaaaaaaaaaaaaaaaaaagtgaacaaacatcatgaatcatacaaataacaatattttaattaactaactgccttaaacattttatgactttttttccttacatccttggctacatatccttcagtcttccgttcagaaaataaaatgttaaaatataattttctttagagagaaatgaaaggtaatttagtcttctttctgtcaggtttgattaaaaattttttttaaattgatggcttagaaaagtttctttcagcttcaaaattcattattgatagcatcatggtaagtttttaggactgttgctgaattttggaaaatgcctataacttgtttttcatggataaatagtgaaatttcaaagcatttcaagttttcttgtgctctaatcataaatacacttagattgagataattattaacctatctgttattgatgtctttatgtcatactgacatattttgacctttacagtgtctttgttcatgtcagggattttttttgtgtgtcaaatcagcaggaaatttacctttttctagttctcatgattaattgttcttcattatataggttatgaacaatcaaataacatatgtttgctgtttctgttcaaaacatgcatcttccttttaataatgtaacatgctctcaatatgatctaaagtcagaatgatttttatttattcaattgctcatttttattgtttttgtttcatattttatgcatttttaatataaattttctctcaatcctttaataaatttatagataacaaaatattctttatataaggccagtctgtaatttctcatatatttcattgaaataatcctaaatttataaccaaattataatagctatagcatacgaatatatgaaaattttgattaatctttttttatgtgattcttattaaaaatggaaaaaaaggccaagtgtggtggctcacgcctgtaattccaacactttgggaggctgaggtgggcaaatcacttgacgtcaggagtttgagaccagcctgaccaacatagtaaaaccttgtctctactgaaaatacaaaaattccagctggtagtgagtgcctgtaatcccagcactttgggaggctgaggcgggtgaatcacttgaggtcaggattttgagaccagcctgggcaacatgatgaaaccccgtctctactaaaaatataaaaattaaccaggtgtgatgatgtgcacctgtagtcccagctacttgggaggctgaggcaggagaattgcttaaacctgggaggcggaggttgcagtgagccgagatcatgccactgcactccagcctgggcaacagagtgagactctgtgtcaaaaaaaaaaaaaagaagaagatggaaaaacaagtgtgatgtgtttataattatatatactgagttagtaaatatattctgagaagaatagaacttttgttttaattaggtgtcaatgagaatcaaatcctcaaattataatttgcatatggtattttggatgaatttcccccagactagctcctggctcagtcacgtgacaccagccctgtacttttgtatcatggcagccatagagggtagttgaaatagtcctataaaccaaaaataccttcaacaactccaaaatcactcctacacaagagaaaatgagacagagggaacgtcctaatggaagaagacagtgatctgtgtcagtcatagccaattttggttaaaataccatgcttttaatattttacaaaaacatataatcttggggacatattgctgggttccttccaggatttggaagtgtaggactcaagtttaagctacattggtttcaaagttaattttgcctctaacaatagcaataaagttttagaaaacaaactgtgtgtaagtggcttgacaaaccagagaaagttgagacctaagcccatagcaggaggattgtagaagcaaaccaaattcccactacagatcctcaaataagaggacttagaagctccaggtatttatgaaaatggcaataaatgcttatctgaaaacaagaagcctgattatagggtatccactatagcagtgagaaaatatttcacactcacccaaccacttctctctagccctgttgtagtcattgccttcattattttactttctgtttattttcctgtttgattttttttctttatgtcagatgggtaatgtgctgacatcataacaaggttcaaggatggcatatctcacacgtgcgtaaacacccagtgatcacgcttatgaactacaaaaggattcctttttgatttttaaataaaattgttttaattaaaataagctgccaaatatccagcccttcatctccaacctgtacaataggataagtgtcggtacgctcattccaggagaagactggaggtttcttctctgaatgggttaaatcagagggtcactggagtcagagacacctgatggagctgagtgtgtagagggggttcccatcatggtgattcagttcaaatctaaatatcaaatggtgaggtgttccctccttcactctcccacttttctttcttggttcactccggaaaatgctagaagtcagacaagagattttagaatttctgtctggcaaaactgacctgcccaaaacttgagaactccagatattgacatttggcatactcaacgaaagtgtttatcctgatcatttaccacccctccattgacaagcccccacacaaagttttaaattagctttctgatttgcctctattttagcctctgtttgaaatataaatggacggccagagatcatctgacaattgggaaagccaatggcacaaagaactgagagcaaaacaaataggaaagtgtgacaacaaagaaaataggagaaaatgtcaacaacaaaaacaacaacaacactctgatatcctcagagataagtaaagatgtggtatccctaacataagaacagagttctgtaaaaatgtaacattcagaaaagaaaaagagagcccttggaaattaaagtatgagagtgaaaagagagctattaactgaaggattgaaagtacaaaaaggaaaataaaataggaggaaatttaaaaatcaggctagatagatggtccacaatctgaatagtgggatttgcaaaaagggaaaatagaaaaactggagagaagatgaagtcattaaagaaataatttcagataattttcagaactgcaaaggacttagaaaatcaaggtatatcatcatgtcactctggaatactgaagagacagagaagtttctaaaaacatccagagacaaaaaatagtcagctgtgaagttttgaaatcagaatagctttatgctctttatcagtagccctagaaattaaaagacaaaagagtaatgctttcaaaattctcaggggaaatgacttacaacttttaacttgatacctagtcaaaatattattcaagtaaataatagaatatttaaaatgtcagacatgcaagaattcagaaagtttataatataagcatccttcttcaagttaattaatactccttcaacatggcagaaaacctatagatattgttataagattgataatgaagaaatggaggtataaaacatgggatttcaagatttgcaaatggctaccagaagaaaatcaacaagacttcacagtgactggaaaaattggtgaaccagggaacctcggaggactaatgctcttcttttcaagttttgtaccatttgatctctttaaaatgatatgcacatattattttgactttaaaattttattggaaaattaaaaagcaaagtgaataaaaaaatggaaagtgggatggtgaaagcaatgattgcacttaaagacagttaaagacaaatgtggtgcggtcaagtcagcttcatacctgggatgcaaggctggttcagcatatgcaaatagataaacgtaatccatcacatagacagaaccaatgacaaaaaccacatgattatctcaattgatgcagagaaggccttcaacaaaattcaacacctcttcatgctgaaaactctcaataaactaggttttgatggaatgtatctcaaactaataagagatatttgtgacaaacccacagccaatatcatactaaatgggcaaaagctggaagcattccctttgaaaaccagcacaagacaaggatgccctctctcaccactcctattcaacatagtattagaagttctggccagggcagtcaggcaagagaaagaaataaagggtattcaaacaggaaaagaggaaatcaaattgtctctgtttgcagataacatgattgtatatttagaaaatcccaccatctcagcccaaaatctccttaagctgataagcaacttcagcaaagtctcaggatacaaaatcaatgtgcaaaaatcacaagcattcctatacaccaataacagacagagagacaaatcatgagtgaactcccattcacaattgctacaaagagaataaaatatataggaatacagcttacaagggatgtgaaggacctcttcaaggagaactacaaaccactgctcaaggaaataaaagaagacacaaacaaatggaaaagcattccatgctcatggataggaagaatcaatatcatgaaaatagccatactgcccaaagtaatttgtagattcaatgctatccccatcaagctatcattgactttcttcacagaattgcgaaaaactactttaaatttcatatggaatcaaaaaagagcccacatagccaagacaatcctaagcaaaaagaacaaagctggaggcatcatgctacctgacttcaaactatactacaaggctacagtaaccaaaacagtatagtactggtaccaaaacagatatatagaccaacgcaacagaacagaggcctcagaaataacaccacacatctacagccatctgatctttgacaaacctgataaaaacaagaaagggagaaaggattccctatttaataaatggtgctgggaaaactggctagccatatgcagaacactgaaactggaccccttccttacaccttatacaaaaattaactcaagatggattaaagacctaaacgtaagacctaaaacaagaaaaatcctagaagaaaacctaggcaataccattcaggacatagtcatgggcaaatgcttcatgtctaaaacaccaaaagcaatggcaacaaaagccaaaattgacaaatgggatctaattaaactaaagagcttctgcatagcaaaagaaactatcatcagagtgaacaggcaacctatataaggggagaaaaattttgcaatctatgcatctgacaaagggttaatatccagaatctataaagaacttaaacaaatttacaagaaaaaaccaaacaaccctatcaaaaagtgggcaaaggatatgaacagacacttctcaaaagacaacattcatgcagccaacaaacatatgaaaaaacctcataatcactggtcattagagaaatgcaaatcaaaaccgcaatgagataccatctcatgccagttagaatggtgatcattaaaaagtcaggaaacaacagatgctgaagaggatgtggagaaataggaacgcttttacactgttggtgggagtataaattagttcaacattgtggaagacagtgtggcgattcctcaaggatctagaactagaaataccatttgacccagcaattcccttactgggtatatacccaaaggattataaatcattctactataaagacacatgcacacatatgtttattgtggcactattcacaatagcaaagacttggaaccaacccaaatgtccaccaatgatggactggaaaaggaaactgtggcacatatacaccatggaatactatgcaggcataataaaggatgagttcatgtcctttgcagggacatggatgaagctggaaatcatcattctcagcaaactaacacaacaacagaaaaccaaacactgcatgttctcactcataagtgggtattgaacaatgagaacacatggacacagggaggggaacatcacacactggagcctgttgggggtggggggctaggggagagatagcattaggagaaatacctaatgtaggtgacggattgacgggtgcagcaaaccaccatggcacgtgtatacctatgtaacaaacctgcacattctgcacatgtgccccagaacttaaagtaaaataataataataataataataataataataaaagatggaggtggtggatgggtgaagcattttctctgtagtgtagggaattctcacaggtatgtagctccttaatcctcacaatgaaagaggcaaatatcattatttcattttacagatgaggacactgaggttcaaggaagttaaaagaacttgcctaaagtcacatagcttagaactggcaatatcaaggctgaacctaagtgtctgttccaaggctcagtcatgttccactaattttgaatgttggcaaacgaggagagagagatattgggacctaggatgaagggaagaaagagtttttggtagagaaaacacataaacatttatgtaagttgaaagtaaagagtcctcagaagctaagaactgaaagtacaagggagaataagaataattgagccaagtctcagaaagtttggaggaagcagcatgctgacctgggcaagagtttgccttggaaaggagtaaagttgcttttatttctgaaacaggtgggaaggaggtaagggtgggtaaagttgctattaagctggagcttggagaggagggaaattgagatggtcatactatttcctccttgaaataagaggctagttattctcctgtgaatagacaagtaagggaaagcctggatttttaccagtgactgggtcaggggagggaagaggggagaaaagggagttggaaagtgactggagcaattaggaaagagagtaaggctcaggcttgtaatcccagcactttgagagtccaaggtgggaggactgcttgagcgcaggagttcaagatcaccctgggcaacaaagtgagactcctgtctatacaaaaaataaaaataataattatcaggacatggtgactggtgcctgtagtcccagctgcttgggaggctgaagtaggcggatcctttgagggcgggagatcaaggctgcagtgagctatgatttcgccactgcactccagcctggatgacagagcagagccagaccctgtctcagttgaaaaaaagaaaaaaaaaaaggaaagggaaaagagtagagttgcaatatttagcagataaaaaatatagctcatggctgggctcggtggctcatgcttgtaatcccagcaccttgggaggccaaggcaggtggatcgcctgaagtcaggagttcgagaccagcctggacaacatggtgaaaccccatctctactaaaaatacaaaactagctgggtgtggtggtgcatgcctgtaatcccagctattcaggaggctgaggtaggagaattgcttgaacctgggaggcggaggttgcggtgagctgagatcacgccactggactccagcctgggcaatagagtgagattctgtctcaaaaaaaaaaaaaaaaaaaaaagatagctcacacagttacatttgaatggcacatttatgacaaatttttgtttagtgtatgctccaaagattgtgtggtattttatctgtaaacttttaaagagaaacactaaagcatgtgtaaagaacaacaaagccactttgaaatcaaaaattggaaatggagcaaacttaaggtaggaatgttgggcttgacttctaggcagcagcagacagggagttgtactggcagtcaggagatagcttgagaatgcaatttttagggcctccttggagagcaatgggaagagacttatatgggaactagagacttggaattggccaggacgccattgctggaaacatttgcctactatctaattttacctaagttgatcatctacaattacatctcataggtgtgtactaaagatgaatattattaaataacaatctgaaaggtttttggactctgtaaaacactttatcaatattgaatgttaaaaaccagtggtattcacaagaaaacaactgatatccccaaggaaattcttgaacctgtttgaggtttatcatggtggtctggagtagtggttaagagtctgcagcctgtcccacattaagcaagctgcttaatatgtctgggagtcaatttccttgtttgtaaaattagaataattatagtgcctaacttgtcagattaaatggattaatatgtgtaacactatgtgcaaatactaaaagtacaatgttacatgagatatcataggcagacaatgagaagtttcagaaaacattcattaatatgcatatgtatacactttgtatgcttacgtagaaaatgagtggttttaaaaggacattcattagcatacttttatatgcattttgtagacttgtacagtcagaaatgcagcaaatgtaaaactttaaatctagaagtctgtttccctctaggaacatatatttcaattccttaactatttattgactgatagcgtttgagccacaaggcaaggcatttgcaatatttaggttttggaacccagctctgccactcactagctgggaaatctacaagtcaccttagttgtctgaatgacacttctctcaacaataaaatggccagcaatgcttacttacttcacagagcagtaaggttaaattaacctagcacatgcttgatacagactaggtgtgaaatttcactttgattcctttggctttaaagaatgcataaattagtgtgggtggaggcgggagaagggggggaatgccaagtcccccgttttgttgtgctgggtagacacaatatacctcttcccctttaagtgaaataagtcttcaaatccaattaggatctactctggagtcttagaggaccgttatcttggtttccacattatatgcactgtactgttgttgaagctgtgggtatgtattgggtgcgtcgctgtcgatgaatgctttaaaacagctgtgaattaactgtcacttcttttttttttttttttggcaaactcacaaaatcccagaagtcaggggtctgttgtttgttcattctgcctccttctgagtcattcaggtacagggtgtgtctgccaattgaaactgcacagcggaggaagtttttgagttcacatctgccgggatgggaacgcagtgcgaccagggactgggtggaaacttttacaacagtaatgcaagggcagaagcgtcctgtcctgagcttgtcacgcaggcagatctgaccaagtccgcctctcagcctcacgttcttaagtagcatctaagcaaaagaaaagggtgggcaaagtgctagtaatgagatttgaggcctctgagtcgactcccaagcagaatgtgagagaagggtgccggctcctgctgggcagctgcagttgctccgcagctcctggccgagaatctccccctttggaaattcctgagctgcccaggcgttttgaatctctcaggactcagcagcagcccaccccctcaacgacctctccattggccagaatctgggacacacagcctgactttgtgctcagctgagggaaacccctcgcccaacaccaaaaccggcgctggttcatttctctgtgcactctgggaaagccactgcccctcagaccgcagttgcgagtagcacgaggatctggggtggcggggggagtacaggaacctcccggttcattctccctcccgggctgcttgtctcctccgtacctctcgcagccccttcccagcctctcctccccagagcgccgccgacactcgccgggccgcggctcaggttttctgctgctcgcgcgaaagtggctcggggagctcctggccacaagctcagcacaccgatcctcctagggctgcggggggtgtgggaccagggcggtgcgctacgagactccgggccgtcctctgcctcctcagacttttcgagagaaaagttttcaaagtctctccaccttttttttttttcaggggctcgggagaatcctctccacagccagggatcagcgtctatctgggcgagggcagtgatttatacagtagaatccaggggttaccgggctccgccccttctctctctctctttttttctttcatttgttgtttggggaggaggggttcttttttttttttttttttttttttttgcttctgccccagatctttcctggacagtgcgtctcagcagttcagatccgggggcccccagctgacagagggcgtggggggttaaggcattaacccctcccagcctcttcctgaagaaaccacccagccttggcgcggcgctgggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagcgagccgtacagatcccgggctctccgaacgcaacttcgccctgcttgagcgaggtagggggcggcgaatggcgggggtcgcgggcgcggggagcccggttgtggtagggcttaggtgtcagaaacgaatttttaagtcgaacgaggcaaacaaaaacttagaaaacatgcatctccgggcgctgaaaatttgcatctctgggctactaaggagcccatctcgatcagattgttcttgggcacttgtgatttatggagttcagaaaaaaggttaattcccaactgtggaacctacgggtgtaggggcagtgaaaattgcagttggtcggaggaataggagggaaggcgttaaattttggaaatcctatagacaaagaatatggtgggtggtgtggagcgtgggtaatggcttaaattagtactgcccaggagcagggtataaaattagttgggggaaaatgcggagcttcttggcttgagcagcctctgctgttcgcggagttgctgggattgttctcatctctattacctcattttattgcattgctgcattaccttgaaatatttaagcaacttagaagtagacttctgctgaccagtgccgtcttagaaagtttctttgtaactttctagtcctaggagaggagtcaacgtgttgggggactgcagtaaataaaactgcccacgcaaatttagcaatgcaccagggagcagtttaatgtgagtttctgaagagtagttttgcaatcgaaattagaaatgtggtagcatgtattatggctgtcatgagtagtttgatttctctcttttgtgtatgttttggctaaactaaacaaagcaaaaaatatttatgcaatcaactaatgtacgaaacttctgggatttgctgcaatctgttatgaatggttttaactgaatacctttaaatttacttgccctggcttggggtggggggtggggtgggggggcgcggggggaggcggggagaataagaagaagaaagaaaaggcagtcgcttcacggaggcgctaagctttcctgtttacagcaaggcggggcgggcctggctgcccacacctcactgcgccctcggaccctaagcacacctgctcctagagagttattaatagagcccccaaatggcttacgctttcaaatgattttcctgcaaatctgatttcttgcatggcacatggcaattaggaggtggtgctagtatctttgaactggggggctgggggtgggcatgggggacagaggtgtgtgtcttcgccctcagactggcagttgagtcttttccgaggagagacgtgggctggtattgagcgtgcagctaagctggtgactgcttcagagaatctcatggctggaaatccgggggtgagggggtgtggggtggtgagagggcaggagtggagttaaaatggggtgtagttctctaggtttcccattcctcccactccttgttttccttttcatcatctttttttttttgtcaacccacagccaacatcgtaattcccatttccctttgagtgaatgtggccatagagtttctccctctctttttcttccccctcttccttttttgaaaaaagaaaaaaaaggaagaaaaaagataatttgatttttaaaaaaaatctctctccctgagctctccccaagtttctttaaaacaaatcaacaacaacacaattggagcagtgccttagctagaatgaattatgccagtatgctgtggctctttccctgactctctcctctgacttgtttaaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagatccctttgtgaagagcattcttaaaaataattattgagtcatctactggattgtgtagctctttggaatcaaagtgaaggacaaatttctattattctttaaaggatttttaccttaactagggtgtgaaaaaagtgtggtttgtttagaaaccactctatctttttcaggaagagaaacttcaataagttaacactgaagagtagtaaagaatgagataaaaaccaccaaccttctgaataccacattggctagtaagtagaattgtttgagttttaaactgcatttaagccaaataaattaaatgcaataattctgtcatcaaatatgggcttttaaagaaattatacacaaaaatgtggttgtaaatctagtttaaatgatgagactcaatcatcattcaaaacccatcaaaaaagcatacattcttggcctttcaccaacatgttggggaagtggggatatggatatgggtattaaatcatgtgttttttttttttttttttcaggacactgtcttggcttctcccagcctatcttctgaaccacatagaagtatacagtatcagtgaagcagctagctgtaaaatgtgggctgagtagcataacacttttatctgaaaaccttcaattcatagtatctgaaagcattaatattctcagtcattaatttttccaactacaaaatgaaggcactttgcaagcatcacagacttattgtaatagttaattcttgtttttgattattgtcatcttttgggggattaaagtgttttggcatgttgggctctctaatcttttcgctactttcagaatttgtgctttcaagtgtcattgtatatgcacaggacacagttgggacatgaagataaacctcacctaatagagtagatgtcatttctgggtaaggttaactgtgggaaacagaaatgtgttcactaaggaaaccttaggtcacaacctccagtttcctgaaggaaatgccaaaaatgctccaaagacaaaaggctggaaacaaactggaatgtctctctccatctgtctgctaaggcggaaggaatgatttcatgttacattcacttcctagactttcattacagagtcaagcataatggaaaagtatgtccattttgtgtttctgtggaagataaaatgttcatattctccgacttatcttcataagcacagtagtgattcatgatatggggaaagatgggataaggtggctggctttgggagatggggagctctttggtgacacttttccccctgtgaccacattatccagtgattagatgtactttcttcctggaaactccagactgtgcatttcattccaagaaagctgggtagtcatggactgtggttttcctgggcacatgtgtggtagagccccagatcagaccaagaagcaaagacataagaagaaggaatccttggttgtctcccaacatgaatatctggttttaattcagtgtattctcagaagtaagaatgagaaaaaaatcttagtaattatatgtttgtactaaaaaatacacatataaggctttgattttaaaattgtagtgtttttcaagaggagtgaaacagatcctggacaatacttgacatattcttgtaaaaagttcaattgactcaaaatagtcaggaaagttatgaagtaacatcatataatactttatccccaacaatattaaatgtgattacaattttacagaatattcaaatcaaaatgttatataagacaaattattattcttgcttttacatctccttagaaggagaaacattcaattgttttaaaaatgttctatttatttttcagaaatgaggtgttgccttcttgcccaggctagtatgcagtggcacaatcatagctcactgcagccttgaattcttgggctcaagtgatcttcctgccccaagcctcccaagtagctgggaccacaggcacgtgccaccatgcctggctgatttttttttttttttaatgttttgtagagacaggatctcagtatgttgcgcaggctggtctttaattcctgggctcaagtgatcctcccatagatttgtctgtgttttctctaaataggttataaataccttgagggaggaatcacaaataactaaaagaaacttttgtagagactatcagagtattatttccttgtggacacagtaaatgtatgatgatgagaaatcataataaactacaacattttctccaaccttccttcctgctcttttgatgtgtacttcacgtggtccaagaaaagggactcaaaatactttttaacatacaccattgccttcactgcaatactaagtggaactagagttgtctctcagaacattcaagcaagcaaggtttacttgaataactaaaggccttatatggattatctataaagaggattttaaaccggtggtttaaaaagctgggagagataggaggaagagcatagtgaggggttagacctgcatttatttcagtctttcacaatctttgacaagaaccaggacccagagtagtttgggttcatgttgaatatatctctcctaatacatccgatctcttgttccctacactttcttcttggattcagactctcaagtaatttctgtttttcccgtgctctcttttttatccctttgaggactaaaggattaaaaaattagacttagctctggttatagtcattagcaagagccaagtgtggactgtggacttgagtgaacaggaattgctacattttatgtaatccaaccttgatatatgaagtatcttcatatatccaaccagaagcttccatatcagtaatggataaatacaccatggtaaattaatacaatggaatattattcagcaacaaaaaaggacctactactaatcttgcaaccgttttcatgaattttaaacctcttatgcaaccacaaaagagaacatacgtcatgatttcctttatgtaaaagttccagaataggcaaaactaatatatggaggtataaatctgcacagtggttgcctggggtaagaggataaactggaaaggaacacgagggaactttctaggttgttagcaaagctctttatcttaatttttaggaccttgttcactcagatgtgtatatttgtctaaacttatgtaatcatattcttaagaccagtgaaatttaaaaatatcaatatgctagactttcacttctgagtataaggactatatgagactttctctgtgaaattgtgggaaggttccatgaagttcagtagaaagtggcagccgtgcacagtggctcacgcctgtagtcccagcactttgggaggccgaagcaggaggatagctttgagctcaggagttcaagatcagcctgggcaacatggcaacacccgtttctacaaaaaatacaaaaaaaattagctgagcatgatggctcacacctgtagccccagctatttggatggctaagtctggagaatcacttgagtccaggaagtggaggttgcagtgagccgagatccggccactgcattccaactccagcctgggtgacagagtgagatcctgtctcaaaaaaaaaaaaaaaaaaaaaaaaaagaatgtggaaaaggttccaaagtgtttcataaaagggaaatacgctttttaagtattatcccatgacccagaaataaaactttagaatgctaaataattgtgacatgatgatactctttgcttccataggatgagaatttggcttagtattggtatttgtaatccctgaagaatttctgtgtcttgaaagagtctagagatgtaatgaaactgtcacaataaaagtttattgacatttggatttcagttttaggaatatatgatgggttgtaaatagccttatgaagaatggaccttgtatacattgcaaggatatgtaaacatattagtactggagacatacaaattggagtgtgccaatttcttatcatggccacctgaccaaacctataaaaggcattcattcagataataacactcgccctgggtgtaagcactgcattgttagaagagatagcagagcacaaaggatatggaagacaagcttatgttcctgtggatctattttttaataatttcagcttttatattagattcaaggggaacatgtgcaggtttgttacataggcatattgctgtgatgttgaggtttggggtgtgaatgatcccatcactgtggtagtgagcatagtacccaacaactagtttattagccattgtccccctccctctctctcccttctagtagacaccggtgtctattgttcccttatttatttattttggagggtctcactctgttgcccatgctggaggggagtggtgtgaccatagctcactgcaacctggaacttctaggctcaagcaatcctcccgtctcagcttccagagtagctgggactataggtgtgtgccaccacacctggctaattatttatttttgtagagacagggtctcactttattgcctaggctgttgccacactccttacctcaagcaatctttccaccttggttttccaaagtgctagaattacaggcgtgagccatcatgaccagcctgtttccatctctatgtccacgtgtacccatcctgtgagttttataagcttgcagccagacacattgttacctgcattcccctgtctgaggggtctttctttcagccatctctgggagtaactggacagagaagaaatgcctcaggtgctgcactgctccttggacagactgattagatacaaagcagaaatagaaacagggaagagggggcatggttacctcagctaacaaggagcagggagacgtaggaaattgtttatccatttccccagagctctactactattattactccacttttctgctgctttgttgataccagggcagaaagaaaaaccttggaaaaagttactggtgtgggtcatgcttcctactcccattcctcttgataggtcggcaaacttacccactcatccactcaacaagaatgcttgccctgtgctctgtgctgtggatctaggggcaaatataaacaga

SEQ ID NO: 319 - DNA, 40140 bp, Homo sapiens
catgcaatgggactacactgcaacgaaaatgaatgaactgctgctacaggcaacctggatgaatctcacaaacatgatgttgagcgaaaggagccagacataaaagaatgcagactgtatgattccatttttgtgaagttcaaaaacaggcaaaaactaacctatggtgtcaggatagtggttacctttggggaggagggtgggtaatgggaaaaggggcacaaggggaggatcttttgaggtgctaataaggctttatctcttcacctggtggtggaaactcaagtgtgtctactttgtgagaactgggttgtgcacttaaaactggtgtgtctttatgtatgctgttcttcaataaaaaaaatttttttaatcacggtttatcaggattcagctgcccattagacacctttctgtgtctctctctctctctctctccagctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaaggtgaggtccattttgttatgcccattactcccagagtgacctaattttcagaagatcattcacaatcttctctgggctttcctttttgcttttgaagcagaagtagacctcaatgttatttctcccaggagaaagactaccattccaaaatacctggaaatggtagggggtagaaaatcagttctccttctgtctctgcgtttcattgtatttgttttctttgttgctcaaatttttaactgttccattttcacttgttcacagacaaatccgaccgccctgtctgccgacattttgccaaaaagggccactgtcgatatgaggacctctgtgccttctaccatccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgcctttgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaatccctgtgttctagtcatctctggagttgcagatgaagctgttctcacctggtggagtcagcttattctttagttcatacacactagtgatggggaatgacaaagcttaaggttcttccaggctgaaaaaaaccaatggaggttccattagcctgtaggcatcaaccagaacaagctgccttatgttcaagggcaaagttttgtaagaaaaaggaaaggccaggtgtccgtggagttatttttaaatattttactttgcagagtttgtgtttatggagtggtaatgatgaaggagtctttcagcagcaatttgcagaatgcctgtgggccaggcaatataccaagcactagagataactgacagccaaagccaatggatttaaaatgtacagggaagacaggtttctcataatcacaaatagcatgtaaagttaaacctgtcaaaagtgctgggaagaagacagggaagaaaagagggtgaaagagagttgtgtaataaagggagtcagggtaggagatgcaactgagacaagctccaaaggataaacaggaggtggggtgggagagggaagtcaaggcaaaggtcttcgctaaaagacctaggggaagaggagctaagaaacctagggacagtgggagatgatgcagaagaaagaggagttagaccactcagggccttggaaaacatgaagatttggctcttttcttagaacagaagcctttgaagaattttagacaggagtatcatggcttaggctggcttttcaaaaaaaatcagcttgtatggagagggcccaccttggacctggaagttaattagaaggctactggctacttcagtagtacaagtgagccatgatggtgacatagacttgggtagtagagttggagaaaagtagacatttgaaaattacaggtcaaaataaaagtatcagatttctccaggtagttctggcttatgtaactgccatttaaaaagaagtcttaagatagaagtttatggctgggcgcggtggctcacgcctgtaatcccagcactttgggaggccaaggtgggtggatcacgaggtcaggagatcaagaccatcctggctaacatggtgaaaccccatctctactaaaaatagaaaaaaaattagccaggcgtggtggccggcgtctgtagtcccagctactcgggaggctgacgcaggagaatggcgtgaacccaggaggcggagcttgcagtgagccgagatcgcaccactgcactccagcatgggcgacagcgcaagactccatctcaaaaataaataaataaaaaataaaaataaaaataaataatttttaaaaagatagaagtttatttctctcacaggtcaagaggtggacaatcaacaatccaagatgtgtgacaatgccaccactacaaggtccctgagtattcagaacctcaacccccaactttcagattcacaaccacaagcttctattcactgtccaaagtgaagctctggcttcctcatccatgttcaaagcctcaggatggaggaagggctgagaacaccagttgtctgggaagaaacttctttttttttttttttttttttttgagacggagtctcagctctgtcgcccaggctggagtgcagtggcatgatcttggctcactgcaagctccgcctcccaggttcacgccattctcctgcctcagcctcccgagtagctgggactacaggcgcccaccaccatgcccagctaattttttgtgtttttagtagagatggggtttcaccgtgttagccaggatggtctcgatctcctgacctggtgatctgcttgcctcggcctcccaaagtgctgggattacaggtgtgagccaccacgcccagccggaagaaacttcttaaaagttaacttataactcctcaacttatgggcaagcatttaagttgagtttattaattctacagaggttatctccctaaaagggggctaggaatgacaggattagggtttgtgtttggtgatttcaaaagaaacaggaaattgttctggcttagatgctgtcagaaagatgactacttcttaatcttatctagaaggagggagaaatgaaatatggctaaagctgtaaggtaaaaaagccaacacattttagctgacagggaactgtgtggtgtttttgtgcttagacaagattttgaagtttgtctaatttcatcacaaacacaggatgaccttgtttgacactgattttctgtgagatagtttatgttcaacaagagtaccatggcctaactatgggcaacaggccagctcccagcaacaccaaagcctgccagttattgtcaggccagttcccaattctcagggactgtttttcttaaaagtatgcaaacatataattacaggttgagatgaatcatatgaaggaaataaatggggtactgaatagaaacagtagttggggagctactcaagacatggtggccgggcgcggtaggtcacgcctgtaatcccagtactctgggaggctgaggcgggtggatcgcctgaggtcaggaattcgagaccagcctggccaacatggtgaaaccctgtctctactaaaataacaacaactagcgaggcgtggtggtgggcatttataaataatcccagctacttgggaggctgaggcaggagaatggcttgaacccaggaagcagaggttgcagttagccgagattgcaccattgtactccaccctgggcaacagagcgagactccatatccaaaaaaaaaaaagacatggtggctaggatagacctctctgaggaatctgtagatgaagggcccagaacttagccttgaggaactctgacattgaattgctaagtgaagaaggacaaggataagccagacaaggagactaaggagggatgacggagaggcagggagagatctcagagtgtggcgtcacctggctgcttgctcagtgccaggtaccctgctaagctctttatagacattgtctttgtcttatttaagcttcacatacttttttggggggggagagggggtggttcaagcgattctcctgcctcagcctcccgagtagctggaattacaggtgcccaccaccacacccggctaattttttgtattttagtagagatggggtttcaccatgttggccaggccggtctcgaactcctgacctcaggtgatctacctgcctcggcctcccaaagtgctgggattataggcatgagccaccgcacctggccaagctttgcatactttcagtgaacactttagtgcctactgtagggcaagcactgttttaggagctggagctacatcaataaaaaggacaaaatccctgcccatatggagcttacattgctttgaggatgatagacaatatacataggtaatataattttaagtaatagtaaatgcttcaaatgaaaataaagtgaaaaaagaggttagagagtgacaggtggaagagaacaggttgatacaaagagagagctgctttgaggaggtaacacatagagagaaaattaaacgagggaacaaaccatatgaacacacagagaaagtgcgttccaggcacagggaacagcaaaggcaaaggccttgatgcaggaatgactctggggtgtttgaagtaaaaatagaaggccaggccaggcgtggtggttcatgcctgcagtcccagcactctcagaggctgaggcaggagcactgcttgagctcagaagtttgagaccagcctgggcaacatggtgagaccctgtgtctgcaaaaatgtttaaaaagtacccaggcctggtggcgtgtgcctgtagtcctagctagttggaggctgaggtgggaggatcctttgaggttgcagtgagctatgattataccactacactccagcttgaatgacagaccaagatcctggttcaaaaaaaaaaaaaaaagcccagtgtggctagactgtgggagatgggatcaagatgtttaacagagggcatattgtacagagccctataaactatggtaaagcatttggattttattctggattttatacttttttaaatatttttatactttgaacaaatggatttactttttttttttttctttttgagacggagtcttgctccatcacccaggttggagtgcagtggcatgatctcagctcactgcaacctccacctcccgggttcaagtgattctcctgcctcagcctcccaagtagctgggactacaggcgcccaccaccacgcctggctaatttttgtatttttagtagacacagggtttcgccatgttggccagcctggtcttgaactcctgaccttttgatccgcccgcctcagcctcccaaagtgctgggattacaggcgtgagccaccgcgattggcccatggatttacattttaaaaccacctctgactgtaggtgtgaaggatagactagagaatgagaatgacagcaggcagaccagttaggaggccagcgcagtgcagtggtccagggagaagagacgatggcttggtcagggtagaggtggagagaagtggttaaatttgggttatgttttcgtctcagttgatggcaattacatctttctagttaactcaggccagaaatattggagtcatccttaattctatttgtcaaacatgacctccaatccattaacaaaacttgttggctcttttccaaaatacattcagaaaccagcccttttcacacctccactgctgtcaccctagtctgagtcaccatcacctcctaatagatctccctgcttctgtcatttctgcccattctttgctgcctgccccctcccacctcccgcccaggttgttctcagcacagcctccagagtcatcctttttatttaacaatttaaaaaatgttataggccaggcatggtggctcacgcctctaatcccagcactttgggaggccgaggcaggcggatcacgaggtcaggagtccgagaccagcctgaccaacatggtgaaaccccgtctctactaaaaatacaaaaatgagccaggcatggtgacgcacgcttgtaatcccagctactcaggagactgaggcaggagaattgcttgaacccaggaggcagaggttgcagggagccgagatcacgctactgcactccagcctgggcaacagagcaagactctgtctcaaaaaaataaaataaaataaaaattaaaaaattgtattatatacggagacaaggggtctcgctatgttgcctgggttggtcacaaacccctgggctcaggcaattctcctgcctcagcctcccaaagtactggcattacaggtgtgagccactgcacctggccaggtcatccttttatttattttattttatttttttttttttgagacggagtctcgctctgtcgcccaacctggagtgcagtggcgggatctcggctcactgcaagctctgcctcctgggttcatgccattctcctacctcagcctccccagtagctgggactacaggcgcccgccacctcgcccagctaacttttttgtatttttagtagagatggggtttcaccatgttagccaggatggtctcaatctcctgacctcgtgatccacccatctaggacttccaaagtgctggcattacaggcatgagccaccgcgccccagcccaggtcatccttttaaaatgtaggttggatcacatcactctgctcagaactctgcagtgacttccatttaaatcaacagaagaagccaaaatccttaagataatttaaaagacctttcccaatccagaccctgctttacttctcttttcacctttcccacaactctggctcactcgtgccactccagcccctcttgcctccttcctgtttgttccccatgtatgtccgaacactcctgtcacagggctttactccagctgtttcttatgctagaaaggcccttctcctggaaatccatgtggccaaaactaatcttctttaatgatttgcttgaatttcactttactgaggcctcatttaagactaaaatctgtcctcttgatacttttaaacttgatccatattttcttttatctataggatcatctcccctgctggaaacctaatcagagatctttattttattcagtagtatcccaagagcgtagaagagtgcctggcacatactatacactcaataaatatatttgttgaacagatgaatgaaaaaatgaggcagacttagctggctgatggattgattaggggaggaggaatggagaaagaggatgatgacctttcagttttggcccaaataactgaatgacctgtggtgcaatttcttgatggggaagcctggaagagacaggctttaggagtaagaacaagagctccattttgtacgtatgagagagatttattaaagatctcagagaagatgtcccataagcagttgaattcatgagcctggagctcggggcagaagttgggggccagcaagagaagtttgggaatcttcattggttatagatggtatttaaagtcaggaggtgataggtgataagtctagattaaggagagtgtcaaagatttagccctgaggcacttcaacatttagacttcaggagaagcccattagatgcaaaggaaacctatagagagtagtgtccctgaagaaaacaaaggagggagggagcgaccaagtctatcaaacattgatgggagagtgagtaggatggccccagatctgttgactttggcaagtgtgaattcagacaatggtggcaacaaaagcatgattgtagtggtttgagagctgacagaactacaggagcaccttgctcaagctcccatattaagtggtagagttagaagtgaaccaaagtcttgattgtggtgatagtttactgggtttatgcaggtcaaaacttatttaagtgatactttgcagtttattttgggtgccattttattttgtgtacagtttattgtatgtcaattatatctcagtaaagctgttaccaaaaaaaataaatgaaccgaagctccactgcaccgtgacttctgcatgttgggctccagttccctgtttacaattgtacacttcgggattttgtgacacatttcaacactggaccgatcagacctctcccttagccattggtctgcactgtcttttctgcccatgacccagtcagtctcgcgccccatgaccctctcctaaaacacgcgcagtctcctctctcttccccttcctctcgtgtcttccttgcctaccagcctcacctgatgggctcgtgttctctccgtccccgatccactcgggctccggcagctgctgcttgggcgccttcggcatcgcggtggcagaactagaaacgagttacagatagaaactagaatatgctttttaaaaaaacaaaaaacaaaacaaacaaaaaaacagtatgcctcaactccttcatactagtaggaaattattatgttcattccttgagtctcgcggcgtcgggaggtcacggcgtcaggcttcccagacagtcgtaaacgccatgtgtttacgcgactggagcaagcggacgccggccccgctccgtcattgcaggccacgcctccactgaaccagggccacgcccccgagatgacggcgaagctcgcacgtgcgcagcccgggggcggggttggccgcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcaggtgaggctggtaggcaaggaagaaacgagcagagggggaagagagaggagactgcgcgtgttttaagagagggtcatggggcacgagactgaccgggcccctgcgggagttactgcgcatgcgtgccgtgggcccgggaggagtttgccggggaggagtgggtttggaatcggggttaaaggaaagagatccagatgtcgcacgtgacctaagtgagactgggcgagataaaagaaagagcatatggcaccgagggagagatggggagaaatgggaaaaccttgcttaaaaaatttggacatccgccccaccatacactgtattccaccaggaatatatgagccctgcctcgacctccccttccccctgcgcgcgcatacacacaccttgggagcctgtgatcccccttgtttctcaagagagggtgactccttcatggtttctttcttaagacacccctctcactcaactggagcaagagtgtagatttttgatgttggaatgagggttaaggtttacttaaaaagcagcgaaagtttgttaagcgcttgtttttaattaagcactctatatactgtgctttgagaggggaaggaaaaaaacatgaagatatcctcccagggttgaagtcagttttaagggggacataaatggacacaactaaccccagtaggtacacagtaactaattttaaaagcacttattggatgcctactgtataccaggtactgtgtggaggaagtgggaatgtagagataaaagataagactttccctcaagggacaacccagtatggtgaagggtcagagcattaaccagacagacagtggttgtcagagtatgatgaaggtgcttaagaatgttatgggactgtagaagagaggaggagcatctactcagacaggtaagggagtgtcagcaaagcctcccaagaatatgtaatagctgagtatttttttttgaggcacattgtagctccatcacccaggctggagtgcagtggcatgaacatggctcactgcagcctccacctcctgggtttaaaggatcttcctgcctcagtctcccaagtagttgagactactggcatgcaccaccacaccttatttttaaaattttttgtagacacaagatctggctatgttgcctaggctggtctcaaactcctgggctcaagtaattctcctgcctcagcctccaaaagtgctgggattacaggcgtgagccactacatctgctccccagagtttattcttgaaagatcatcgtgaattagcaaggggaagcgcattccaagccaaggaagtttgtggaaggtagagatgtaggcaagcctgactggtcccactagagcctggtgactagtgtgatgaagtcagaaagatgctcaggagacagataatgaaaggctttagatgccattccgaggagtttaatcctaaagacattaagaaggaaggcccattgaagtgcataaggaatgattatgaacagttcacctgtagcactgagcaatggagaatgaatggccttgaactggtcaagatggaggcggggagaccatttagggggctctggccatgatctaggtgagaagtggtaaggggataagccaaggcctgaagaataaagagttactaaggaggcggcattgatcggaactgagaactgattaaatgaagggagaagtaaggttgacacttaagtaacccagtgactagtagactattaactgaaagcagtaatggacaggagagtaagaagtggaaagagataaggtgaacttctgaatgctgagttaggcgtttctgaggatttctaaaaggaaatggcaagaagagagtttgtttagtcactgtggagagacaactatactaggagtaaagacacaggcaagtagagttgaagtgctggatatggaagagtcccctagagagtgtttgcagattgaaccaaaaagaaggttaaaggtgggaaccctaaagaacttcagcaattgcaggaagcaggtggggaaggaggctgaagagatgagactgagaaaggcaaacagccagagaaactggaggcaaaccaggagtgagcaagatcccagaaattaaataatgatagaagagaataaaaaaggtgtggaggtaggcagcatggaatgctgcagagaagtcaggcaaaataaggaccaaaaaatactttgtggtttgaggagctaagggttcagtggcaactttggcagaagtagtgttcattcggagatgataccagattgcagtatgtttcaaaggtatgggagaagagaaagtgaagcttgtgaattacgattttgagacccaatgaggacaagaatacgaaacagtaatgggggagaggggtataagggtaaagaaggcttgctttcttgccttgaaggagcagcttaagcgatatacgaaaggagagaagacacagtatatctctagccacacttaatctttttcagttccttggggattatactttctcacaatgaaactcttcggaggcttttcctgtccctataatgaagtggataagagtgattaaagtacaaaagatttttttggttttggtgggttttttttttttgtgacggagcctcactccaggctggagtgcagtggcgcgatctcagctcactgcagcctcaatcgcaggctcaagccatcttcccttgtagctgggactacaggcacacaccgccatgcctggcttattttttgtttgtttttgttttttgttttctgtagagatgaggtcttgctatgttgcccaggctaatcttgaacctctggcctcaaccagtcctcccaccttggtccccaaaatgttgggattacaggcgtgagccagtgtgcctggccacaaaagagatttaaaggaaggagagatggtatggctgtgttagtccttggggagaaattagtgtctgggatgagtcagtcatctgtgttgataaggtgagctgatcaggtttttccttcttaggtacttcagtagatccttcctcctaatgcctttaggattaaactccttggaatagcatataaagccttttattattaatcctgcacaatttttcaactctcacactagtcacccaatactgggctcagattttttttctttaacttttttgtttgttttttgtggtttgttttttggggaggaggagggccccaaactttgaaatgtgttctggatggaggatgcagattaagcaaagacagacataagcgtgcctgggacttcataaaggaacagaaagaagccagtatcgagaccagaggtgtgggtagggaaacagaaaagatagggtagggccattttagtctgtgaagcctttaattattggaattgtctctcgttaactctagttttttggagaagtagatgcaccataaaactttcctgaataaatgattactttgaaatacatggaattctagtctgagaatattttaatgtagtagatggcggataccattgactttttttcttttttttttttttttttgagacagtctcgctgtgtcacccaggctggagtgcagtggcgcgatcttggctcactgcaacctccacctcccaggtacaagcgattctcctgcctcagcttcccaagtagctgggactacatgcgtgctctgccacgcccagctaatttttgtatttttagtagagatggggtttcaccatgttggccaagctggtctcaatctcctgaccttgtgatccacccaccttggcctcccaatgtgctgagattacaggcctgagccgccgcacccgaccaatttttttttttttaatattaaatactgaaatgcttaagggtagaattagatagcagtgaatggaagggatgttttggaagagaagataataaataggcctaagcctgaagggaaatcatgaggctgcctccagtaggggagggagttggacatggtcctctaccttcagggaaacaaggatggagagggggagagctagaatctgttgaatctgttttggctttactgggaacacaggctaaacagtctctcaggttactctctagaatgaaagcacacagacaggtaaatatgacacaatgtgatttgtgctataatattcaagcagaacaagtaaggcatagactgaggtgttcatttgcttaccagataactctatttacatggcctataggttttacaaacaacgtgtccccctggccaggcacagtggctcaggcctataattccaacagtttgggaagctgaggcaggagaattgcttgaggccagaggttcaggattagcctgagcaacatagtgagacctcctctctaaaaattattatttttttaattaggcaggcatggtggcgcttgcctgtagtcctagctactcaggaggctaaagtgggaggatcacctaagcctaggaatttaaggttacagtgagttatgatcatgccactgcattccagcctgggtgacagagcaagaccctgtctcttaaaaaaaaaaaaaaaaaaaggagggtgtgtgtgtgttgtatacatgtgtgtgtatctacacatatctcccaaattgaatttataatatcttcttccttcctataagaccttctcttccactgcctccttaattaataaatggtaccacttagcccagctaattttgccagctaaaaacacaggagtcatctctgagtgctctttttttttttttttttttttttttttttgagatagagtcttgctctgtcacccaggctgcagtacaatagcgtgatctcagctcactgcaacctccgcctcctgggttcaagcaattctcctgtcttagcctcctgagtagctgggattacaggcgcccgccactatgcctggctaattttttgtatttttagtagagactgggtttcaccatgttcaccagactagtcttgaactcctgacctcaagtgatccgcctgcctctgcctcacaaagtgccgggattacaggcatgagccaccgcgcccggccgggtgctctttattccccacctctagccccatcctatgaattcttctttatgtccgcttgtcaccaccacccagactactctgacagcctccccagtggatttcccactatgcttattccctccgattcttgctgtactctgaagccagagtgaaactttaaagtgtgaaagtgatcataccaataaagtccccattccttaaccttgctacaaggccctcactccagccttaccttgcaccattctcccctcagtctgtaagcttagccataccaaacctttccctgtctctcagtgtgtgtgctttctcacagctgggcctgtgcacagcactggaattacaccatgtgtctgactaacttctcatactcctcattacttcagttatttgcttaaatgccatcttcttagagaggccgccaccagagatgaagccagcctctcccccaccaccaagtaggctttaccttttcttttggaaccttcagtacacctggaattacctatttaaaaatctctcttcctatagcctgcaagctccagaggagaccacatttgtcttgttcattgctatgatcccctacgctagcacaatatctgacacatggtagctgtttagtagatacttagtggatgaatgaatagagatgggaatgattatttctgcaggagttgtgagacagtacaaatatttaaggagtgatagttaagctagaaaaataataaaataggatagaggctacagagatctttgcaggggggatcagactgctttggaatttgcagataagcattcacgatgtccgcttaactttctagacaaagtggtgaagaaagggaagaaggacaagaagatcaaaaaaacggtgagaaaatgagggttgaggataagaaatgactatggatgtttccaagctaaataaatagccatgtgaaggaggtgggaggtccaagggaggagaaaagatcttgtcaagagaggagataggcagggcacggtggcttacacctgtaatcccagcgcttagggaggcagaggtgggaggatagcttaagcccaggaatttgagacctgcacactccattctccacaaaaagaaaaaaaagagagagacaggaggtaaggtgagggtggagtggagggccagtgggccaatgtgtggcagagcacagcctgcttggattgctcttggaaacatgtttacctgtagcttaactccctttatagttctttgaagagctggcagtagaagataaacaggctggggaagaagagaaagtgctcaaggagaaggagcagcagcagcagcaacagcaacagcaggtacaagtgccacagggcccaccaatcctgggaggcatctgggttccaccaacccctttccagcccatgttgctccattcagctgatggggaaccctctgtgaggcagaaatacagcaggggcctgggcttcattttctcactgttcttttgctctcagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaaggtaaatgacctgagggggaatgggtacctggaatccatgagtcatggagagtgatacctcataccctgatcttcaagttggattcaattggggggccagacattgtaattctttcctatctcatgttctccccctgtcatttcagtacccgccccaaaaccccgcggagggaagaaaaccaaggtaagccatctgtgtggtaaacggagactccaaggatgcaaccttgaccatcctactgacttctgtggccctttcattctctagggtggtaatgtttttgcagccctgattcaggatcagagtgaggaagaggaggaggaagaaaaacatcctcctaagcctgccaagccggagaagaatcggatcaataaggtgacagtggtggctcgatcagtcactctcactccatttagcaccttctggccatggtggagtaatttcccgcttttaaactagctcttctcggtctgtcttacttatactgttaaaatcatctttttagaatacatgcccaggctgggcacagtgggtcacgcctgtaatcccagcactttgggaggccgaggtgggcgaatcacgaggtcaagagatcgagaccagcctgaccaacatggcgaaacctcatctctactaaaaatacaaaaattagccaggcgtggtggcgtgcgcctgtaatcccagctacttggaaggctgaggcaggagaatcacttgaacttgggaggtggaatttgcagtgagctgagattgaggcactgcactccagcctgggcaacagagcaagactcagtctcaaaaaaaaaacaacaaaaaaaaccatgccatttttatcactcagaaatctacagtgattctgttgctttaagcacagaacctgaaacaaagccccaggtccttgctcttctacttgtgactcttctgcgtgtgcatcttagtccatgtccatttgagctcttgagaaagcctccagtgctagtgccactcactctggtggcgcacttgcctgacttataatccttagccttgctgacgttccctagttatctcttcgctatctagtctgaagctggagggtagggtttttctgggtctcatttttcgtcagcagcactcaatacagatggtctccaacttctgcttcggtgtacgatttttctactttatgatggtgtgaaagtcatactcatttagggtactcctcaactcatgatgggattatatccagataaacccatcataagttggaactatttttttttttttttttttttgagacggagtctcactctgttgccaggctggagtgcagtggcgtaatcctggctcactgcaacctccgcctcccgggttcaagtgattctcctgcctcagcttcctgagtagctgagattacaggcacgtgccaccacgcccagctaatttttgtgtttttagtagagacagggtttcaccatgttgaccaggatggtctcgatctcttgaccttgtgatccacctgccttggcctcccaaagtgctgggattacaggtgtgagccaccacgcccggccaagaactatcattttttatttaagtttctggtgggtttatcgggatgcaacctgtcgtaaatggaggagcatgtgtatggttaacacagtagactctctagaaatgcttattacacagcaaagtagcacaataatttgtatgtatgtgtgtaatgtgtatgtgtgtctcctccaggccgtatctgaggaacagcagcctgcactcaagggcaaaaagggaaaggaagagaagtcaaaagggaaggctaaggtgagagagtaactagcaggaggaggtattggggcccaggaattaaaacatttcatcagggctgggcgcggtggctcacgcctgtaatcccagcactttgggaggccgaggtgggcggatcacgaggtcaggagatcgagaccatcctggtaacacggtaaaaccccgtctctactaaaaatacaaaaaaaattagccgggcgtggtggcgggcgcctgtagtcccagctactcgggaggctgaggcaggagaatggcgtgaacccgggaggtggagcttgcagtgagccgagattgcgccactgcactccagcctgggtgacagagcgagactccgtctcaaaaaaaaaaaaagaaaaaaaaaaaaaacatttcatcagacctgtcttttccctattagcctcaaaataaattcgctgctctggacaatgaagaggaggataaagaagaagaaattataaaggaaaaggagcctcccaaacaagggaaggagaaggccaagaaggcagagcaggtgtgtatttggtgttggggcaaggtggaatgagggactagggcttccagggtccttatgggagagttagaatctggggatatagttattatcccagcaaacctttattcttttctttttttgggggagtagttggggtggtggttcgtttgtttttgtttttgtttttgtttacacaggatcttactctgtcactcaggctggagtgcagtggtgtgaacacggctcactgaagcctcaacctcctgggctcaacagattctcctgcctcagcctactgagtagctgggactacaagtgtgcaccactacccctggctaatttttttatttttagtatagagatgaggtctcactatgttgctcaggctggtcttgaatttctgggctcaagcagtcctcctgcctcagcctcccaaaatgctgggtttacaggtgtgagccagcatgccagccagcaaactttttctataaagggccatatagtaaatgtttttggctttgcaggccacatacaatctctatcacatattcttttttttttttaacaactctttgaaaatacaaaaattatttttataaagttcaggagctatataaaaataaatgtcaggtcagccttggcccatgggctgtagtttgcaacacctaatccagtgaagaaagggcctggaatttatctcagatgatctgggtcctggctctgccttcactggctgtgtgaccttgaatacatcttcccatccccttgggtctcacttgtctcctttgtgtgatagaaggaggagtccggagatctctagggtccctatgcgtctggcacttcctaattctgtgattctgctggattcctctgactgtgcactagagcttcctgatctttttttttttttttttttttttgagatggagtctcactccgttgcccaggctggagtgcggtggcgcaatctcagctcactgcaacctctgcctcccgggttcaagcaattcttctgcctcagtctcccgagtagctgggactacaggcacgtgccaccatgaccggctgattttttgtgtttttagtagagacaggatttcaccatgttagccaggatggtcttgatctcctgaccttgtgatctgtccatcttggcctcccaaagtgctgggattacagacatgagccaccgtgcccggacggctacctgatcttttctttgcatgttaacaaggaaaccacagaaactcattttatacaaatgaaactcttgaaatccatttactccaccttcagttacattgtattgggagttacatttatagggacataacgcgttgtcacatttcataaatacacattcataccatttgtcttgtaccattcctggtagcagaaattaataaaggacctcagggagaccaggggctgggtatgagaatgagagaggatcccaagatattttaggactctgagtagtgaaggaaagagctggggcagggacagggggcagatgatgtgaaatctgagttctagaaggagtccctagtttttttttgttgtttttttttttgagacggagtcttgctttgtcacccaggctggagtgcagtggcacgatctcggctcactgcaagctcctcctcccaggttcacaccattctcctgcctcagcctcccgagtagctgggactacaggcgcccgccaccacgtccggctaattttttgtatttttagtagagatggggtttcaccatgttagccaggatggtcttgatctcctgaccttgggatctgcccgctttggcttcccaaagtgctgggattacaggcgtgagccaccgcgcccagccaggagtccctagttttgaccatccccgggttctcacagggttcagaggaagaaggagaaggggaagaagaggaggaggaaggaggagagtctaaggcagatgatccctatgctcatcttagcaaaaaggagaagaaaaagctgaaaaaacaggtaagaccttggttcttagcggtcaaaagtaggggatttttaaatacttcaactaggggacatgcgattggggacacgaaggaaaggtttgggggctactccaagtaaaacaatcggagtaagaaaataattgtgttctgtgaaccttatctcaatgtctgatgacatgggctgtttcactttggggttttttgtttattttttgagacagggtctcacactgttactcaggctggagtgcaatgacgtgatctctgttcactgcagcctcaacctaccaggctcaagtgatcctcccacctcagcctcccgaatagctgagactatgggtggcaccaccatgcctggctaatttttgtattttttgtagagacagtattttagcatgttggccaggctggtctcaaactcctgagctcaagagatccacctacctcagcctcccagagtgctgggattacaggcgtgagccagcatgcccagccagcatgggctgtttcatggtgatgggaaactggtagactgtggcttcaaatgtagtttttcctaccttctcagatggagtatgagcgccaagtggcttcattaaaagcagccaatgcagctgaaaatgacttctccgtgtcccaggcggagatgtcctcccgccaagccatgttagaaaatgcatctgacatcaaggtaaggtctcaaggggccccttccagtccacttacctagggaagagccagttctctcatcttccctgagtggctgtggtgtgtgaatgggttagttcagtgggaagaaagattggaggcattttccacaccttaggttctgccaacttgagcaagaagatagaaaaaccagtagaagtggggtccacccttggcagaaaatagtgtgggacagactagactagctgaggatgcatggggctcccattacaggcagcgaacagggcggggaccggctgtggggagaggaaggggattatgctggaggtagcggtttgtcagaggcttccctgcagggagaaagtggccgctcctgtcccaaagggagaattttcatgtgatcatcccttccctctgccacctctttcctgatggctgcagctggagaagttcagcatctccgctcatggcaaggagctgttcgtcaatgcagacctgtacattgtagccggccgccgctacgggctggtaggacccaatgggtgagaagaggagggagctggaggcaaaaaagggcctggagggaaaagaagagatttctcagtggtggccaggtcctaatagcttttattccccagcaagggcaagaccacactcctcaagcacattgccaaccgagccctgagcatccctcccaacattgatgtgttgctgtgtgagcagggtgagaccactggggagaaaaggggcttggtggggtgggcagttgggtagaaaagccagccagccaagaatagaagaaattgtggctatggagttggaagggatgtggagggagactggagaccgggaaagggatgctaaggaaaggaggggagggtcaatgaggaacttgagagtgttttatttggaacaagtacaaagagctgggcagggtcaggcaaaacagaaatgtaattgaagggaaagaaagatgagactcttggctcttgaggctgcctgactgttctccctctgcctcccagaggtggtagcagatgagacaccagcagtccaggctgttcttcgagctgacaccaagcgattgaagctgctggaagaggagcggcggcttcagggacagctggaacaaggggatgacacagctgctgagaggctagagaaggtagaggagatggcgcaggggacacgggcaaagacttgggggttcctgggaccctcagacgtgtgtcctcttctccctcctcccaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccaggtgggccattcacctcactgccctcccttccagcctcagaccaccggggcccttttcctctttcccttctcattcttccaaggccaatagggaggctcaaggcttacctctccctccttactatctgtgttgtgagaacttagggtctttctctatttatctccctacttggtggtgagttctcatcaacataccctgcagctgggtgcaatgggtcacgcctgtaatcccagcactttggaaggcagaggcaggaggattatcttcaacccaggagtttgagaccagcctgggcaatatagtgagactctatcttcacaaaagggggaagaaaacatatcctagcctgggcaacatagggagaccctgtctctacaaaaaatttaaagatcagctggatatggtggcgcacgctgtggtcacagctactctggaggctgaagtagaagtatcacttagacctgggagatttagactacagtgagcccttattgtgccactgcacgacagcctgggcaacagggcgagaccctgtctcaaaaaaattaaaccgtatcctgcccgagaacttctctgaggagagcttgggaaggagtgttcatggtctcaggctctatctccgagttttctctggggttgtctgagcaaggatctttctctccctgaccctgccctctgctacccaccctctagggcactgttcatggagcccacactgctgatgctggatgagcccaccaaccacctggacctcaacgctgtcatctggcttaataagtgcgttacggcctttgcatcattggttcccattctgcactttcttccccttccctccctgccctgttttcctttagcccttctccactgtgcctgtgagtggagctctattcagacccccctttccctcccagcccccgttgtctgcctgcttcctctgaattctctctcacttgaccactgtgacacttacaccctgttctctgaaacccagctacctccagggctggcggaagaccttgctgatcgtctcccatgaccagggcttcttggatgatgtctgcactgatatcatccacctcgatgcccagcggctccactactataggggcaattacagtaagtaggattgtgtgtggatgcagggaagagatagaacctcgaaaagaggcctgagtgggagggcctatttagataaactgaatcctgtcagaattccagacagtgatgcctaccccatcaccaccagtccctggttgtccctttgctgggaagaggagcaaccactgatgcctggtcccctcttctgccccagtgaccttcaaaaagatgtaccagcagaagcagaaagaactgctgaaacagtatgagaagcaagagaaaaagctgaaggagctgaaggcaggcgggaagtccaccaagcaggcggtgagcacctgagggacttctgggctgggggccactgttctctcctggcagtggaggaagaaggagactctggaacgctggcctacatttcaaggactgccgcgcagggctcaggtttctcttttttcctcttcctctccaggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgagtgccgcgggcctctgctgctccacaggaagcaccggaagcatgtatgtgcaccctaaattctccaccaaggctgagattgctcctgttctccaaggccagcacatgagagggactttgcagggactgaaaagaatataaattgcttcttttcgtggctttcaggtgtgacattcggctaccagggacagaaaccactctttaagaacttggattttggcatcgacatggattcaaggagtgagttggcggggttgcctcagggatgtgtagcaggagccacagggagagtctctggggacctctttgaccacctgtcttccatcttgcagtttgcattgtgggccctaatggtgtggggaagagtacgctactcctgctgctgactggcaagctgacaccggtgagtcctggagccaaggagggagagcatgagaaatgtgaagacacagctgcttttgccagaagctggaatcagggagcctctcgagaatgtagagttaaatacagaactcatgatagatgattcatttccctaagaggggcagtagaggaggaaagagcttagatcagttcaggggggagagctaagagaattaagatagaactagggggcacacccacgtgttttggttatacaagaaatatatgtcttttatagaacgattaaaaattgcataaacgggccaggcacagtagctcactcctataatcccagcagggatcacctaaggtcaagagttccagaccagcctagccaacatagtgaaccccgcctctactaaaaatacaaaaattagccgtgtgcggtggcgcgcacctatatcctagctactcaggaggctgaggcagaattgctggaacctgggaggcgggggttgcagtgagctgagattgcaccattgcactccagcctgggcaacagagcgagactccatctcaaaaaaaaaaaaaaaaattggcctggcgtggtggcccacgcctataatcccaactctttgggggaggctgaggcaggcagatcacttgagcttaggagttaaaaaccagcctgagcccagtgtggtggctcacacctgtaatcccaacactttgggaagccgaggtgggagatcacctgaggtcaggagtttgagaccaacatgaagaaaccccatctctactaaaaatacaaaattagccagacgtggttgcacatgcctgtaatcccagctattttgggaggctgaggcaggagaatcacttgaacccaggaggcagaggttgcagtgagctgagattgcgctattgcactccagcctgggcaacaagagcaaaactccgtctaaaaaaaaaaaacagaccagcctgagcaacatggtgaaatcccatctctactaaaaatacaaaaattagctgggtatgttggtgcacgactgtagtcccagctactcgggaggctgaggtaggagaattgcttgagtccagggggcagaggttccagttagccgaggtcgtgccactgcactccagtctaagtgacagagtgaggctctgtcaaaaaaaaaaaaaaaatgcttaagtcaagagaaaaatctggagataaccagttttttttttttgttattttgttttgagacggagtctcactgtcgcccagcctggagtgcagtggtgcgatcttggcccactgcaacctccacctcccaggttcaagatattctcctgcctcagcctcctgaatagctgggattataggtacgccccaccatgcccagctactttttgtatttttagtagagacagggtttcaccatgttggtcaggctggtctcgaactcctgaccttgtgatccgcccgcctcagcctcccaaagtgctgggattacaggcgtgagccaccgctcccagctgagataaccagtattaatgttttagtggatatctttctccttttttctttgcaaatgtgcatataatttttaacaaaaatgggctgtcatatgagttgttgtgtagctagatttttccaaatatatcaagcatttttccatgcaattacttatttcatatgagtctaccttttttttttgagacagagtctcactctgtcacccaggctggagtgcagtggcacagtcttggctcactgcaacctccgtctcctgggttcacgcgattctcctgccttagcctcccgagtagctgggacaacaggcgcgtgctaccacgcccagctaattttttgtatttttagtagagatggtttcaccgtgttagccaggatggtcttgatctcctgacctcatgatctgcctgcgtcggcctcccagagtgctgggattacaggtgtgagccaccacgcccggcaaactctaccattttatttgaacttttgtaatatattgccatctagtgtgttagaaagtttgtagccatttctgctctctctagcagtgttgagaggccattttctcatatccagagattagatctttagaaaggtattattagattctccccaaaacactaaacttgccacatgaggcccttacgatgtaccattcgtgagtctcgctgtatggagagcaggtgttctttggctgtggttagtccctcctgcttgtccctcttgtcctccattttgcttaactccccttttgtcccttaactcttttactttgctcaccatgcctttgtcatattaggggaacatccctgttccttttcttttttgagacaaagtcttcccctgtccccgagggtggagtgcagtggtgcgatctcagcaacttccacctcctgggttaaaaccattcttgtgcctcagcctcctgagtagctgggattataggcatgtcccactatgcccagctaattattgtatttttagtagagacagggtttcacaatgttggccagcctggtctcaaactcctgaccttaagtgcctcctgacctgccttccttggcctcccaaagtgctgagattacaggcatgagccaccgtgcccagcccctattccttttcttatgcatacttgtccctggcccatttctggtgtttgtctctccttcagaaaagttggtgtatggacgaggtcaggagatcgagaccatcctggctaacatggtgaaatcccgtctctactaaaaatacaaaaaattagccgggtgtggtggcaggcacctgtattcccagctactggggaggctgaggcaggagaatggcgtgaacccggaaggtggaggttgcagtgagccgagatcgcgccactgcactccagcctgggggacagagcgagactccgtctcaaaaaaaaaaaaaaaaagttgatgtatggagctgcagcacctttttcccttgccctcctcttaactactttgtcttcccttgcagacccatggggaaatgagaaagaaccaccggctggtaagttggcattgggatttagggaatgataatctgatggaggaagtgtgactttaaccgaccacctccctctcttctcgggcagaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtaccacttcaggggccagggagggtgcccttcaccttatcattcatgtctacaaactgtacctagaggaaccgagaatgagggagcctcagctcacaaactggcacatcttgagggtttgccttcagaatgtgaggtgctaggtgtgacagccctccccttcctttgctacaggtggtcagaaggcgcgagttgtgtttgctgagctggcctgtcgggaacctgatgtcctcatcttggtgagtgagctgggctgtgggaaaagggataagggtaacagtaatggaagacgggagttgcagtgctcagtcatggaattcctcctatgtaggacgagccaaccaataacctggacatagagtctattgatgctctaggggaggccatcaatgaatacaagggtggtaagtcagctgagagtgtgccctcatccctgctccatggggaccaagctgtagtgtccttcactacagaagggcctaggactcccttatttcatgttctgattcccctctttctcctttcttcctgccctctgttgttgctatctttcttcaaagctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgcagtcttgctgacagtgtttgctgtttaaggatcataggattcctttcccccaacccttcacgcaaggaaaaagcaaagtgattcataccttctatcttggaacatgggtctctttcctttttttttttttttttttttttgacagaatcttgccctttcactcaggctggagtgcagtggcatgatcttggctcactgcagcctccacctcctgggttcaagcaattttcctgcctcagcctcccgagtagctgggattacaggcacacaccaccaggcccagctaattttagtgtttttaatagagacagggttttaccatgttggtcaggctggtctcgaactcttgacctcaagtaattcacctaccttgacttcctaaagtgctgggattatagggatgagccactgtgcccaacttctttttttttctcttttctgagacagggtcttgctgtgttgcccaggctagagtgcactgtaccctcaacctcctgggctcaagcaatccttccacctcagcctcctgagtagctgggactacaggcatgtgccgccacactcaactaatttttttttttttaatttttagtagagacagtgtcttgctatgttgcttaaggctggtcctgaactcctgacctcaggcagtcttcctacctcgacctcccaaagtgctggggtgctgggattatagacgtgagccacgacgcctagccagaatttgggtctcattgtccaagttaatctcatgaatgaggaggtgctctgccctgtggccagggaccagggtattgattctctcaaaaattattaaatcatctagccaaaatgtacggtactgtggggtatataagaagggaagagacaagatctgccttcattaatagtctggttagagaagacttaaaagtaagcatgaatagataattaatttgatcaattgtctaatatgtcgtactctagattctaagttgccacatactcaaaaaagggaaagattatccagggcctgattatttgacagggtcacttgagggtagatcttgaaaaatgatgatttgactaatcagggaccagggagccatttttcagaagtaggaaaagagcagatctcaggcttggggggaagaacaagctacttgggagttaatggatgatagctgctgtggccatttttcttaagagttagactggggagatgggtttggaaagtaaaatgcaaatggtgggtagtggtattaggtggtgatgtgcaaggcgtgctgtagaaacctgcagggtgaagcccataacttttgttacgggaatggggtaactgaatcctaaactagctaggggagatagggatggaaagagcagatgtggaggttggggagaagggagtgacaggagatatatccagttccagagggaatagggagagctgtgtggctaagatttaactgtttggacatttaatttggggaaattgttttccagccaagtgaataaataatactggacttcaagtacaagcttcatacaggaagtgaagttttggtgtggagatagctgcatagtcagggaacactctaaattaaaaataaggaggccgggcatggtggctcatgcctgtaatcccagcactttgggaggcgggcagatcatgaggtcaggagttcgagagcaccctgaccaacatattgaaaccccatctccactaaaaatacaaaaaaattagccgagcgtggtggtgcacacctgtagtcccagctactcaggaggctgaggcaggagaattgcttgaacccgggaggcagtggttgcagtgagccgaggttgcgccactgcactccagcctgagcaacagagcgagactctgtctcaaacaaaaaccaaaagacatcaggaaacatgcctcttatggaatttgagggggaaaagtcagggtcttggcagtgaccttggacaagccattagcctcttgatacctcttttctcatctgtaaaatgaaggtggtagttacctacttcacagggttattaggggattcaatgtgtaataatacgtaaagtgccttaaattctgttgcttttgttatatgtatttcatattatatatatatatatattttttttttttttttttgagatggagtcttactctgttgccaggctggagtgctgtggcgtgatcttggctcactgcaacctctgcctcctgggttcaagtaattctgctgtctcaccctcccaagtagctgagattacaggcacgtgccaccacgcccggctaagttttgtacttttggtagagatcaggttttgccatgttggccagtctggtctcaaactcctgacctcaggtgatctgcccacttcggcctcccaaagtgctgggattacaggcgtgagccaccgcacctggcctatacttttgcatttttaagtttttacttcgctagtctagttgagatgatacataaaatatataggaatgttatttataaagtgaataccagcttgcatttcaaatatttggtcactaatttcactacttcaaacataagtgagaaaagtactttaagtactccaaaataactttccgccacaggcataaatttcatttctctctctgttctttttttttttttttttttttaaagatgaggccttgctatattgcccaggctggtcccaaactcctggcctcaagcagtcctttctcctaggctccccaaagtgctgggattacaggaatgagccacggcacctggccacaaactttatctcctcccgtgtatgttttaacttctgtgatccctgtagccgatcatatgtgctgttaatggaattaataattcacctaaatgtgggcaaaagtatgccctccaaaaagcagcatagaaatggaacacgaaagggaaacatttccatggtagcgcatggaaatttcattaaccaaattaaattgttttatttataaacagcttattacctacaagtgatgcacatatgtggtacacagtaaacatcgtagaaatgtgttttttgttgttttgagatgtggtctccctctgtttcccaggctggagtgcagtggcacaatcatggctcactgcagcctcaaccctctggactcaagtgatcctcctacctcagcttctcaagtagctgggactacaagtgtccaccaacatgcccagccaattttttaatttttttgtagcaaagaggtcttgctttgttgcccgggctggtctcagactcctgggttcaagttatcctcccacctcagcctcattaaagccaaagcctgaaggtaggaaaggaagagccttcagggaagggaccaaaatgtgcaaagaccctgaggctgaaaagagctgaacatggtcaaggaatggctggagctgagaacttgagcatgcgccaatacacacggggccttatatgcatagacagcaggttgggatgtgatcaggagaggctgagcaatgggaggccattggttctgtttagccaggagtgcaaactgattcagttttcatttttacaaaattgctcctggctgctaggtggcaaatagtgggtgtggggagacagggaaaagagatgccaggagaacagctcaatattactttggaaagaagattctcttcatctaagaatggaatggaagggagataatgtagactcagatatttccatgtgaagggaagggaaaatgttgctcacagtggatgggactcactttttcccaagctttggtgccagagaatcaagaagagtaggccgcgcacggtgcctcatgcctgtaatcccagcactttgggaggccgaggcaggcggatcacctgaggtcaggagttcgagaccagcctgaccaacttggcaaaacaccgtctctactaaaaatgcaaaaattagccaggagtagtggcacgcatttgtaatcccagctactcaggaagctgaggcaggagaattacttgaacctgggaggtggaggttgcagtgagcggagatcatgccattggactccagcctgggcaacaagagcaaaacttcgtctcaaaaaaaaaaaaaggtttgctgagcagcagtaagtgtagaatcaatgctaacattaatttgtactgggctaagatagtaggattttgtgatttttcaacattaggtctactgcccaggagtaggaatgaaagaaataggataatgattctgaattgaagatagaccccgttgcacctggggaaggattgacagaaagagaacgttgaatgtcacaagggtattttagagggaaaaaatggaagcagaaaggaaaaacagactgaaacggtagagagaaaagtgcctgcagggagggcttggtgaagaaacatcattgtagtgaaatgaatgaaatgttcaacctctctccccctgcaaaaaaacaaaaaacaaggaaaatcttctctttatataatctaaagtttttacgtaagtaaaaaggaacaggtaggccgggtgccgtgactcacacctgtaatcccagcactttgggaggccaaggcgggtggatcacctgaggtcaggagttcgagaccagcctggacaacatggtaaaaccccatctctactaaaaatacagaaattagccaggcgtggtggcaggtgcctacaatcccagctactcaggaggctgaggcaggagaatccttgaacccagggggcagtgagccaagatcgtgccatttcactccagcctgggcaaaagagtgaaacttgtctaaaaaaaaaaaacaggtttctttgaattttttttttttttttttttgagatgaaattttgctgtcacccaggctggagtgcaatggcacgatctcagctcactgcaacctccgcctcctgggttcaaacgattcttctgcctcagcctccagagtagctgggattacaggcaccagtcaccacgcccggctaattttttgtatttttagtagagacggtttcaccatgttggtcaggttgctctcgaactcctgatctcaggtgatccacgcgcctcggcctcccaaagtgctgggattacaggcgtgagccaccacgcctggccgaattttcataaatgatttgaaagaaaatgagctcattctttctttttttttcagacggagtcttgctctgtcgccatcctggaatgcagtagcgttatctcggctcactgcaacctctgcctcctggattcaagcgattcccctgcctcagcctcccaagtagctgggactacaggtgcgtgccaccactcccggctaatttttttttttttttgagacagagtcttgctctgtcgcccaggctggagtgcagtggcgcgatctctgctcgctgcaagctccacctcccgggttcatgccattctcctgcctcagtctcctcagtagctgggattacaggcacccgccaccacacccacctaagtttttgtatttttagtagagaaggggtttcaccttgttagccaggatggtctccatctcctgacctcatgatctgcccgcttcggcctcccaaagtgctgggattacaggcgtgagccaccgcgcctggcaatttttgtatttttaatagagacggggtttcaccatgttggctaggatggtctccatctcctgaccttgggatttgcccgcctcggcctcccagagtgttgggattacaggtgtgagccaccgcgctcggccgagcttattcttaaaatacagtaaaaactttaagctctcttttaaggttcttgtggcttgttgcaggagatagaagaaaggtgagaagcaggcagtaaatggaagcagaaagagacacaaagttgtgaccactaggttgtgacatgtttgggttttttcacttgagctgtatacttctttggtatttcacgccctagcctggtccttagattatgtcttctcaggtcttctcccagtgcacacagcaacaacagactgacctgaacacctccgcccacacacaccaagcctgggcaaggggaaggtaaaactacccactttgggcctacatgcagtgaggcctttcagatactgataaaacattgttgccccctcatgtggccaatgctggaaatacagctgagacacgtattccagggcagtgtagcagcctcagcaactgggaatttgttagaaatgcatatctcgggatccatcctgacctactaaatcagaattttgctggaccctacccccaatctgtctgttttttctttttgttttgtttttgttttttgagatggagatggagtctggctctgtcacccaagctgaagtgcagtggtgtgatctctgctcactgcaacctccacttcccgggttcaagtgattctcctgctttagtctcccaagtagctgggattacaggcgcgagccaccatgcctgactaatttttgtatttttagtagagatgggatttcaccatgttggccaggctggtcacaaactcctcacctcaggtgatccatccgccttggcctctcaaagtgctgggattacaggcataagccactgcatccaacccaaatttgtttttttttttctttcttttttttttttttttttttgagaccaagtttcgctcttgttacccagactggagtgcaatggtgcgatctcggctcaccacgacctccacctcccgggttcaagcaattctcctgcctcggcctcccgagtagctgggattacaggcatgcgccaccacgcccggctaatttttgtatttttagtggagacgggggttctccatgttggtcaggctggtctcgaactcctgacctcctgatctacccgccttggcctcccaaagtgctgggtttacaggtatgagccactgcacccggccccagatttgttttctaataagctcttcagatgatcctgatgaatgctaacagacttgaaaaccgccattctcaacccacatgttaaaacatgttaatatcttcaactgccccatatctgccacacacactccccccagagtgatgtatcctttcttttttttttcagatggagtttcactcttgttgcccaggctggagtgcagtggtgcagtctgcaacctctgcctcctgggttcaagcgattctcctgccttccgagtagctgggataacaggcgccagtaaccacacccagctaatttttgtatttttagtagagatggggtttcttcatgttggccaggctggtctcgaacttctgacctcaggtgatccaactgcttcggcctcccaaggtgctgggattacaggcgtgagccaccacgcccagctttaatttctggtttaagagtggaggccaggcgcggaaatggggaaatggagtttccctatgttgcttagggtagttttgaactcctgggttcaagtgatcgtcccatgtgggcctcccaaagtgctgggattacaggcgtgagccaacatgcccagctttaatttctggtttaagaagagtggaggccaggcgcggaaatggggaaatggagcttccctatgttgcttagggtagttttgaactcctgggttcaagtgatcctcccatgttggcgtcccaaagtgctcggattactggcttgagccaccatgcctggccagagccactttgggaagagcagtctatacttaccctttgtttttttgtgacggaattttgccctgtcactcaggctggagtgcagtggcatgatctcggcccactgcaacctgcacctcctgggtttaagggattctcccgcctcagcctccggagtagctgggttataggcacccagctaatgtttgtatttttagtagagacggggttttgtcatgttggccaggctggtctccaactcctgacctcaggtgatccacccacctcgccttcccaaagtgatgggattacaggcatgacccaatatgcctggctttttttttttttttttttttttgagacagggtcttgctctgttgctccggctggattgcagtggtacaatcatagctgtgagtttgaactcccaggctcaagtgatcctctcgcctcagcctcccaggtagctggaactaaaggcatgtgccaccatgcctaatattttttgtattttttgtacagacctggtctccctatgttgctcaggctggtctcaaactcctgggctcaagtagtcttcccacctcggcctcccaaaagtgctgggattacagacatgagccactgatacccaacactaacctggctaaggtcacccaggctgtagagaggtagagctgggacaatggcctttatctgactccagcatcctcaggatttcctcccttatctgtagaatgtggataagatgaccaagaacacatcctagagggcacgatagccaggataggactgttctaggaacacacacgaggcgtgttaaagaagactcagaaagatgaaaaccaggaaagagccctgtggccgagatctactctgtatcctagagtattttatgtactttttgaagcattttttcaccagtacttaatagcaactgttagatcaagcattagctccagaggagtaaaaatcagattccacagatttgtactaatgtatctaacacaggtggtaatggcttttaaaaaaaaaaaaatgaaaaacagtccaggccgggcgcggtggctcacgcctgtaatcccagcgctttgggaggccgtggcgggcagatcacgaggtcaggagttccagaccagcctggccaacatggtgaaaccaagtctctactaaaaatacaaaaaaattagccaggcatggtggcaggtgcctggaatcccagctactcagaagactgaggcagaagaatcccttgaacccaggaggcagagattgcagtaagccaagactgcaccactgcattctagcccaggcaacggagcgagactccgtctcaaaaaagtccaaacacactaggggttaaataagctgcttctctttccactgtttattattaatgtacaaaatatacaaaaccaaaaaaaaaaatactcatcctcaaatccattttggctctaacccaagaccctgcacaaaacccaaccaatccactgttttcatagaaaacaactgatgccaaagtgaaggagagaactgggaaagggcaaaatcatcttgttgaatccacccaggaaggcgcctggtggggattcagaggtggttgacagggtgaagtacctggaagcctccttcacgctggcaaggttccaggtgggagcagggagtgagctgactcccaaaggcagtgcatgtagtgtgactttcaggcccagcacgccgggcccaagttgatgagaagctggtctcactgaagtattttatcaagtctccagactggctatagttggcaaaggcagaccagcaccaccggtctcacctctgccagctaaaacttgcaccggatgcagatacgagttcgccatcatcgaacctagcagacccaggacgcagactgggtgttcacagaaagttgaaggtcccacttgagaaaggactaagaatggtgagcccacgctgggggaggggtggggatgatgtgtgttccagaactcaaatccagctgattgagccctctcagtgcagtgggatatacaatacccctttcagcatctccccaccccatgaggaataatgaacttagctgggatgatttcttaagtgcagctgatcctgtgtcagagttctgtgtgcatgtggggacccgcaatagaagggtaggggtgttcgccaggataaccagctttaggttctcaagcattaagggtaatactggaaaggggtttggggtacagggcgaatcttctcaaaaagtgaagccaactgggtctcctcttcagcagtccaggaacgtttccagtctctctcctccccagactggaggaaaatatgtacatcaatgcgcaccagtgatcagaaaacccccaggaacccaagcaagtgggaactgagggggccggctcctcatcagctggggaaaagggaaaatgggcctcacagaagccataacagggtggaaagagcgaggctgcagtccacaggggttgtgtgaacag

SEQ ID NO: 320 - DNA, 35675 bp, Homo sapiens
tagttctgactgtttatatgacccagcataagcccttcccctcactaagcctcagactacctatctgtaaaatggaggtgataggccagatttctgaggggccctcctgctctaacaacccatggtttcatgaagaccagctttgtgcccagacatgtaaggcatataccgaaggacaagttattttttaaccaatggttggtgaatgagtgagtgttgaattaatgaatgaagtatgccttttttgtcccaatatcttgcccataagccaaatgaagagtaattcgaggtttgaaattgtgcaaactggccaggcacagtggctcacgcctgtaatcccagcactttgggaggtagaggcaggtggatcacttgaggccaggtgttccagatcagcctggccaatatggtgaaaccccacctctactaaaaatacaaaaattagccgcatggtggcacatgcctgtagtcccagccactcaggaggctgaggcaggagaattgcttgaacctgggaggcagaggttacagtgagccaagattgcatcactgtactccagcctgggcgacagagcaagactctgtctccctctctaaaaataaataaataaataaataaaattgcacaaacttaggcttaaaatcccagcccctctatttcccagatgtggatcttggggaagtcactttgcctcagtttcttcatcttgaaaatggaccattaatgtccagttacagcctcttccccaggacgctgtgagggagagatgtgacagtaaagtgcctagagcaggatgtagaaagtggaccctcagaaaataagaaccccagcctttctgctcacatgggagggcagggagctgaaataccttctgcttatcccaaggcattttcccccacccttctctcctgtgccactcagaaagggtaggagctactttggagagattttgattttatttattgtattgtataactatcaaaatctgccctaacaactgatacctaggctttgtgacaggaagccacaataactttttcttgacctgcagctgccctgcggataaaagataaaacaaagctggggagccactgagattatcaggcctgctgcacaggaaaagggcagtatgcagcaggggacctgggctccaggccccatactcagaaacctctgagggaggcagaggcaggtggatcacttgagcccaggaattcgagaccagcctgggcaacatggccaaatcccatctctacaaaaaatacaaaaattagctgggtgtggtggcgaacgcctctattcctagctactggggaggctgaggtgggagggatgacctgagcccagggaggcggaggttgcagtaagcagagatggtgccactgcactccagcctaggtgacagagtgagactccatctcaaaagagaaagaaagaaagaaagagagagagagaaagaaagaaagagagagagagaaagaaagaaagaaacctctggcaagctgtgtggttaagccaagtaactcaccctctctggtcctcagtttccctgtttgcctacttcccatgtgtgaggttcaaatcagattgtgcaagcctgtgaacactgtagaaacaataatcattatgtaagtgatcatttcgtcagcctttgctctatgccaggcacgggacgagcgttcttacaagagctgcaaaattagttttagcagtattgttcctgttttacatatgagaaaacctaggctcagcgaggtcagattccaaccaacccaaatcacgcatcttctcctggcccttcgttttctctcgggagacatggcctccctactattgcataattactttgtgaagttaaagagcgttgggtggaaatgagtgggacagattggagatgacgtgggtggggtgggaggattcaaggagggtacgcgcctggccggactgggatgactctgcggcaggcctgggactccctcaggccgacccaggcttcccaagtccctcctggagccaagggcccgggattctcgggcggctcgggcgagcgggcggggcaggaggcggggcggcggcaggaagctgcccgagcggcgctctgagcggcctgagcccggcggagccctgcagaacccggccgacctccatgggctgcggggggctgcacccggacccctggggcgcggcgcgcccctgaatgcaccgtgggacgcaggaggtagaggcgcacgaggcggcgcaagagacatcgggagggtcctgagcccctccggggaggaacgcggtcctaggctgagtgggttggggggaaagcgatgctggctgggtcccctggttcgcaagacctcggactgccagggggtggggcctcaccgcgcccctccctctccggttcgggccccgcccctcctcctcctgcgccgggctggggtacccctcctccgggatccggtacacagcgtcgcgcgctccccccagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcaggcgagtgcaggaggacggaggcgggaaccctggggctcgattaggcctccatcccagccgcgttcccagagcatccagggcgctaagttgatccagctgaaactcccacacttcttaaagcgcctgggccacctcttggctgtgtgaccttgagagagtcttaacccccctctgagccaagttttcccttgtgtcaagtgggagaactcactctcatctcagaattgctgcaggcattaaatgtacagggcttgggatccgaatggaaatgatgtattaacgatattttgagggtggagctattaatttagcccctactgtctgccaggcacggtgtttggctcctcggtgcctctctgtccctcagtttccatttctgtaaaaagggggtaagtcctgcctcacactgggaggatgagtgaggccacgtcagtggttgatgtcgaccctggccctaggcccattgatatgactggtcatgtgtctgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtggtgagtgagggtctagaacccctgggctgtgagtccagaagtatggctaggagcaagtagggaagaccccaacttcctgaggggtctatgtagttataaatggttaccttgtttacaaatggggaaactgaggtcagaaaggggatgtaacttgagcaaatcctcacacaagacttagtttccttgagactgactgaagtggggattaaggaccttcctcttaacctggttttgagactaagagaactggtgtgtgcacttccccacccagcccacaaggtttttgcaaattgtagcaagatgtgagatacagagagacagatgttatctgggtcaaacttgagatccaagttgcatgggctggtagttaaggaaataggctttcgatccagaccaatcttgactcccacttatttccagttgtttgactctgggtgagttgtttaaccttggtcatcttccgtttcctcattatagcaatggggaaaatgcagaagattacagcaggagttaaatgagacaatggacaaaaagcccttagcagtgtgcctggcattatgacgtggtcaatgaaatggtagctatgtcatcattatttaactttgggttgaaaatgtttgtcatctagggcctgctgtgtccttataacgcacaggtcaatcagttctcaagcacccgaccttgtccctaagggctagacttagagggttggtggaggttaggatgaagagcaatgttggggaggaccttggagtcccttgctgttttccttgctgttgagagactgacttggagaatgaggtctgctcctttaatgcccacagcgactcctgctccagtcccttttcaggccaggcctgaaagccagctgagctggccactcctgtcagtggcagctctccatctctcactcccctcctcttcaccacccttctccacctctgactcagcaggagggggcctggagcccagtcccacatctgggcctctccacccttttctgttgctgttagtaagcaagggccacacccatggggtgactactccaatttcagcagggaccgactccgattattgagtcttttaaaaaaatttttgaggccgggcgtggtggctcacgcctgtaatcccagcactttgggaagccgaggcgggcggatcacgaggtcacgagaccatcctggataacacggtgaaaccccgtctctactaaaaatacaaaaaaatagccgggcatggtggcaggcgcctgtagtcccagttacttgggaggctgaggcaggagaatggcgtgaacccaggaggcagagtttgcagtgagccgagatcgagccactgcagtccggcctgggcaacagagcgagactccgtctcaaaaaaaaaaaaaaaaaaaaaaaaaaattttgagacagggtctcgttctgtcactcaggctggagtgcagtggtgcagtcataactcactacaacctccaactgggctcaagctatcctcccacctcagcctcccaagtagctaggactacagctgtgcaccaccacgtgtggccaatgatgaagtctgaagtggcaaaggtctcagaactctgggttcatacactggaaggggacaccaaggaatagttcagaggctgagaggaatgggggtgactgtgggtacctggatgggaagggatgacaagatagagcaggatggccaagtatgccccggcctgtgtctggagaagcaaggcacctcctgtgtacaatggggaccctaattccccactcaacttgtgggggtgaagagcacaggctttggaatcagatcaacctgagtttaaatcccagctgggctgttttccagctgtgtgacttacggcaagtctttgagcccttttccccctctttgagcctgcttcctcagctgtcagagataaggaccttccttgcagtgctgttgtgatgattaaatgaaatcacagatgtaaagagtgcttggtacaacaggaggcacagggtaaatgcttgggtaatggaactactgtcattatcacccatctggctgcatgttacaaggtcaatgagataatggatacaaaatgtaaactagatgaacataaaggcttattatatagaccagtgtgtcctgaagaaaactggtgtcctaaagtgtgtcctgcagaaaactagttccctggaatgttaatagctgtttctaaataaaggttttgcaggcaatatgttttgagaatgcagagttaaatgagaatacaataagtttctttattgttaaagtatttaatccctaatagtgatatacactgtgaatcttcaagaggacagagtaagcaaacctaactgaccaggagtggctagagtattgtcagttccacagaacaaatgtgagagaaagatctggatttggtgttagggtgcctttaacatctaacactggttaactctccttttaaacctgttggcttggcattataggttaatccatattcaggttctcagacctgggaggcggggaacttcgtgatcatcttgttcagtgttttccaaacctcagtcattccaatacctccctgattcttgtcctatctaaaaatgccacttgtgtccttttcttcttaacatttttctttaaatgaacctatttttttttctttatctttttttttttcttttttgagacagagtcttgctctgttgcccaggctggagtgcagtggtgcaatctcagctcactgcaacctccacctcctaggttcaagcaatcctcccgcctcagcctcctgagtagctaggattacaggtgcccaccaccatgcctggctaacttttgcattttcagtagagatggggtttcactgttggccaggctggtcttgaactcctgacctcaagtgatctgccgcctcagcctcccaaagtgttgggattacaggtgtgagccactacgcccagccgaacctattttttttcttaaataagtttatcgagacggagtcttgctctgtcgcctaggctggagtgcagtggcgtgatcatagctcactgcagccttgaactcgtgggctcacatgattctctgcctcagcctcctgagtagctgggaccacaagtgcccaactaattctttttctttttctttttcttttttttagagacagggtcttgccatgttgcccaggctggtctcgaactcctggccttaagctgttctcctgcctcagcctcccaaagtactgggattacaggtatgagccactgtgcccatcctttaagtaattttaaaagacaacttcatagcactaccgtacgtggaaagtctcacttgccaccgagagaagctagccataaaaataaaaggtgaggcacggtggctcacacctgtaatccccgcactttgggaggctgaggtgggcagatcacctgaggtcaggagttcaagaccagcctggccaacacggtgaaaccccgacactactaaaaatacaaaaattagccggatgtggtggtaggcgcctgtaatcccagctactcgggagattgaggcaggagaattgcttgaacccaggaggcagaggttgcagtgagcggagattgtgccactgcatgccagcctgggcgacagggcgagactaaataaataaataaagtaaataagtaagtagtgaaaatgaaacgtcattaaatcttgcctagatgttgttgcctgaaggaggccctgacctgagatccactttctgactcttttctaaaaatggagatgagaagtgttagagaagtactttttttttttttttttgagagagagtttcactcttggtgcccaggctcgagtgccatgagcaatctcggctcaccacaacctccacctcccaggttcaagcaattctcctgcctcagcctcccaagtagctgggattacaggcatgtgccaccacgcctggctaattttgcatttttagtagagacagggtttctccatgttggtcagcctggtctcgaactctcaacctcaggtgatccacctgcctcagcctcccaaagtgctgagattacaggtgtgtgtgtgagccactgcaacctgcccaagaagtcctttttttaaaaccaaactgagagctggccaggcgcggtggctcacacctataatcccagcactctgggaggcaaaggcgggcggatcacaaggtcaggagatcgagaccatcctggctaacacagtgaaaccccgtctctactaaaaaatacaaaaaattagccgggcgtagtggcaggcgcctgtagtcccagctactcgggaggctgaggcaggagaatggagtgaacccaggaggcggagcttgcagtgagccgagatcgtgccactgtactccagcactccagcctgggcaacagagcgagactccgtctcaaaaaaaataaaaaaataaaaaaaccccaacaaaaccaaactgagagcttctcaatttgtagtcagaaagattaaaaaacaattaggctgggtgtggtgctcatgcctgtaatcttagcactttgggaagcctagctaggaagattgttcaaggccaggagttcaaggccagccctagcaacatagtgagaccccccctcatctccatacaaaaaaaaaaaaaaaaatttttttaaatagctgagtgtggtggtgcatgcctatagtcctagctacttgggaggctgaggcaggaggaatgcttcagcccaggaggttgaagctgcagtaagctatgattgtaccagtgtactccaacctggccaacagtgagaccctgtctcaaaaaataataattaaaaggggaccaacctcctgatacagtgatatttactctagtgcacaccacctaaaaacctcaggtaccaatacttgtacatgtctcatttttggacaaacactgacttgaccgagcacttccttcactagaaacagaagtggacccagagggggactcccttgcctgggtcacacagagaaggagtagctgacctggggttagaacttgagtcctaggccagtatacttttcacagttatggcagttgtggctatctacagacctgtcctctgggtctagtttggaaaagcctgaccagggatgtggaggccaggtgtccaaagtggaacaagctccaagctggtcctaaaggagccccaagagattggctggggtttcagcttatgtctggttttccagagggggctgtcagaagaactaatgctctatgggaagggagtacaaaaaaaggggcagcagccccgggcactgaagctcatctctgtctttctctcttcttgctgccttgggcctgggtcatttcagacaaacctcaggtaagatgggactgggcttccccgccactgcgcagcagctcccgccctcctgggtgctgtcccaggggtgaaaggaagaggtggggaggtacagctgggagtgtgggggatggggaaggatggggagggaacgggcccgtggacaacttgcatttgccctgacacccaccctccctgcagctctacaccctcgccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactccagtggtatcagtctctttattggatgtgagggccaaaagggactgtaactcctgtctcaggaatggggatagatgggaggttcttgaagccccaggcgaagctggtacctctggctacagcttgctctctgagacctggggcttcactcggatcacgccctcctgggcacaggtcacagctaggactccatcctgacgccacagccgcccatggaccagcccccgagagccacctgtgggtgaggtgaagggtgatgatggcctgcttcagaacagccaaatacactttttttttttttcctgaaacagagtctcactaagttgccaggctggtctcaagcgcctgggttcaagggatcctcccgcctcagcctcctgagcagctgggattacaggcgcacatcaccatgcccaacctccaagtggacttcttgcaaagggtctggcccagggcagggctgccccacacaagggtgcactgagtgtcgtggctgctccaaatgccccttcatgagcttattatggaccgtcattgaggggtaactcctcccacaggaaccccagttgacagtttaaaagcactttcacacctctcctcgcttcctcaaaaagatcacagagggaggagctctgagaacagtctccttcaacagttcggccaagcagaactgctgtacctctgaccacttgtgttaggaaaactatcggctccctgtataataaatcaagccaggtcctccaagtggtaattcatgaaaaatatccccactaccaccaccaaggggaagaaaggactcagaagagaggacttgaggccatgaggtctggcctcttccctccccatctggagactctttctcccttgctggctttgggcccaagtttgatgtttatgaggatgattgctggtttcccttacacatagcagagctcactcagttctcacagtagccaaatgaagcagttatgtgttgtccagttttccagaccaggactgaaatccagagagggtcaggaatttggccccatgatgaagccaaatctgaacccatgtcctcacttcaaggttatcaatcttggattgtgatgctattggtacttgagaataccccttatctgagtataaagaatccttgagttttgtccttggtttatcaagcaaagcttttcttcatttgaaatgtactcccttggaaaggaggtcagggttctgaagctagacattgatgaacgagtcttgtttctctcccctgcaaggaaggtccaagcaggcccttagggaccactgaatgccccgatcccaatcaggttaatcagaatcacttagagaacttaaaaatacagtttcctggaccttatccaagacctactgagtgagaatcttgagggtggaatcagaatctattttgaaaaggcatccccaaatggcagtctgatggactgcgggtttggataccactgctgtaatgtaaccctctttgtttagatgaggaaactgaggttcagatggaagatatgatttgcctattgtaatacaaagaatctgaactggttttgggactagaactgggtccctgggagaaggtgaatcacatttccagcacattctagaaatttagagcagagcaggtgtcccggcctcaccctctcattttgaagatgaagatgccaaagcctgggagggaaggaaaggaagtgacctgtgcagcgccacacaggaagtcgggaaatcagcatcacccaagaaagcaggctcctgccactcaaggtcagtgcccttgtcccacacggccccacactcaccggcccaggggctctcgcattcatagagcatccagtggtcagctcggaagggggcgtggaaccacatggaatggtccagtgagaccatgaagtgcaccttgtgctgccactggtgaggcagcagtgcagtgcccaagaaggcatagtcggagatataggcggccacgcagcagtgcatcttcatgtcgccctcgcctgcaacaggtccccatcagccctgggctcctgggctttccagctcaggacctgcacggaggtagggggaaaagggactcccgtgcatgggtgtgcagactggttgctgcacaagagcgcttggcctacagtgtgtgtgtgtgataggggagaagtgagatggcgacttggggagggcaggggtgagcagggactgaaattcagtcttcaccacccaagtctcccactctaggccccaaaaggggtgtcttcttccaatttgcacaaagatactttatagttagcagcaaagctggacaacaaccccagcgaggtgccttttgccttcctcagaaaggccttgtgtcgggattatagtcatctccaccttctccccatgcaaagggctgagagggcccaggtgagaagctaagccaacttccccatcatgcagataaggaaacaggcccagagaagggaactcatgtgcccaaggccacacagcaaatgagtggtagaccccttggagagtggtttcctcccatccatggggtactcttaccaatatagccccgggctcgcacccagaacatctgtttgggctccattctctgcagctggctcaggggggatgggtttactggcttgatctcaatggggacctcctgagcagcaattcggttgagcgccaatgggtacctcttttggaggttagggtccctgaaagtaaagggaagagggtcggggtgagacccaggaagagagggagtcacatctgcattgcctcttctgactcccctcattcttccacagggacccctgatatccccaaagctcccctcccctgtggcaggcaggatagtgcagcgtttgaatcccttcttggccacttacgagccatgtggtctcgtgctaattagtaatctgagtctattttcccatctgcaaaatgtggataatgatagtaacctacctcataaccaacactgtgaagacaagatcatgaatatctaaccaacacatcatagtaataaggcataccctgtaatatgcactgttctaagcattgtacatacaatagtattcctcacaacaaccctgtgagataggtactattatcacccccatttcatcagtgaaataagcacagagtccaggtagcttgcttaaaaattggagagacaggatttggactcaggcaatctgggtccacagtatgattattttctatttttttagagacaaggtcgtcttctcacccaggctggagtacagtggcgcaatcagctcactgcagtctccaactcccaggctcaagccatcctcttgccttggcctcccgagtagctgggactagaggtgtacgccactgtgcctggctaacatttttattatttctttattttgagacggagtctagctctgtcacccaggcttgagtgcggtggtgcaatctcagctgactgcaacctccgcctcccaggttcaagtgattctcctgcctcagcctcccgagtagctgggattacaggcgcctgccaccatgcccagctaatttttgtatgtttagtagagatggggtttcactgtgttggccagggtggtctcgaattcctgacctcatgatccgcccgcctcagcctcccaaaatgctgggattatttttacttttttttgtagagatggggtctctttatgttgcccaggctggtctcaaaatcctggccttaagtgatcctcctacttcagcctcccaaagtgctgggattacaggagtgagctgctgtgcccagccacttcattattttaaacactcaagaaacaggctgcctgacttggcctgagttaccaaaccctacacagtagggaacattgcatccccccagggggaggagcccattccaaggaactcccttcaatacagtgacaaccacccatagtgctctgcacaggtcctgccattttcacccctatcctctggagtgctgttggacagaacctcctatgatgatggaatgcctatctgcacagcacactatggtagccactagccacatgtgactatggagcacctgaaatgtggctaatgcaactgaggaacagaattgttcattctactgactttggtttttttttgtttttttttttttaagacggaatctcgctctgttgcccagtcaggagtgcagtgactcaatcttgcttactgcaacctctgccccctgggtccaagcgactctcctgcctcagcctcctgagtagctgggattacaggcacgggccaccacgcctggctaatttttttgtgtgtgtatttttaatagagatgaggtttcaccatgttggccaggctggtctcaaactcctgaccttgggtgagccacccgccttggcctcccaaagtactgggattacaggcatgaaccactgcgcccggacctatttaattttaattaatgtaatatagccacgagtggctagagactaccttattaacagcacagatctaaattcaaggtcctttaacaatgtcttcctttcatttcagcaaacatttgtcgaactgcaaccacacaccaggccctgtgttttttctgttaatagtgatataactacaattcactgccattgtgctagttagtactagcacgctaagtgccttttctctcttatttaatcctcacagcagccttatgaggtaggaatatgattagcaccattttataatggtgagtactggctcagagtgggaaagcaacttgcccaaactcacacagctagtagggacaaaatctagaattgaatccaggcctttcaggttcccaaacccacatccatcccgtcatactctgctgcctccccagtatctaacacgagatagagacattctctccttatgatacagctaagaagtaggcagggcagaaatgagcattcccattttttagaagaagaaactagggccctggggagttgggcactgtcccacagcaggtgagcattcacagaggcacagccctggacagaatccatgtgtctatcctttgtctggacccagagctctttcccctgtaccagcatttttcaaacttgattaggtgtgatccaaataaatatattttaccaggtattcaaaatatctaacatgctccctggtggtctaatggttaggggaaaatacatatttgtatttttgtacatatgttttatatacataaaacatgtggccgggcacggtggctcacgcctgtaatcccagcactttgagagaccaaggcaggtcgatcacttgaggtcaggagttcaagaccagcctggtcaacatagcgaaacctggtctctactaaaaaaatacaaaaattagccaggcatggtggcatgtgcctgtaatcacagctgcttgggaggctgaggcacgggaattgcttgaacctgggaggcagaggttgcagtgagccgagatcatgccactgcactccagcctaggcaacagggcgagactctgtctcaaaacaaacaaacaaacaaaaacatgcactaatgcaaaggcagtgaccaaacataggccatagcgctgcagctctccagaggacactcactcctggtgtgcattaagtcctaagttgctggaccaggggcctgggggagagagggaatcacttagggggctggggaggtggtacttaacaagtggttacggaagtatttctatatacatatatatataaaatatatatatggttttttttcccaggtatggtggctcatgcctataatcccagcactttaggaggtcaaggtgggtggatcacctgagatcaagagtttgagaccagcctggatagcatggtgaaacgccatctctactaaaaatacaaaattagctgggcatggtagcaggtgcctgtaatcccagctacttgggaggctgaggcgggaggatcacttgagtctgggagtcagaggctgcagtgagccgagatggtgtcactgcactccagcctgggcaacaagagcaagactccatctcaaaaacaaacaaacatgtatatatataaacaacaacaaaatatatattctttttttcttttttcagacagagtcttgctcttgttgcccaggctggagcacagtaacacgatctcggctcactgcagcctccacctcccaggctcaagtgatccccccgcctcagcctcccaagtagctgggactacagacacatgccccgacacccggctaatttttgtattttttatagagacagggtttcaccatgttgcccaggctggtcttgaactcctgggctcaggtgatcctcccacttgggcttcccaaagtgttattataggtatgagcccccacacccagccccagccttatttttaaattagagatggagtcttgctatgttggcgaggctagtatccaactcctggtctcaagcaatcctcctgccttggcttcccaaagtgctgggattataggtatgcgccactgcacccggccaagcccttcattttataccatgacccagtacagacacacaccagaaacacacatgactaaacctcaagtttcacaaaaggattcttgcccttaatacatacatattattcactccagtatcttcttttctaatctgtattttaaaaatgctggtcaagacccactaaaggattctatgacccacaaacagatagcagctgcattttgaaaagtctgccatggagcctccaggtctctcaccttaaatactggtcaatgagggtctcacagtcaagcagctcttctggtggtggcacagtgggcatggagaactggtgctgcatggggctgggctgggcctgctggaaggaggcctggcagatgaagatgggcttcccatgttgcacggccttcacagagcgcaccgagaagctcgaccctgttcgtgtccgctccacttggtacagtactggcagcttcgggtcccctgcagtgggcacaaggacacagtgggtccacaggccctgtcatcatcacaacgcctgacaggcactctactactcatcttccattccatttcatctcagtgactactaactgaggtctgctaaggtccaggcccagggatacagagaccaccaggccctgtcatcaggcttctccctgtgcaggtggagcttttctctaacagcacaaacagcagagacattgacagattccttgcattcaaatcctggctccaccactcaccagccgtgtgacccttcacttctctgagcagtgtgcttatttgcaaactggggatcatcatggtgctcatcgcttacaggattttaatgataatgaaatgaatccgtagttgtaaagtgtttagaataatatctggcacatagtgagggctctatatgtgtttgttaaataaaattaatactccttgcttctatcttgctccatctatgcctgggatcttgtcatcagtccaaaaccattattctagatcagggagcagtaaatctagcctgcagcctgtttactgtttattctgttgttgttttcttttttgagaacaaacaaaggctatttattcagcgcttgttcttttttttgtttgtttgagatggagtcttgctctgtcacccaggctggagtacagtggtgtaatctcggctcactgcaacctccacctctcaggttcaagcgattcctgtgactcagcctcctgagtggggggggactacaggggtgcatgaccatacccagctaattttttttttttttttgagagacagtttcgctgggtcaccgaggctgaagtgcagtggcgctatctgggctcactgcaacctctgcctcccaggttcaagccatgctcatgcctcagcctcctaagtagctgggactacaggcgtgcgccgctacacccaacaaatttttgtattttttgtagagatggggtttcactgtgttgcccaggctggtctcaaactcctgacctcaactgatccacccaccttggcctcccaaagtgttgagattacaggcatgagccactgcgcccagccaatcagagcttgttgtagcaggaagtcaaccaccatcacttgcttttggcagagacttagaggcaggcaaaggaatgggaatgctctgtagtggaaaaaaaggcttcagggatgctcccattgcaggctgttggcatggggaagctgttggtgggctaactagaagcatgacacctggctgggcacggtggctcacacctgtaatcccaacactttgggaggctgaggcgggcagatcttctgagaccaggagttcaagaccagcctggccaacatggcaaaaccctgtctctactaaaaatacaaaaaattagccaggcctggtggcacacacctgtaatcctagctactcgggaggctgcagcaggagaattgcttgaagctgggaggtggaggctatggcaggagaactgcttgaacctgggaggtggaggctgcagtgagccgaaattgcaccactgcactccagcctggggaacaagagtgaaactctgtctcaaaaaagagtgggacatcctatgtgattggttaggagtacatatttggctttctccggttggtcctaagttggaagcaggggcaaaaattagggcagctatcagttattaatcaagtcctggctttggaggccaattgttacagtggtcattatttggcttgctggactggttggtaaagatagtggtctgacttcctacaagtctgacttgtggatagtaggctggcttcctgtgctggttgctgctattgtgcgtcagagttctgtttttctacatggtctagccattgtctgtttgtatattcagcctctcccaggcaagggccactgtcagtcacttcacccctgatgtatatggaagccatttggtccttcactgtcaggtgtctctgctccaaagcagagtggaagagcctaggcaacacagggagaccctgtttctacaaaaaataaaaaataaaaattagctggacatggtggcatgtgcctatagtcccagctaatcaagaggctgaggcggaaggatcacttgaggccaggagatcaaggctgcagtgagccatgactgcgtcactgtgctccagcctaggtgacagagcaagaccttgtctcaaaaacaacaagaccaccaccaccagagtagaaggcactggccagggataaggcagccaacaacaagcaggtgagggaagatttggagaggaagagaacttccctggtttccctgaagttctcactttgtctgagtcaggctgaccttgaggaaccctgacatctgggccatgagacatcttggggatgactttcaaccttcagatgaaagaagcaggtctagagaagtgttgcttccttcactctgatccaaatggggagtcaaccaggcaccagggctcaatcaacagcaataaacatcactgtctgaggtcaactggcttgctcagctctctgttatcaggcactgccaccagcagcacttctatcagagtgcgagctcctcaaggttaaaggcatttgagaagggcttaccaagagtccagacactagacaaagttacttgtgcagtctgctttcagacactgggaatgaagtcttcctccctaccaccaaacttggggggaaaaaacaaaaaaaaacctctaatccaatccttggtctgcaggtaagctaaagtgcagattcctgaggaggatcacagaaacttcagtactctggtctacctttcagtgtgaatgagttccagccctattcttgaaaattgttattggaacagagcaggtaggccctgaggcatattgaagggagttaatgattatggagtgatgcagggtgcctgacagcattggacaggagggtatgttttctcatgttggtctcacaataactatgtagagccactcttacccccattgtacagatgaggaaactgttgccttaaaatacaatttttttgtaataaagtcatgctaatttgtttacatattgtctatagttgctttcactggcaaaacctaaaatgtttactatctggccctttctagaatgtttgctgaccttgttctgaattcttcaagctctaaatttacctctgtagagaaaaactaaaaacaaaacaaaaacccaactaattcacattctttcctgggcttttagaaaaagaactgatttgataaatggccaaggaccaaccctccccctcccccataacatcttttatttttaaaatgtaattgaaacatctcttttttgttttgtttttttgagatggagtctcgatctgtcgcccaggtgggagtgcagtggcgcagttttagctcactgcgacctccagccgccgggttcaagcaattctccttgcctcagcctcagcctcagcctcccgagtagctgggatcacgggctaaggtcaccacgcccagctaattttcctttttttttttagatggagtcttgctctgtcacccaggctggagtacagtagcacgatctcagctcactgcaacctccacctccagggttcaagcgattctcctgactcagcctcctgagtagctaggactacaggtgtgcaccaccacacctggctaatttttgtgtgtgttttttttttttagtagagatggagtttcgccacattgtccaggctggtctcgaactcttgacctcagccgatctgcccgcctcggcctcccaaagtcctgggattacaggcataagccacatgcccagccaaaaaacagcattggttttaatatctgatatagctggcagagtcacaccacaaacagataagagctctcccctttttgccttgcagccaggaagctcagaactaaaccttgtatgaaactgcaacaatatggcttagccaaattttttgacatgatcgcttctcccaaatcccattactactggcctaatgtcctttgacttttaatattcccataataactaccaattattttagctatcttgcagcctttcaagacacaagcaagggcacaaataattatttttatttatttatttatttttgatggagacaagagtctcgctctgtcgcccaggctggagtacagtagcatgatctcagctcactgcaacctccgcctcctgagttcaagcaattctcctacctcagcctcctgagtagctgggactacaggcacatgccgccatgcctggctaatttttagtattttagtagagactgggtttcaccatgttgcccaggctggtctcgaactcctgagctcaggtgatccgcccgcctcggcttcccaaagtgctaggattacaggcatgagccaccacgcccggccaaataattatttattttgaaatggtggcttggacacagctcatttcacgctgctcctggatgaagactttccaagaaagaggatcttttccccagaacctgggatgggtaccctggcagctctctcattgtttagaattattgcccaagagcgaagcaaagaagcaggaaagagtttggcactcaaagacacataaaccaggttcaaatcctggctctgcctccttgggcactgtgggagctggttccaaacctcttcaggtcccagtttccttaggtaagaatgatggcaggaatgcctgccacccatgtttacttatgaagactaaacaagataatgcacacaactatgctctgtatcatgcaaattttaattattcccataagttaatcatcaaaaactaataatatttatggaaaactagattatgccaagccctgcactagatactttactggcaaagactcattgaattcttccatcacaggatgaagagattcagagttcaagtaatgcccccacccacacaaaagaaaacagccaggtatttcactaggctggaaggattacaatatcaaaaggctggtacttacaaacaaattaaagaaacaaagcacatatttactcccaactagcataaagataagaacctggctgagcccaaggtaagtattcaaatactttatagcagtgactgggggccgagaagaggggggccaatcaatactcctcagggatgaggagtaagagacacgggacagtatgaaaaagtgtatttaccattacagggataactttcatatttacaaaatgaagggggaaaccccatggttttcttaatacaaatcacatactgtaaaggtccacaaactcttctcagctggggatctacgcagaacacatgagggcatctgctctgggggtaacagggaaggaaagaaaacagtgagggttttttttgtttgttttttagcataggttttgcttttattttccttttatttatttttttgtagagacaaggtctcgatttattgccctggctggtcttgaattcctgggttccaacaattctccgcattggcctcccaatgtgcggggattataggcatgagccaccacacataggttttttgtttttgagacagagtctcgctctgttgcccaggctggagtgctcgcccaggctggagtgcagtggcacgatcttggctcactgcaagctccgccttccgggttcacaccattctcctgcctcagcctcccgagtagctgggactacaggcacccaccaccacacctggctaatttttttatatttttagtagagacggggtttcaccgtgttagctaggatggtcccgatctcctgacctcgtgatccgcccgccttggcctccaaagtgctgggattacaggcgtgagccaccgcgcccggcctcacacataggttttaagttacattatctgaccccagagctgtaagaagctgtagagatcatcccactaaaatacccttggtcccacccttctccattttacagctgaagtaaaccaaactgtagggcggggaggtaacctcacaaggctgcatggtaaattatggacaaaactgaagctaggccctacatctttggtttgtttttattgaccctatgctcagttgacaaaagaagccttagatcccttgactctcaggctggtgctctcttctccaacccaagctgccctacctccacacctctagcacagaggtcacagcacactgagaacctagcacagcgctccgcaccaggagctatgttaagaatggaagaacaaaagcccacaaggagcagttaagcaacaaagtcttgtgtcattatcagccagacatcaggtacccagtgagtcccagcaggtgtgaggtccaaggctcattgttagccccagacctcgttccaccctagacacctcttagggtggtagtgtccgccacccctccccttgtcttccagtctccctctcttcccttttgacctcagcccccaaggccagaaatggctgctgggccaccagggttgggttggggcaggaagtggggggtttacctgcccgaacaaagtagcagtgcagggagtgcacgtggacgtcttcactcacagacttggctgcagccaccagggcctggcccacgatctgaccaccaaacagcctcttggccggtacccagtaatgccttcctctgtagggagagggggaaagagggaaagacttgggaactgggccaaattctactaccctcactaagactctaatgcatgatctcttcaccatattggggtttaagatccttttgagaatatggtaaaagccataggtcctttccccaggcaaatatccttatgcataaaaatcctctgggccgggcgcagtggcttacatctgtaatcccagcactttgggaggccgaggcaggtggatcatttgagatcaggagttcaagagcagcctggccaacatggtgaaactccatctctactaaaaatacaaaaattagctggacgtggtggcatgcacctgtaatcccagctactcaggaggctgaggcaggagaatcacttgaacccaggaggcagaggttgaggtgagccaagatcgcaccactgcactccagcctgggtgacagagcaagactccatctcaaaaaataaaattaaataaatgtataaatgaataaataacaagagccctcagacatcaagtctaactccttcagtgtacagatgagaaaactgcagcttggccccagagatgaaaatgcttgcccagaatgtaggcccattggaagctgaataattatgtctctagcctcccacgtcccagctgtttggcattttctgtaacaatgagttatgaacagccctccatgacctggcaggtggctctcgcctgtaatcaatcccagcactttgggaagccgaggtgggaggatcgcctgagcccatgagttcaaaaccagcctgggctccaaagtggggcctcatgtctactaaaaataaaaaagttagctggatgtggtggcaagcgcttatggtcccagctaaacgggagactgaggcagaagggtcacttgggcccaggaggtcgaggttgcagtgagccatgttcgtgccactgcactccagcctggacaacagggccagatcttgtcttcaaaaacaaaaatcaaatagccctccaagaagttatttacaattccttaagtggaaggaagggagctcaaagtaagataacttccagtaaagccaggagaagccttggaggtcaaagctgttagaagccttgctgcagggggctgggcgcggtggctcatgcctgtaatcctagcactttggcagaggtgggcagattacaaggtcaggagttcgagaccagcctggccaacacggtgaaaccccgtctctactaaaagaagttaaaaaattagctgggctgtggcgcgcctgtatgtcccagctaatcaggaggctgaggcaggagaaatgcttgaacccgggaggcggaggttgcactgagccgagatcgcaccactgcactccagcctgggcaacagagcaagactccgcctcaaagaaagaaagaaacccttgctgcagtcaagaacttcagcgatgctgggaaagaaaaaaacatgcttaggcctcagaataagtaatgagaaaccagacccaccaaatggtactgggggcgggatattgtgagaagaaaaggatactgaagacacaaggagctgcggcgtcggttttaaggctgatccatcagctgtgtgcccttgggcaaatcactgccctctctgggctagctcccccgtgaaggcttagggcaggctgccgagcagggtctctcaggtcaccactatatttgctcagctgtgcagacctcgcagcgcggagaggaagggaggaagccagagcagagaggacagctctgttgggggcgagttctctcctaatcgtggcagagggtgcatcccacgcagagccatactagtcccggagccaggggccccgggcggcggcagtcaagatcaagtttctgccctaaaggaggggatgctgggcaggagctgccggctacctgaagagatcctcgtccagcggctcgaggttgagcacggtcgtgaccaagacgctacggaggtccccagggggatcgccgcggtcgccacagccctgcccatcttctggggcctgcggggacgacatctagttcaatgctgcaggccctgcacacccgctccgcggaagacgcggagacatacacagaacctgactcttccggcagattgccctagtaaccggaagtctcctgcagaccccgggaaggaggaatctaggttatgattggtcaggactcctgtcagtccgctggtggctgtggccctctttctctagcaattggagaaaatgaatgccaatctgcgaatcctgtgtgtgactggatatgtcgctgaggaggcggaacctcgggactggataatatggactgagtgtcatttcccctgtcagatagcaaatacacccccttcctcttgtaacccggtcaggcctagggttcctccctgagttccagaataggccacccagttggggcggacccttaaggcattctgggcccacgcctgcctataaaccctcatagtgtgacctttgacccctggtgtgatcttgggcccgggctgggaccagcccctagtgtgggttgtgggggcggccatggagctgggcagctgcttcaagacctatgaggacttcaaggagtgcttcagcgcctacaaaagggagaacaggtgctccttcattctcagggactgcgtctccgtccgcttccacaacctcaaccatggcacctccatccgcgaagacatcctgtaagggcgggcggggcggggcgggccaagagggtggggaggaggctggacctccggagggctgcctggaggaggaggggtgcataggcacgcattgggctgcgtggccattcattcaacaggcactcattgagcacctgctgtgtgccttgtgaagagagctaagcctccacggccattggtttttgaccacccactccactttcactccattcacaggcttttctggaatttataactgcagtttctcccattgttttgagcagctgcagcaacccaaatacaaagtatggctttcataaacggataaaaacaccttggcgataatttccttcatcagtctcctctttacaaaacagtcacatggtcgttggaatgttcgttcattcattcattcagtttttagttcttatatatttgttgaaacagggtctcactctgtcccccaggctggagtgcagtggcacaatcagctcactgagccttcaactgctgggctcaagcgatcctcccacctcagcctctcaagtagttggaactggaggtgcacgccaccatgcctggctaattatttgattttgtacagactgggtcttgttatgttggctaggctgttcccagactcctggactaagcgatctttcggcgtctcaaagtgttaggattacaggcatgagccactatgcctggtctattcattcattttgtaaatggtttttgagctccttatattaaccgttttcaaacactttccatgtgccaggcagtgttctctatgcatgctttaccctgcagggcttttttttcagaattatagataaatgttatttttttgcatttgacagatgagaagatttgacagatgagaagtcaggcttagaggttaagacaggagttgaaaactcaaatgccttcagggattaggtgaaacaacccaatgtaagaaagttttaactttgaattttactttaagaaaaagaatgatgaaatagcaaccaacaccaggtctttgtgctagggacaacagaagtgtgaaatgggccaaatggagagtagatgccatctaatcagctccagctgatggctgccatatgaaaataaagatctagtgttgccagaattttgggcaagagttgtcagaaatccacactttatgtggattttcccatttaaaaaaattgaatcagttcaaattttaactcagagcatgcgggccaactcagagttaaagcatatccgagtttgagacttggattgagatgctcaaccaaagctcctcaattagacagccaggctatattctttccactgttctgaagtccagtgctatgctgggtataggtgacataaagatgaataagtgttcaaactatccccagagaactaggataaacttgaactcaagcaaactggtgtgtgataaatgctttaaaaggaatgtggaaaaaaaaaaaaaaaaagaaatgtacggagaaagaaatgaatgacaaatgcctgggaggtgggggaagtcttcacactggaattgatggtttccctgggctgtgaatgaatgtagagtgctagagtagatctgtggttaattactgagtaccatggaggcatttgaccagaagttgctgtgcagaaggacctacaggagcaaagacaaagatacatgaaagaaggttggcatgttagagtaacagtgagggataccatgtttggcaggagatgaagtcatttgcagtctaagggtctttagggaccattgtgaggtgtttggaccttgtcctttatgggtaggaccttgctaagcaatgagaggaatacaaaaaaaaaaaaaaaaaaaaaaaaccacagttgcccgtaaacacccttcaggaagaccatctcaggtggctagcacaaggtgtggcccatagcaggcattaaataattattgaatgagtgagttatcaagtactaaccatgtgattcagggaaataggtgctgcgggaactcagaagagaaaaatcactgcgagctagagacgtaagagtgaaagggaggcttgagctgggcccccaaagatggagagctgtcagaaggtgtattggttttctgtttgccactctagtgaattaccacaagtttaatggtgcaaagcaacacaaatttattatcttagagttatttaggttagaagtcaggcacaggtcttagcaggctaaatcaagatgtctgcagggctgtatttctttctggagtccctgggtaagaatccatttcccgccgggtgcagtggctgatgcctgtaatcccagcactttgggaggccaaggtgggcagatcacttgaggtcagcagttcaagaccatcctggccaacatggtgaaaccccgtctctactaaaaatacaaaaattagctaggcgaggtggcacatgcccgtaatcccagctactcaggaggctgaggcagcagaattgcagccgggaggtggaggttgcagtgagccaagatcgtgccattgcactccagcctcggcaacagagcgagactccatctcaaaaaaaaaaaaaaaaaaaaaaaaagaatccttttcctttccttttccacctcctagaggctgcccaacacaccttgggtcatggcccccttcctccatcttcaaagccagcagtagcaggttgagtcatcacatcactctgaccttgcttctgtcatcacgtctctgactccctcttctgcctccctcttccacttttaaggatccttgtgattatattgggcccacccagataatcccagataatttccctattttgaagtcagctgatagccaccttaattctatctgcaaccttaattctcctttgccatgtaacctaacgtattcacagagtctaggattaggacaaggacatcttcaagggaccattctgcctgccacaagaagattaataacctggaggtaaaaatggtgtgagtcagtacagacgtaaacatgacgtgcttctattagaaaacagtgatgggctgggcacggtggctcacacttgtaatcctaatactttgggaggctaagacagggagattgcttgaaatgaagagtttgagaccagcccagactataatcctgggcaacaaaatgagatccccgtctccacaaaacaaaatttaaaattaggggccaggttgtggcagctcacacgtataattccagcactttggtaggctgaggcaggcagatggcttgaggccaggcattctagaccagcctgggcaacatgccaaaacctcatctgtacaaaaaatacaaaaagtagccaggcatagtggtgtgtgcctgtagtaccagctactctggaggctgcggcaggaggattgcttgatcccaggagtcagaggttgcagtgagctatgatcgcaccactgcacactacattttagcctgggcaacaacagagtaagatcctgtctctaaaaaaaaaaaaaaaagcaagcagtgatgtatgtttgcacgcacatacaaaagccatgaggagacctgcttagctagaaggaaggatttatgctggagcagcaggaaaggaaattggagggttgataagcaggttggtgggttgggatttgttttgtttgttttaggagacaaggtctcgctctattgcccaggctagagtacagtgggagggtcatagtttactgtaaccttgaaatcctggcctcaagtaatcttactacctcagcctcctaagtagctaggactacaggtatgcacccccatgccaggctaatttttttttttcaattttttgtgtagagacagggtcttgccatgttgcccaggctggtcttgaactcctaggctcaagctgtcctcctgcctcagcctcccaaagtgttgggattacagatatgaaccaccatgctggacctgtttttgtttttgaaggtgaacaattttaaaagtgtttttgggccaggcacaattcaatcacttgaacccaggaggcggaggttgcagtgagtcaagatcatgccactacactccagcctgggcgacacagcgagactctgtctcaaaataaataaataaaaagtgtttttgtgtttgagtggttaacataattaaaaatattttcaaaaagtacagaagggactaaaagggtcacctccactgcattagcttttggttttttttggttttttttttttttgagagatggagtttcgctctgtcgccaggctggagtgcagtggcgcgatcttggctccccgcaacctttgactccctggttcaagcgattctcctgcctcagcctcccaagtagctgagattacaggcacgcaccaccccacccagctaatttttgtatttttagtagagacagggtttcaccatgtttgcgaggaaggtctcaatctcctgacccggtgatccacccgcctcagcctcccctgctgggattacagatgtgagccaccgtgcccagtctgcattatcttttttatctatttatttatttcatttttatttatttacttacttacttacttattttgagatggagtcttgctctgtcacccaggctggagtgcagtggtgcaatcttggctcactgcaacctctgcctcccgggttcaagtgattctcctgtctcagcctcccaaggagctgagactacaggcatgcaccaccacgcctggctaattgttgtatttttagtagagacagggttttgccatgttggctaggctggtgttgaactcctgacctcaagttatacacccatctcagccttccaaagggctgcgattacagctgtgaggtgccacgcccagcctatgtatttatttatttttatttttgtagaggtgaggtctcactatgttgcccaaactgatattgaactcctaggctcaagtgatcctccctcctcggccttggaaagtgctaggattacaggcatgagccactgtgcctggcccactgcattattatatagaggcaatcagcgttaccttcctgagagatactgaggctgaacaaacatgtcttgtatatgcatttgcatctttttgttgttttaacacaagtggcagcatgctatttagacatagccttctgtacctgctgtacctggctcttctcacttaccaatatatcttggaaattatgccaccgtatgggcaatttgatttgactttcattgatttccttgtttttttttttgtttgtttgtttgtttttttgtttgttttttgcagttgttaactaaaaagttactccatgctggtgtctggagatacgttgttgaaaaatataaattgaatctctgctcttgtggagacaaatactaatctataatcacagaaataataatttccttaaagtggtagtagagctccaaaggaaaaacccagggtgccctgtggaggggtgatggtgacacttattctgattgtcaggaacagggtgggggtgctggttgacaccctaaaccaatgcaggctcttgctcagaaaaaactgtcagccctgagattttgcagatactttacaaagcacattcacctttattacctgacctggttctctgaataaccttgtcagaggcaaattttgctgttcccactaaattagttaatacatgtaaagtgcttacagcagtgccttgtagatggaaaatagtccacaaatattgtattgttttacagatggggagacagagccaggagaagtcaaacattaagagacaaatagtttagggccaggcgcagtggctcatgcctgtaatcccagcactttgggagaccagggcagacagatcacctgaggtcaggagttcgagaccagccaggccaacatggtgaaaccctttctctactaaaaataaaaaaattagccaggcatggtggtacgtgcctgtaatcccagctactcaggaggctgaggcaggagaatcactttaacccaggaagaggaggctgcagtgagctgagatggcaccactgcactccagcctgagcagcagagcgagactctgtctcaaaacaacagcataaataactgaaaattagacccagcctatttactgacagagctcttaattgttgtacttagccactgggctctaatagttttctaatgtcacttgtccatttttccctcaacaaacttgtggtaagaggctaagtgtttaccatgggccaggagtacaaagatgagctggagtacaaagatgaggaaattgtaggctccacccctgaggacaatagcggactgagatagcttaggaggcggtgaattcatgagcagcacaggtctttagcagaaacaagttgactgctggttgtgatgttataaaggacattcttggatcatttattgcaaactggctctgtgcagagctcactgtcttgggctttttgagtgatacgtgggtgtcttgggggactggagggttggtgggggaaatgtttttaggaggtaatttagtacatgtttctgcagccaaatacacatattactgggtggtcaggtgagatgatattaatacttatgtgaaaatgtagacataaagttccttgataagcaaagtaaagcaagtgaactaatttaaagaaaaccatttacagctggatgttgctcacgcctataatcccaacactttgggaggtcgaggcgggcggatcacttaaagtcgggagtttgagaccagcctgcccgacatggtgaaaccaactctactaaaaatacataaattagccaggcacggtgatgggcatctataatcccagctactcagggggctgaggcaggaggatcccttgaacccgagaggcggaggctgcagtgagctgagatcacgccactgcactccagcctgggtgacagagtgagactccatctcaaaaaaatttttgaaaataatggtgcagggccgggcgtggtggctcacgcctgtaatcccagcactttgggaggcccaggtgggtggatcatgaggtcaggagatcaagaccatcctggctaacacggagaaaccctgtctctactaaaaatacaaaaaatttatccaggcatgtagccggggcgcagtggctcacacctgtaatcccagcaatttgggaggccgaggcgggcggatcacttgaggtcaggagttcaagaccagcctggccaacatggcgaaaccccatctctactaaaaatacaaagaatagctgggtgtggtggcgcacacctgcaatcccagctacttgggaggctgaggcaggagaatcgcttgaacctgggaggcagaggttgcagtgagccaagatcatgtcattgcactccagcctaggcaacaagagcaaaactctgtctcaaaaaaaaaaaaaaaaaaattatccaggcctggtggcgggcgcctgtagtcccagctactcagaaggctgaggcaggagaatggcgtgaacccgggaggcggagcttgcagtgagccaagatcgtgccactgtactccagcctgggtgacagagtgagactccatttcaaaaaataaaaagaaaagaatagtgcaaatattatatgggtggctatggcagatgtaaaggtgattggcaattctttttctggaaaagctggcccaagggttaaaaggaagagctctggagtgaaagagactgcctttgcccttgaccttgggtaaaacttaacctcttcacatagtttcatcctttacaaaatgagaagggtgtggcaatgattaagaaaaattcagggctgggcgtggtggctcatgcttgtaatcccagcactttgagaggccgaggcgggcagatcacgaggtcaggagattgagaccatcctagctaacacggtgaaaccccatctctactaaaaatacaattagctgggcgtggtggcaggcgcctgtaatcccagctactccggagggtgaggcaggagaattgctggaacctgggaggcagaggttgcagtgagccgagatcacgccattgcacttcagcctggatgacagagtgagactctgtctcaaaaaaaaaaaaaaaagaaaaagaaaaaaaaaattcaggctagggggcatgcctgttatcccagcacttgggaggccaaagtgggaggattgcttgagcccaggagttcaagaccagcctggccaacatggtgaaaccgtctctactaaaaatacacaaattagtcgggtgtggtggtgggcacctataatcccagctactcagggggctgaggcaggaggatcatttgaacccggcagaggttgcagtgagctgagatctcaccactgcactccagtcttggtgacagagcgagactccatctcaaaaaataaaattgaaaataatagtgcaaatattatatgggtggctatggcagatgtaaaggtcattgggaattctttttctacaaaactggcctaacggttaaaaggaagagctctggagtaaaaaagacccccccttgcccttgaccttgggcaaaacttaacctcttgacacagtttcatcctttacaaaatgagaagggtgtggggatgattaaggaaattcaggctaggggcagtggctcatgcctgtaatcccagcacttgggagaccaaggtgggaggattgcttgagcccagaagttcaagaccggcctgggcaacatagcgagaccccatttctacaaaaaataaattaactggtcgtggtgacatgttcttgtggtcccagctactcaggaggctgaagccggaggatcacttgagcccaggagtttgaagctacagtgagccatgcttgcaccactgcactcctacctgagcaacagagaccctgtctcaaaaaaagagagaaagaagaaaaggaaaggaaaatgctcgtagcacctaaaacagtgctcagtaaatgtttgctgaagctgtaactatagtatgtagtagaaagtggtagttatttgaaagagagtcaaagatacgtgctctgggaattaccactaaatgaccaaaagttcacgtcaaaaaaataaaatcagatcaagttagaaatttttttttttttttttttttgagacagaatctcactcttgtcacccaggctggagtgcagtgacgctatctctgctcactgcaacctccgccttccgagttcaagcaattctcgtgcctcagcctcctgagtagctgggattacaggtgcccgtcaccacgcccagctaatttttgtagttttagtagagacagggtttcaccatgttgggcaggctggtctcgaactcctgacctcaagtgatccacccacctcagcctcccaaagttctgggattacaggtgtgagccaccgcacctggccagaaaaaattttattatgcacacaaaagaacagttggagattagtcagatgctccagtcactgtagtgagggcagtgttaataaagccta

SEQ ID NO: 321 - DNA, 91937 bp, Homo sapiens
atggactaaatgctgcaattaaaagacacagactggcaaattgcataaagattcaagacccatcagtgtgctgtattcaggaaacccatctcacgggcagagacacacataggctcaaaataaagggatggaggaagacctaccaagcaaatggaaaacaaaaaaaaggcaggggttgcaatcctagtctctgataaaacagactttaaaccaacacagatcaaaagagacaaagaaggccattacttaatggtaaagggatcaattcaacaagaagagctaacaatcctaaatatatatgcacccaatacaggagcacccagattcataaagcaagtcctgagtgacctacaaagagacttagactaccacacattaataatgggaaactttaacaccccactgtcaacattagacagatcaacaagacagaaagtcaacaaggatacccaggaattgaactcagctctgcaccaagcagacctaatagacatctacagaactctccaccccaaatcaacagaatatacatttttttcagcaccacaccatacctatttcaaaattgaccacatacttggaagtaaagctctcctcagcaaatgtaaaagaacagaaattataacaaactgtctctctaaccacagtgcaatcaaactacaactcaggatgaagaaactcactcaaaactgctcaactacatggaaactgaacaacctgctcctgaatgactactgggtacacaacgaaatgaaggcagaaataaagatgttctttgaaaccaatgagaacaaagacacaacataccagaaattctgggatgcattcaaagcagtgtgtagagggaaatttgtagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaacagagacaaaaaaaacccttcaaaaattaatgaatccaggagctggttttttgaaaggatcaacaaaattgatagaccgctagcaagaataataaagaaaaaaagagagaagaatcaaatagatgcaataaaaaatgataaaggggatatcaccaccgatcccacagaaataaaaactatcatcagagaatactacaaacacctctatgcaaataaactagaaaatctagaagaaatggataaattcctcgacacatacactctcccaagactaaaccaggaagaagttgaatctctgaatagaccaataacaggagctgaaattgtggcaataatcaatagcttaccaaccaaaaagagtccaggaccagatggattcacagccgaattttaccagaggtacaaggaggaactggtaccattccttctgaaactattccaatcaatagaaaaagagggaatcctccctaactcattttatgaggccagcatcatcctgataccaaagccgggcagagacaaaaccaaaaaagaggattttagaccaatatccttgaggaacattgatgccaaaatcctcaataaaatactggcaaaccaaatccagcagcacatcaaaaagcttatccaccatgatcaagtaggcttcatccctaggatgcaaggcttgttcaacatatgcaaatcaataaatgtaatccagcatataaacagaaccaaagacaaaaaccacatgattatctcaatagatgcagaaaaggcctttgacaaaattcaacaacacttcatgttaaaaactctcaataaattaggtattgctgggacgtatctcaaaataataagagctatctatgtcaaacccacagccaatatcatactgaatgggcaaaaactggaagcattccctttgaaaattggcacaagacagggatgccctctctcaccactcctattcaacatagtgctggaagatctgtccagggcaatcaggcaggagaaggaaataaagggtattcaattaggaaaagaggaagtcaaattgtccctgtttgcagatgacatgattttatatctagaaaaccccattgtctcagcccaaaacctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaccttacaagggatgtgaagcacctcttcaaggagaactacaaaccactgctcaacgaaataaaagaggatacaaacaaatggaagaacattccatgctcatgggtaggaagaatcaatattgtgaaaatggccatactgcccaaggtaatttacagattcaatgccatccccatcaagctaccaattactttcttcacataattggaaaaaactactttaaagttcatatggaaccaaaaaagagcccgcatcaccaagtcaatcctgagccaaaagaacaaggctggaggcatcacactacctgacttcaagctatactacaaggctacagtaaccaaaacagcttggtactgttaccaaaacagagatatagatcaatggaacagaacagagccctcagaaataatgctgcatatcgacaactgtctgatctttgacaaacctgagaaaaacaagaaatggggaaaggattccctatttaataaatggtgctgggaaaactggctagccatatgtagaaagatgaaactggatcccttccttacaccttatacaaaaattaattcaagatggattaaagacttaaatgtcagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaataggcaacctacagaatgggagaaaatttttgcaatctactcatctgacaaagggctaatattcagaatctacaaagaacttaaacaaatgttcaagaaaaaaacaaccccatcaaaaagtgggcaaaatacatgaaaagacacttctcaaaagaagacatttatgcagccaacagacacatgaaaaaatgctcatcatcactggccatcagagaaatgcaaatcaaaaccacaatgagataccatctcacaccagttagaatgacgatcattaaagtcaggaaacaacagatgctggagaggacatggagaaataggaatgcttttacactgttggtgggggtgtaaattagttcaatcattgttgaagacagtgtggcaattcctcaaggatctagaactagaaataccatttgacccagcaatcccattactgggtatataccgaaaagattacaaatggtgcaactataaagacacatgcacacgaatgtttattgtggcactattcacaatagcaaagacttctaacaaacccagatgtccatcaatgatagactggattaagaaaatgtggcacatatacaccatggaatactatgcagccataaaaaaggatgagttcatgtccttttcagggacatggatgaagctggaaaccatcattctcagcaaactatgacaaggacagaaaaccaaacaccgcatgttctcactcatagatgggaactgaacaatgagaacacttggacacagggcagggaacatcacacaccagggcctgttggggggtggtggactgggggagagatagcattaggagaaatacctaatgtaaatgatgagttgatggatgcagcaaaccaacagggcacatctatacctatgtaagaaacctgcactttgtgcacaggtaccctagaacttgaagtataataaaaatgaaaaaaagaaaatgttactagcaaattgtagatgggtatacctaatataactctgcatgtgcactatgtgtctggatacacatggaaagtattcaggcatacacaccaaattgttaaaataaatccccttccaacattaggagtggctggggagcagatggctttcacttccgcacattccatggtgccagggtaataccacatcacaatagtaaatagcaaaaataacaaccttaagtttagattttcttatctaaattttaattctgtgaagaagtttccatttccctttttcacacaggatagtagaatgcagtttagaaagagtgagatcacttgttagactgtacaatttttaagcatcagcgaagtataccattaaacttctctatcaatccattctctaaacttcccaacccaaaaaaaaagaaacacataaaattgaaatgaagaaaacaatacaaaagatcaacaaaaatgaaaggttggctttttaaagagataaacaaaattgacaaatgtttagccagactaagaaaaagagaaggcccaaataaataaaatcagagatgaaaaagcagacattataactgatactgcggaaattcaaaggatcattaatggctactatgagcaactgtatgccaaacattggaaaatattgaagaaatagataaattcgtagacacacgcaacctaacaagattcaaccatgaagaaattcaaaatctgaacagaccaaaaacaagtaacaagatcaaagccataattaaaattttcccagcaaagaaaagcctgagacccaatggcttcactgctgaattctatcaaacatttaaagaactaataccaatcctactcaaactattccaaaaagtagaagaggagggaatatttccaaacttattctatgaggccattactgctcctatatcaaaaccaaggacacatcaaaaaaagaaaactataggccaatatctcacatgaatattgatgaatcctcaaaaaatgctagcaaactgaattcaacatcacattaaaaatcattcattatgaccaaatgggatttatcccagggatgcaaatatggttcaacatatacacatcagtcagtgtaacatatcatatcaacagaatgaagaagaaaaaccatatggtcatgttaattgatgctgaaaaagtatttgagagaattaaacatctcttcatgacaaaaaccctcaaaaacactggagacagaaggaacatacctcaacacaataaacagacatatatgacagactcacagctagaatcatactaaatggggagaaactgaaagtcattcctctaagatctggaacaagacaaggatgctcattttcaccagtgttagtggaacatagtactgaaagtcctagctagaacagactagagacagaaataaggggcatccaaactgggaagagagaagtcaaattacctttgttcgcagatggtatgatcttctgtttggaaaaacctagactccataaaaaaatgattagaactgataaattcagtaaagtttcaggatacaaaattaacatacaaaaatcagtagcatttctatatgtcaatagcaaacaatctgaaaatgaaatcaaggaagtaatcccatttcccatttgcaatagctataaataaaattaatataatctcatctcttcaataagtggtgttgggaaaactgcatatccacatacaaaagaataaaattagacccttttaatatacaaaactggacccaagttaatatacaaaaattaacttgaaatgaattaaagacttaaatgtaagatctgaaaccaaaaactcctagagagaaacataggggaaaagctccttgacgttggccttggcaataattttttgggatattacaccaaaagcacagacttttgaaaaaataaacaagtaggactacatcaaactaaaaagcttctgcatggcaaaagaaagtcaacaacatgaaaaggcaacctacagaatggagggaaatatttgcaaaccatatacctgatgagaagttaatatcaaaatatagaaaatatataaggaactcacatatctcaataccaaaaaaataataacctgttttataatgggcaaaggacctgaatagacattttttcaaagaagacacacagatggccaacgagtgcaggaaaaagcgttcaacatcactaatcatcagggaaatgcaaatcaaaaccacaatgagatatcactccacacctgttaggaaagctattatgaaaaacacaagagacaatgaatattggcaagggcatggagaaaaaagaacccttgtacactgttggtagaaatgtaaattgcaacagcctttatggaaaatagaatggaggttcctcaaaaaataaaaatagaactaccatacaatctagcaattccacttatgagtgtacatccaaaggaatcaaatcactatgtcaaagagatatctgtacttccttgtttattgcagctttactcacagtagccaagataaggaaaaaatctaaatgtccatcaacggataaagaaaatggggggaggggtgtgcatgtatacatacacaatggactatttttcagccataacaaagaaggaaaccctgccatttgtgacgatatgaatgaacccagaggacattatgttaagtgaaataagccagacacagaaatacaaatattgtatgatctcatttatatgcgaatctaaaaatttcaaacttgaagacgaataagtagaacagtatttatcaggagctaggggatgtggggaagaagcaaaatattgggcaaagagtataaactttcagttatgagatgaaggccaggtgcgatggctcatgttggtaatcccaatactttggaaggctgaggcagagggattgcttgagaccagcctaggcaagaaagtgagacctcatctctacaaaaaataaaaataaaagaatcagctgggagtggtggcatacacctgtagtcccagctagtcaggaggctgaggggggaggatcatttgaaattggaaagtcaaggctgcagtcagccaagatagtgccactgcattgcagcctgggtgacagagcgaaaccctgtctcaaaaaaaaaaaaaaaaaaaagatgaataagttctggggatcaaatgtacagcatggtgactatagtttataactgcgttattacttgaaattggataagagcagattttaagcatccccagcacccccccaacatacacacacacaaatggtaactataggtggtgatagatatgttaatttgactgtgacaatcagcattcaatatatacatatatcaaatcatcacattttaccccttgaaatagaaactttgatttgtcaatcaaatattttaaaacgaaaataatcataatattaatatagcatacaggaaaaaatttcgtatctcgactgatacagaaaatttcatgataaaaacactttaaaacaaaagaaataaaagggaactccctcaacctgataaatggcatctgtggaaacccccagctagcatcaaacttaatacagaaaggctgggtgttcacctcttgaaccaggaacaagacaaagatgcctgcttttgccacttccatttgaccttgtactgaggttctggctagggcaattatccctgaaaaagaaataaaaggcttccaaataaaagaagaagtaaaactatctctactcgctcatgacatgatcttgcatatagaaaatgtgcacatgtacacacacacaaaccattagaactaataaacaagttcagcaagtttgcagaatataaaatgaatgtacaaaaatcaagtgtttttctatatactagcaattaacaatctcaaaatgaattaaaattccatttacaatagtatcaaacataaattatttagaaataaaaagtgcactgaaaactacaaaatattttgaaataaatcagaaaagatttaagtaaatggatcacttgaacctgggaagcagaggttgcagtgtgccgagattgtaccactgcactttagcctgggcaacagagggagactccaaagagtcgaaaagaaaagaaaagatttaaataagctgaaacatattctatggatcagaagacttaatattgttaaagtgacaatattccccaaattgatctacagcttcaactcaacccctatcaaaatcctagcttgctttttggctgaaattgacaagctgattctataatttatatggaatctcaaaggatccagaataaccaaaacaatattgaaaaataaagaacagcgttggtggattaacattttccaatttcaaaacttactatagcactgcggtaatcaagcagtgtggcactgtatagcatgtacattacagatcagtggactagaatcaatgtccagaaataaaccgttatgtttataatgaattactttttaataaggtgtcaagacaacgcaatgggaaaagaataatgaattcaacaaatgatgcatggacaaccggacatgcacatgcaacacaatgaatttgaattcttctatcgctccatgcataaaaactaactcaaaatgggtcacggatgtaaatgaaaagctaaaactataataatcctagaggaaaacctaggagtaaatctttaagatgttattgtaggcagtggtttctcagataggaccccaaaatcacaagcgacaaaagaaattggacttaaagttaaatacttttgtgcttcaaacatcatcaagaaagtgaaaacacaacccgcagaagcaataaaaatgtctgtaagtcatgtatccgattagagacttctatccaggatatataaataatgcaattcaatgataaaaaagataaatagcccagttttccaaagagtcaagcatctgaatatacatctctccaaaaatatacagatatccaacaagcatgtgaaaagatgttcaaagccatttgccaggtgcacaaacccaagacagtatgaggagatgctacagggactctgctgcttcacagacatgaagcgttggtgagaatgtaggcagccgcctttggggacttcacatccccgccgccccacgcacggtgagctagtgtttaaacttagccgagatcaatacacgcgactgtgtgcccgtcagaccctgcgctgccggcggggctgggagaggcgggcgccaggagtgggcgggaacctgggggtcaggccccagccgcgggaagccgcccaggagcgcgcgaaaccttctccacacccttccaggcatttgcccgccgcgattcagagagccgacccgtgacccctggcctcccctagacagccccgcatgtccagatgtgccgtcccgcctgcctcccgcgaccactggccatctctgggcctgggcgcggtctcggcgcccgcctgcccccgccaggagccgcaggtccagccagtgaagaagcccgcgctgaaggagcctctgtgctccagaatccatcctcagtatcagcgctggggtggcctcctccaggaagcccttctgattctctcatgggtcgctcttcctctgcagactcccggagcacccctgctccaagtaccgcaagtggcactgagaacttggggagagcagaggctgtgcctagatttgtagggagtccccgcagctccaccccagggcctacaggagcctggccttgggcgaagccgaggcaggcaggcagggcaaagggtggaagcaattcaggagagaacgagtgaacgaatggatgaggggtggcagccgaggttgccccagtcccctggctgcaggaacagacacctcgctgaggagagacccaggagcgaggcccctgccccgcccgaggcgaggtcccgcccagtcggcgccgcgtgaagagtgggagagaagtactgcgggggcgggggcgggggcgggggcgggggcgggggcagccgggagcctggagccagaccggggcggggccgggaccggggccagggaccagtggtgggaggaggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtgagcgcgggcggggcacgggtggagcgcgggctgaggtgcgtccgggacccggtttggacggcagaggcctgggcgggggcgccgagggcccgtcggggcggcccggacaggactgggggtgtccaggaccctgtcagggagggcagaactgcggtggggcgtgccctgggctcccagtggccggtgggtaccctggtgggcaagcgtccaggacccctcgcggcggccgcgacccctgtcggaaacggagacttcccgcgtgccgcctgcaaggcgtcttccctgggaggagaaggcccaaggtttcccctccacttcaagatctgggctccgaggctccggagcccccttcactgggccgcgtttcttgtgccacctcttccttaggctccttctgcaggtcgcacagggagggagaggcagatgagtcatgctcacagaactctgagggcacctcggagcagccagctgtgagccgtggggaagggtgcacgtcagcgggtccagaggcctgagttctgtccagacatgaccaccagctcactctaccgtctgtctgggcctcagtttccccagctgaaaatggagggttggcttcagtctggtccatgagtcatgggtgagcccaggcccatctggtggctcagacggcacctgggcagcttacattctcaggacagtccccagaggaaattaaagggaaggaacagaacccaggccaggagaggcttttcctaaatggaggggctgcactccctcccagcagaatgtacaccagggaacacttccacgctaggtgtgaggacgcgagggagccctcagcatttggaagctagttcctaatgctgatctggacctgaattccagccccacgactcttttccatgagcatgggcaggtcgcagttctcactgagcctttaatgaagtgcctaatccagtacctggcacagaggaagcgctccgtaaatgactggtaatagtcccagacatactgcaggtgcgcagggaatatcagttcccttccaccccaccccagctcctaactggaccaaaaagatttagactttaccaagctgccttctcaccatttagtttattatttgatcaaaccttgtgaaattgctcataatggacaaatacaaccggcaagttcatgtttcaactgattactcttggataaaatttgtgttttaggtgtgcagagcctaaagtaagtaaaaactactctttttctggattccaagctctccatgggctcgattcctatccaggagcccataccctcgctgtagcacgacatggccctcagccaagttcactagcatcctggcttgagctcccttcaagaagagttaggtgttgagtacaagagcaaccttcagttgcttagttgccccagtcggggaactgaccctgaggactgcggtgccctggagttaatgtgtcgtccatttagggtgatggcaccctctgccatttctgacgcaccttcatttacttccattatttcatggattccccacacctgggggagaaggacagggtacaggctacttcccctttgtaagtgcttcctcctccccattctcctccacacatcataaggttctagaagcacaggccattggtgtgctcacactgcacagcacgggcaccccgtgtgtgctttcctcctgcaggggacatgataacgtggccatagcgggctcttcggacaaagagtgaaggcactgttttgtccactatctccctctctcggtctgtcttcccctaccctgagaagtcattcaaatgacattataattaaacacctcagccggaatcccaggggcaaatttcaggagagatttgcatgtcacatttccattgggttgagagggctataagtcaggggtggggcggggggtggttgggggtgggggctaccgcagggtggggaaccagctaaggctgaaagtttccttgaaaaaatcagcttttgagaaagttcctgttgatgcaaagttactcaacactttctcttgcccagcccagaactacttcctcattctcccagcttggtatctgtaaagacaatcatcctttttgggtaaaggtaaaagagaaaccctagaggaagtacttgctgagaagacaaggttatcccattttacagggaaaagtgttaaaatctgtattgttaacagtagtaacgataacaataacaataaaggtatttccacacaatttaatcatttccaagttattggcaggtcaacacccccctcctccagggcatagttcagtcaaataatggacaggactgattttttccttgataaagtgagtcacaggtcccttgttattctcatcagagttccgcatagtgattcagtcaggactgggaatcaagtccttcgcaggtgggattatcctataaacggttgtgtcttccttggctcctcactgtctgctggagaaagccgggatcctacacagaatggccctgtttccagaggctaacccaagtctaggcaaatttaacaagttgatttatttctttaactctgtaaatttaaagtaattcagatcggatacgataactgtaacagatctgaagatttctgagaaatcttagttggcccatttcattctgtgctggtacttttaagaaagctaagggcaatagcgtggtgtttaatatatgatacttgaatatgttcaacaagtgtagaaaagtgttataatgattcatgcttcttaagtcagtgagtattcttacattcatgaaaaattaattctagaatacctccttcttgtgaatgggaatatattagtggagcataaatatttctttggtatgaccctcaatccgtctctcatctcccagtctccccctctgagccatcttttccctacattctgccccctcttctgcctcctcttccttcccctgctcccagttccctaaatgccccccgtttctgctctctaccctacaactctcccttcttttttgctctgaattttcctctacactctgtcttccagccacctctcagaggccccttctctgctccctcaatctccggctctctgtcccacattttcccccttctctgccccttggtctccctatccactaccccaatccctctctccgtcccttgttttcctcagctcttccccatagcctccccctctctcatcccgagtctctgttttgtctggcccccaatcttcctctctgctctacagcttcctcctcccacagcccctcattagtccccctccaagatgggtagtctgggggtggggcacacatccttgcttccgcagagagatccgtctccctgtcccagcaacagcagagatctgatgaaagacagatgaaaactttcctaaaatgctgatagaaagctcacatgaaaactgaccaactgactctttgccgaaatattcaaaagctttaaaactacatatccaataaaaagttaaaagcaacaagcaaaatcagcaaagtggccccttgtgaaatgaggccggtgagttgcaggtttcccttgtttctctccagcatctgcaccaccacgccacccacttctgtccccagaaactgtgtccagccttcctcctcccacgtgtgaatcccccggggaccctgccctcccagttccccacatctgaaatgtgctacccatgcccatcctcctactcatctgccctctgaaatctgatcagcccctaaaagctgcctgaaataccctcttatgaagcttttccctgtccttccatgccactccacattgcccctttacactccatccagggtacaaaccagggctcaaagctgggccttctagcttccggttcagggcttttctcaagatgtggccttggggaactgtgggaggaacctgggcttggccatcacacaggtgtaggttctgatcttgaggccaccattgctctctgagcctcagtttctatctgtaaagcaggataatcactcgctcggccattcccaggcccagtgcttcctgagggcctgttggggggtgtccactgttgatagtgcccaccataattcagtgtgtcacctgagaatttaatgtgtcacagcaaatagacaaatatagcatcagcccagtgtacttggcccagagaggagggaggaaggtggccattgtagttccacaaaccttccgaagatattttgcagtttgacacatgtgaccctggtattttcctggaaggaggcctttatctgtcattcttccattagtggcccctgggatgttagaaccacagccatcaagctttgtcttttactccctgagttgggtcaaggctggagccctctgccccttgttcacctcttatcatattcaggcttgaagccagcaccaggaaagtggctgggctggccatagaccagccagactgcaggcctggccccctcctgctgtggaagtccctgtcagatggcagatggagtccttgtaaatctgcctagtgatttcaccccaagtgaaactcaggggctctccaccaggtgcctgcaggtgtaggtagggcagggggccaggagtgtcccagtcccctgtgactgcaccacaggtgtgctggagggtcaccccactgtccactccctcagagaagctgctcagtctcttcgtgtgggtcgtcacccccaggtagacatcgggccctccctgtgggacctgcccagtcctggaatgcctcctcagcccatctccctcccctcttagtccaaggtactgggagcctccctcccatgagagtgtccctgttagctcctcccaccccaccccagctttcctgtcatctatcccctggggacaccttcctccctctccagcccctcagagccataggaaagctacttcccctgcagcagccacactcagaccaggcccgggcctctggtggccgcccctcagtcctcaccgcacacagacttgctctgcctgccccaccagcattcagaatgcctcccactctccctctgtcctcacagccctgtctccagcctttcaggagttccttctgggctttgagtgaaggagtttgaggtcacaggttcagtttcctcctcccatgtgtgctccagttactcggattggcacatgtagtcacgaagtggccgtgacgcaggggcccatgctagctcacaggcggtgtggggcctggtgccctgcaaccccctggattcaggaaggggcactggtggttctgatgcacacaaccggtggcctgtgcctctggagaaaggaggccacccaggatggtgtcatttcattttctcaatggtcctgcaagtgaggggtatctcctttgggtagatgaagaaacagcttcagagaatgaagcaatgtgcccaggccatccagctacttgcctgaagctgggatgtgaattcagagctccagaccccagggcccaccgagccttctacccctcactgccctctccccactcctcggtgggatcaggaatctctgtcttggctcacaacctgcagctaaggcctctgtaaatccctgtggcatgcagggcctggcgtggggcaggcccgacgcgtatccagtcctgggccactcagcccccactctgctcctccagatgggcccgagcccctgagatgctgagactcctgtcccatcagaacctgcccaccctgtccatgatgggcgaggccttgtgtgtggccctgctctcctgaggacaagctgtggcaggaaggctttctcagaggtggcagatgaggctgatactctccctgcaggaggggcattgtcgtggggccgaggctggtccacatgtggctggacccaagacatgtcatcccaccacatgggcctggctcctctgtcatcagaaactgttcctagggcctctggcctagactacagagcacagggaggaagcttccgctttctgaccacaagcgtctggcctcagcgtcagccaccccaaactgctcacggtattcagagccaggaggtttgtggaaaacactcaagttcccattcctcttaggaagccctccaggggtcctcctggcagcttggaggcagggcatggaatggggatgcctgcgctcgcacaaaggatgatacccctcgccccttccactttgccatcatgctgagaactctaggttctgccgccagggataaagttcaagggttgatgaatctggcttagaaagtgccttgcaggggccaggcacagtggctcatgcctgtaatcccagcactttgggagaccgaggcaggtggatcacttgaggtcaggagtttgagaccagcctggccaacatggtgaaaccctgtctctactgaaaatacaaaacttaaccagatgtggtggcaggtgcctgtagtcccagctacttgggagactgaggcaggagaatcacttgaaccctggaagtggaggttgcagtgagccgagatcgagccactgcactccagcctgagcaacacagtgagactccacctcaaaataaaaaagaacatgccttggagggcatcgagtccggggctttccaaacctgctggtcatcagaatgcgtgatgcaatgcctgagcctctcatcccaacttcctgtctgccatccattgctgcagagacaaaagccctccagaagctatggctgttgcctcagagccgcctgtgtcctggaagcaggagcctggcagggagggggccaagcagccttgtcccagaggcctgggcagctgcgctgtacacagcctggggtggtgccttctagctgcaaggctagcctcaccctgccaccagtaatgccacaggtgcagcagagctgcttggtctcactgttctctgggcatcaccatgcagctgtgaactgcaaatgtcccaggacgactcgaatccatgcaagctccctgtatctaagcctcaccattttcactcacttattatccccactgaaaactggaaagagaggaagtggctatgatggaaagacctggggtgtgactccagctctgctggcaagtggcagaggtgggagtcactgagcctcgctgtcttcatctgtggaaggggtggtaactcccctgcactcccagagtcattgtggggatccactgtcagcaagcccatctccagttgtaaaggtctcccacaaggctatcccatgtgggggcagctgcggaccctcactgggcacagcctcgcaggtgcaggcatgagcctgggcatctccccatcctccagcctgagctaagtgcagtcagcaggcgttgccctctgagcagcacagcaccatcctggctcactggattctctctcctcaagggcagggcccaggatttgtccatttctttcacctgcctgggtcgtagcactgagccttgtcaggggcaggccttcagtgaatgtcttgggtaaatgaattcaggagttcatttaaggtgttcatgaagaatcttggctccatgaactgtagtggaggcaaaactccacctcttcccatttcagctaggtctgagaatcggcataagacagattcatgggcgaaagcctacagatttctttaatacaagttgtacgtggcatgggagccctcttaaaaagatgaagaccccaagaagcagttagagtcaatcccccttagatactgcattgaatgaatcatcgtgagatgtgataaggccaaggggcttgggctagggcaggtaactgggcagggaagtgactcgggaggtaagcgttcattgtacaagatctgtttgtatggatttcctttggcttcaacttcccaaccttgatgaaaagagtgttactttccttttggtatagtgaggacatctttcataggggactttcatctcctgcttctaagaaacagcacgaatgtcagagtatcttgcacctgctgtttttttaagtgcttttcattcaacgtagtccctgtgccacagcagcataccttggggtgacaaattcttaacacctccagaacaaaggctcaggagaccacgcatggcctgattgcctgttctccttcccaggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcggtgagcagctcaggccccttctgccccgggcttcccaagaaccgaaagttcttcctgtcctcaaagcactgtagtcataggaggaatgacactgctgtgcaggggcgggaagtgggagggctctgccctgtgcctcgacacacctgcaggaggcatgactttccttgggattcttacaagcccctgagggtggagcgggtggccccaggcctcactgtcgtcatgtcctcactctgcgctacagttctacaggggagggttgtgcccctctttttgtcagtgggtaactagggtccatacaggcagatacctatgggacatgcccctggatgggcacttctctagttgccagggtgtggcatcactttctagttcatagcctgccctccgtgagatcacagtagggctcaggcaagctcagggtgccccatgtgggcctagggagggaaggggtggacaaggagcaccccaagtgccagctctgaggagccatggacaagcctgcaaatcacagttaccagttcttcaacccgaagtctcacctttcgctgaaagaaagaagaacctcaaatctgttccccttactaagatgcccagatgtgcagaccccagttaggaggccattctttgttagggacacacagctgacctggtacagagcatcagagacggacgcaggcgtcaaggtcagccaaggctccctgaatgaaccaccttgcatacccagcctcctagtgtgcctggcaaaatcctacctcacttcgagtcataacccttcagcttgctctcagtttaaacctggaaagataagccttcaaaggccaggcagccaccgtaataagagaaagccactgcttctgccatgacagcgtcaaactctttctctttgccaagtttcctgtagctagtgtgttcttcacgaagtttggtggggtaggtaggaagagatgactgttacccccattttatagctaagaaaactgagacaaaggagaaaaaagttattctgtacctgctgttcttaagctaccaggccacatcccatcgtttctgatgtggaatttgacttaagaaaccaaatttccagaatatttctgaacatggagttaagaggatttttgtccccctacctaatgacaggaaaaaaaatcacaaagttcatttattcctgtggtcaacagaatgtggaaggttgtggacagggcacttctctttttctggtagttagaaaatgctggctctgaaactccctcctgcacatctacccaaggtctcggttatgaagcccttcttcctgcagacccttcagctcatcttggcaaaaaacagatggtacactaggatgagggtttaacaaaggggcatcacaaaggtgtgggcccatgtgcagagggaccatgcagagtgcggggccatcagcaccactagtcctgatgcagggggagggggaaggttgtgggagtaatgcagaagtatcctggagacagcacccttggaggagctgcggccctcagtagaaaggttctggggagtgattggcctctccttcctctacacattccctcctttctggtcagagttcccagtggaaaacccattgaggcatctcattccaatcactttcagggacagcacaggttggagggtgagcatagagaagctgtccagcaagttccattctctctactgctgtaaaaccaacctccttggtaactttaaacagccatttaattttgttcatgctcttgcaggtcaggaatttaggaaaggcttcactgggcagttcatctgtggccatgtagcatcagctgaagggggctgggccttcttctgtcatgtgtctggcacctctaggctccttggcctctctgtccatatggagtctcattctttaaggcttctcacagaatggtgtcctctgggtgcctgcatttcttacatgatggctggcttccaagagcaagttttctaagagacagaaagtggaagctgccaatctcttcaggcttgggcctggaaactggcacactgtaacttccatcatattctactggtccaagcagtcacagagcccacccagactccgggggtgggggtggggatgcagacccccccatctctcaatggaaggaatgtcaaagaatttgtggcctattattattattattattattattttgggacagagtctcactctattgcccaagctggagggcagtggcacgatctcagcccactgcaacctctgcctcccaggttcaagcgattctcctgcctcagcctcctagggagcttggtttacaggctccaggtagccaccaagcctggctaatttttgtatttttactagagaaagggttttgccatgttggccaggctagtctggaactcctgacctcaggtgatccacccggctcggcctcccaaagtgctgggattacagtcatgagctaccatgtccagctgtggccaattattaatccaccacatggcaaaacaaccaatcccttgaacaacctggaaatgaggggggccagcctacaagtgattcaattactcaccatatgatcaccccttaaatctaatatttcaccactacaccttgggtgaacatgaatgtcagagggccattactgtggccccacagatccagagcatctgtgtgaagggacagcttcattaaggcactgtgtcagtccttggaacctgccctgctgagctcttctgccgtcagtccaggctttctcatcctgctgtgctcccagaacttcatcagccattggataaattcttcaaacaccttcgggaccaggggagacagaactattctctttttgaaacttggcatgttgcaattccgcatgtactgacttattcataccagtgaaactgaagagatccagctcctcagagtcaaggtgcccaagagattagctggttccttaaggtagataagagatgatgaatgttgagtgcctccagaattacccccatagccaatgataacagttattgtcaccattaatactcagcttgccttctgtggcctcaagcctcccctcctggctggctttacatccccaggggaggatgcagaggtatcccgttaatattcctttttggaccccagttccaagctcaaggatgaagatgtctcagcctggaagtgctgtcgggtggacagctcagaatgtggcctgagtgtcatctgagaactaactgcgtccaggtctgcaattagatcagtacagaggttgaagcctatagttccagcactttgggtggctaaggcgggaggattgtttgagtctaggattttgtcacaagcctgggcaatgtagagagaccccatctctacaaaaaaaattgaaaattagctaggggccgaggcgggtggatcacaaggtcaggagatcgagaccatcctggctaacacagtaaaaccccgtctctactaaaaatacaaaaaattagctggatgtggtggtgggcaactgtagtcccagctacttgggaggctgaggcaggagaatggcgtgaacctgggaagtggagcttgcagtgagctgagatcatgccactgtaccccagcctgggcaacagagcaagactctgtctcaaaaaaaaaaaaaaaattagccaggtgtggtggtgtgtgcctatagtcccaactacttaggaggctgaggttggggaatcacttgagtcctgaagttcaaggctgcagggagctatgatcatgccactgcactctagcctgggagacagagggagaccctgtctcttaaaaaaaataaaaataaaataaatacaaaataaaatacaaagactcagaggaggggttttagaaacttttatagcaacttaacagaacaattttgtgacttttgcacctaataagaaaaaaaaagacttggattttgaatatctttgggtttttaaaatttcatttttctagtaattaatttttattatattttacaaaaatataataatctgtgttgaaaagtaagttttaaaacacaatgctttaccacgagagctagagaaactattccaggacctgttttcaggagatctgggctccccctattcacagctctatgggctgcgttcacaggcttggccttaagcaatagtttaaagagtggtcatgatatgacctcatctgctctaaaggctctgagaagcagccccgcccttagctacctgctacctgctccaactcctgcagtgagagacggcagcaggacaggctgagagataagatgctctcagagctaggcttagagggaggagcagaaccctcaggccagtgatgactataggcataatgataatgatcattgttcccatccattggcatttactgcgtgccaggcgccgtgtggagggctttcctgcattctctccccaaatgcacaccatgacccggagaagtaggcattatcatctccattttacatgtgagggggtcagggcaactcttggtcacacagcttcagtgacagagcccaagtccaagcacatgtgtctcttctaaagccatctaggacactgcactcttttagaatggagctcattctcaatcctctgtgtaggcacgacaggaaaccgggttgtgtcatcgtcacacatttctccatgaaacaatgaaatggacttagaaacataagagctgtgagaactgctgctctcacaggcaacactaaaacccagagtgaactcccgtttttgctcagtataagaatttcagagaagaggagtaaactattctgcagtgatttaaagatacccaccaagggccacgaaatgcctttctcctggagcaaaaaggcagctctgcaccaggggcccttaggtccctgaagagtcttgaggggctgagtggaaggttaggacctcaagtggaaatgcacacgcaggccagagttaggcatgtactgtgcctgccaagcccagtgagaaccaagcctggctcttgcatctgaacatgattctctaagcactgaaaggcaggggccccaaggcttgctgagtgagtgggcaagaggatgaggaactggatttggcttttgtaaagtgagtggctaagagcacaggagttgagttttatgttgaaaattcactaattcagactggttccaagatggccgaataggaacagctccagtctacagctcccaacatgagcaatgcagaagatgggtgatttctgcatttccaactgaggcactgggttcatctcactggggattgttggacagtgggggcagaacagtgggggcagcccattgagtgtgagcatcacctcacctgggaagtgcaaggagtcagggaattccctttcctagccaagggaagtggtgacggacagcacctggaaaattgggtcactcccaccctaatactgtacttttccaacagtcttagcaaacagcataccaggagattatatcccatgtctggctcggagggtcccatgcccacagagccttgctcattgccagcaagctcgaactgggtggagcccatcgcagctcaggaaggcctgccagcctctgtagactccacctctgggggcaggtcatagccgaacaaaaggcagcagaaacctctgcagacttaaatgtccctgtctgacagctttgaagtgactagtggttcacccaacatggaatttgagatctgagaagggacagactgccccctcaagtggctccctgaccccagagtagcctaactgggaggcaccctccagtaggggcagactgacaccccacatggccaggtacacctctgagacaaagcttccagaggagcaatcaggcagcaacatttgctgttcagcaatattcgctgttctgcagcctctgctgctgatactcgggcaaacagggtctggagtggacctctagcaaacatcaacaaacctgcagctgagggtcctgactgttagaaggaaaactaacaaacagaaaggacatccacaccaccaaaaccccatctgtacgtcaccatcatcaaagaccaaaggtaaataaaaccacaaagatggggaaaaacagagcagaaaagctgaacattctacaaatcagagtgcctctccccttccaaaggaaggcagctcctcgcgagtggtggaacaaagctggatggagaatgactttgacgagttgagagaagaaggcttcagatgatcaaacttctcccagctaaagaaggaagttggaacccatcgcaaaaaaagctaaaaaccttgaaaaaagattagacgaatggctaactagaataaccaatgtagagaagtccttaaatgacctgatggagctgaaaaacatggcacgagaactatgtgacgaatgcacaagcttcagtagccgattcgatcaactgtaagaaagggtatcagtgactgaagatcaaatgaatgaaatgaagcgagaagataagtttagagaaaaaagaataaaaagaaatgaacgaagcctccaagaaatatgggactatgtgaaaagaccaaatctacatctgattggtgtacctgaaagtgatggggagaatggaaccaggttggaaaacactctgcaggatattatgcaggagaacttgctcaccctagcaaggcaggccaacattcaaattcaggaaatacagagaacaccacaaagatactccttgagaagagcaactccgagacacataattgtcagattcaccaaagttgaaatgaaggaaaagatgttaagggcagccagagagaaaggtcaggttacccacaaagggaagcccatcagactaacagctgatctctcggcagaaaccctacaagccagaagagactgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagaactcctgaaggaagcactaaacatggaaatgaacaactggtaccagccactgcaaaaacatgccacattgtaaagaccatcaatgctaggaagaaactgcatcaactaatgagcaaaataaccatctaacatcgtaaagacaagatcaaattcacacataacaatattaaccataaatgtaaatgggctaaatgctccaattaaaagacacagactggcaaattggataaagagtcaagacccatcagtgtgctgtattcaggaaacccatctcatgtgcggagacacacataagctcaaaataaagggattggaggaagatctaccaagcaaatggaaaacaaaggcaggggttgcaatcctagtctctgataaaacagactttaaaccaacaaagatcaaaagagacaaagaaggccattacataatggtaaagggatcaattcaacaagaagagctaactatccgaaacgtatatgcacccaatacaggagcacccagatttataaagcaagtccttagagacctacaaagagacctagactcccacacaataataatgagagactttaacaccccactgtcaacattagacagatcaatgagacagaaagttaacaaggatatccaggaattgaactcagctctccagcaagcggagctaatagacatctacagaactctccaccccaaatcaacagaatgtacattcttctcagcactgcatcacacctattctgaaattgaccacatagttggaagtaaagcactccttagcaaatgtaaaagaacagaaaccataacaaactgtctctcagaccacagtgcaatcaaactagaactcaagattaagaaactcactcaaaacctctcaactacatggacactgaacaacctgcacctgaatgactactgggtacataacgaaatgaaggcagaaataaagattttctttgaaaccaatgagaacaaagacacaacataccagaatctctgggacacatttaaagcagtgtgtagagggaaatttatagcactacatgcccacaagagaaagcagggaagatctaaaattgacaccctaacatcacagttaaaagaactagagaagcaagagcaaacacattcaaaagctagcagaaggcaagaaataattaagatcagagcagaactgaaggaggtagagacacaaaaatcccttcaaaaaatcaatgagtccaggagctgattttttgaaaggatcaacaaaattgatagactgctagcaagactaataaagaagaaaagagaagaatcagctctccctctcccctctcccctctcccctctctcctctcccatctcccctctcccctctcccatctcccctctcccctctccctctccctctccccacggtctccctctccctctccccacggtctccctctccctctctttccacggtctccctctgatgccgagccaaagctggactgtactgctgccatctcggctcactgcaacctccctgcctgattctcctgcctcagcctgccgagtgcctgcgattgcaggtgcgcaccgccacgcctgactgtttttcatatttttttggtggagacggggtttcgctgtgttggccaggctggtctccagctcctaaccgcgagtgatccgccagcctcggcctcccgaggtgccgggattgcagacggagtctcattcactcagtgctcaatggtgcccaggctggggtgcagtggcgtgatctcggctcgctacaacctccacctcccagccgcctgccttggcctcccaaagtgccgagattgcagcctctgcccggccgccaccccgtctgggaagtgaggagcgtctctgcctggccacccatcgtctgggatgtaaggagcccctctgcctggctgcccagtctggaaagtgaggagcgtctctgcccggccgccatcctgtctaggaagtgaggagcgtctctgcctggccgcccatcgtctgggatgaagtgaggagcgtctctgcccagccgcccatcatctgagatgtggggagcaccactgccccaccaccctgtctgggaggtgaggagcgcctctgcccggccgccctgtctgagaagtgaggagaccctccgcccggcagccgccccatctgagaagtgaggagcccctccatctgagaagtgaggagcccctccgcccggcagccgccccttctgagaagtgaggagcccctccgcccggcagccgccccgtctgggaagtgaggagcgtctccgcccggcagccaccctgtccgggagggaggtggggggcggtcagccccccgcccggccagccgccccgtccgggaggggaggggttcagccccccgcccggccagccgccccgtccgagagggaggtgggggggtcagccccccgcccggccagctgccccgtccgggaggtgaggggtgcctctgcctggccacccctactgggaagtgaggagcccctctgcctggccaccaccccatctgggaggtgtagccaacagctcattgagaacgggccatgatgacaatggtggttttgtggaatagaaaagggggaaaggtggggaaaagattgagaaatcggatggttgctgtgtctgtgtagaaagaggtagacatgggagacttttcattttgttctgtactaagaaaaattcttctgccttgggatcctgttgatctatgaccttacccccaaccctgtgctctctgaaacatgtgctgtgtccactcagggttaaatggattaagggcagtgcaagatgtgctttgttaaacagatgcttgaaggcagcaggctccttaagagtcatcaccactccctaatctcaagtacccagggacacaaacactgcggatggccgcagggtcctctgcctaggaaaaccagagacctttgttgacttgtttatctgctgaccttccctccactattgtcctatgaccctgccaaatccccctctgcgagaaacacccaagaatgatcaattaaaaaaaaagaaaaaaaaaagaagagaagaatcaattagacgcaataaaaagtgataaaggggacatcaccacggattccacagaaatacaaactaccatcagagaatactataaacaactctaagcaaattaactagaaaatctagaaaaaatggataaattcctcgacacatacaccctcccaagactaaaccaggaagaagttgaatccctgaatagaccaataacaggctctgaaattgaggcaataattaacagcctaccaacccagaaaagttcaggaccagatggattcacagccgaattctaccagaggtacaaggaggagctggtaccattccttctgaaactattccaatcaatagaaaaagagggaatcctccctaactcattttatgaggccagcatcatcctgataccaaagcctggcagatacacacacaaaaaaaacaattttagaccaatatccctgatgaacatcgatgcaaaaatcctcaataaaatactggcaaaccgaatccagcagcacatcaaaaagcttatccaccaggatcaagtgggcatcatccctgggatgcaaagctggttcaacatacacaaatcaataaatgtaatccagcatataaacagaaccaaagacaaaaaccacatgattatctcaatagatgcagaaaaggcctttgacaaaattcaacaaccattcatgctaaaaactctcaataaattaggtattgatgggacgtatctcaaaataataagagctatttatgacaaacccacaaccaatatcatactgaatgggcaaaaactggaagcattccctttgaaaactggcacaagacagggatgccctctctcaccactcctattcaacatagtgttggaagttctggccagggcaatcaggcaggagaaagaaataaagggtatttaattaggaaaagaggaagtcaaattgtccctgtttccagatgacatgattgtatatttagaaaaccccattgtctcagcccaaaatctccttaaagctgataggcaacttcagcaaagtctcaggatacaaaatcaatgtgcaagaatcacaagcattcttatacaccaataacagacaaacagagagccaaatcaggagtgaactcccattcacaattgctacaaagagaataaaatacctaagaatccaacttacaagggatgtgaaggacctcttcaaggagaactacaaatcactgctcaacgaaataaaggaagacacaaacaaatggaagaacatcccatgctcatggataggaagaatgaatatcataaaaatggccatactcccaaggtaatttatagattcaatgtcatccccatcaaactaccaatgactttcttctcagaattggaaaaatctacgttaaagttcatatggaaccaaaaaagagcccgcattgccaagacaatcctaagccaaaagaacaaagctggaggcatcatgctacctgacttcaaactatactacaaggctacagtaaccaaaacagcatggtactggtaccaaaacagagatatagaccaatggaacagaacagagccctcagaaatgacaccacacatctacaaccatctgatctttgacaaacctgacaaaaacaagcaatggggaaaggattccctatttaataaatggtgctgggaaaactggctagccataggtagacagctgaagctggatcccttccttacaccttatacaaaaattaattcaaggtggattaaagacttaaatgttagacctaaaaccatcaaaaccctagaggaaaacctaggcaataccattcaggacataagcatgggcaaggacttcatgtctaaaacaccaaaagcaatggcaacaaaagccaaaatggacaaatgggatctaattaaactaaagagcttctgcacagcaaaagaaactaccatcagagtgaacaggcaacctacagaatgggaaaaaaattttgcaatctactcatctgacaaagggctaatatccagaatctacaaacaactcaaacaaatttacaagaaaaaaacaaacaaccccatcaaaaagtgggcgaaggatatgaacagacacttctcaaaagaagacgtttatgcagccaacagacacatgaaaaaatgctcatcatcactggccatcagagaaatgcaaatcaaaaccataatgatataccatctcacaccagttacaatggcaatcattaaaaagtcaggaaacaacaggtgctggagagggtgtggagaaatgggaacacttttatactgttggtgggactgtaaactagttcaacctttgtggaagacactgtggcaattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccatcaatgatagactgaattaagaaaatgtggcacatatacaccatggaatactatgcagccataaaaaaggatgaattcatgtcctttgtagggacatggatgaagctggaaatcacccttctcagcaaactatcgcaaggacaaaaaaacaaacactacatgttctcactcataggtgggaattgaacaatgagaacacttggacacaggaaggggaacatcacacaccaaggtctgtcatggggtgggggtaagggggagggatagcattaggagatataactaatgtaaatgacgagttaatgggtgcagcacaccaacatgacacatgtatacatatgtaacaaacctgcacgttgtgcacatgtatcctagaacttaaagtagaattaaaaaaaaaaaaagaaaattcactaattaggtgtgtgaccttgggtaaagttcaagagcaaagctacacaacttccctaagcctcagtttcttcatcattaattggggaagtgctctgaggctcaaatgaggtcatgcacataaagcactcggcatgggcagggcatctgagggaagcctgaacacttggcattgggcattgttattgttcttcctcaggctcctctcatgttgttctttctttacagcaaagttggcccgagatgaccaaattcacattctcaagcaacaccgacgtaaagaactggaaacacggcaaaaacaatatcggtgagttatgacatcagatcgagtggccacggggccatggtttcttctatctcaagagcatggtatgaaataaaccctttccacagtgtatggcctgtcactgctggaaagtcaccaaggcaccagctcccagtgtgggtgcacaatccccaaacttcaccttacctacaactccagacaagagatggagaggagagtaatgaaaataactttggatcaaccatattggcatgtaggaagaatgggcagaaaagcttgagtgtaccttaatgttctccattgtaggggttgcctcttacttcttatgtcttcttataacaattcaattataaaagtgatacatgatcagcaataaaattgacaactcttcagccaactgaccagaggattcaaaccattaaaatgagcaataagagaaaatcaatacagaaattaaaatgaataaaaaaggaaaaatgagactcataaaatgagggaaaatcaatacagaaattaaaattaataaaaaagaatactatgaacaattgcatgccaacaaactagttaaatgaaatgcgcaaattcctagaaagacgcaaactgccaaaactgactcatgaagaaatagttaatctgaataaaacaatcacaaccaaagagattgaattactaattctaaaatttcccacaaatagaagcccagacccagatagcttcactggctaattctatcaaacatttaaagaattaatactgatcttgcataaactcttttaagaaatagaaggaacacttcccaattcattgtctcatacccatattataccaaaactaaaggcatcacaagaaaactataaaccaatatcccttagcaatatagatataaacattttcaacgaaatactagcaaacctaacccagaagtatataaaaggcattaaacaatatgaacatgtgggatttagcccaggaatgcaaagttggtttaacatccaaaaatcaattaattgaattcaccatatcaatagagtaaataacaaaacaaaacaaagtacataatcatttcaatagacatacaaaaaaggcatttgacaaaatccaacacccattcatgataaaacactcaaaaaataggaattgaagaaaatgtcctcaacctgataaaggtttgaaaattcacaattaggctgggcgtggtggttcacacctgtaatcccagcactttgggaggccaaggcgggtggatcacgatgtcaagagattgagaccatcctggccaacatggtgaaaccccgtctatactaaaatacaaaaagtagctgtgtgtggtggcatgcgcctgtagtcccagctactcaggaggctgaggcaggagaatcacttgaacccagaaggcggaggttgcagtgagctgagatcatgccactgcactccagcatggtgacaagcaagactccgtccccccacatacacaaaaaaagaaaattcacagttaacattatacttaatgatgaaaggctgaatccagaaacaggataaagatgttcacttttgctacttctattcaacattgtactggagggtctagccagctcagttagggaataaaaagataagtaaaggcacccacaatggagtacagtaagtaaaactaccacaatttacaaataacatgatcttatatatagaaaatctgaaggcattcaccaaaagaaattattagaactaataaaccaccaagattgcaagatacaagataatcaattgtttttctatacattaacaaccaactatgtgaaataaaagtaagaaaaagttcaatttacaatagcatcaaaaacagtaaacatttatgaataaatttaacaaagtagtctgagacttgtacaatgaaactacaaaacattgtttaacattattaaagaagatctaaataggttgaaagacatttcatgttcatgaatcagaggacttaattttgttaaaatggcaataccccacaaattaatgtacacgttcaacacaacccttatcaaaattctagctgatttctttgcagaaattgacaagctgtcaattctgcaaattcatatggaaatggaagggacccagaatagccaaaacaatcttgataaaaagaaaacaaagatggaggacttgcacttctcaatatcaaaattactacacagctatagtattcaagacaatgtgatatcggcataaggatagatatatagatcaatgaaatagacttgagagtccagaaataagcccttacacttatggccaattaatttttgacagaagcagcaagacagtttaacagagaaagaatagtcttttcaacaaatggtcctagcaaaactggatagccacatgcaaaagaatgaagttggatccttagctcacaccatatacataaattaacacaaaatgagtcaaatacctacctaaatgtaagagctaaaactataaaactcttttaagaaaacacaggagtaaaccttcatgactttggatttgacaaaggactcttgatatgacaccaaaagcatcagcaacaaaagaaaaatagataaagtgataaagtgatgtcatcaaatttacaaacctttatgtttcaaaggacaccatcaagaaagtgaaaagatgaaccacagaatggaagaaatatttacaaattgtatatctgataagggccttccatccataatttataaagaactcttacaactcaataaagacaaatagtccaattaaaaaatgaaaaaaatgagtgaggatctgaatagatatttctccaaggacccattagtcatctaggaaatgcaaatcaacaccacaatgagataccacttgatactaggatggctagaataaaaaaatccgacaagaacaagtgttgacaaggatgtggagaaatcagaaccctcatacactgctggtgggaatgtaaaatggcacagctgcttgggaaacagtctgctagctcctgactgttcaacagagagttacaatatgacagcatttccactcttaagcatattcccaacagaaatggaaacatatgcccacacaaaaacttgtacatgcatgattatagcagcatgacctgtaactatcaaaaagtgtacacaacccaaacgtccattaatggatgaatggataaaatatagtatatctatataatttgaccatgaaagaagaatgaaatactgacacttgttacaacatggatgaatctcaaaaacattatgctaagtgaaagaaaccagtcacaaaagatcatatattgtatgattccttttatatgaaatttctggaaaagaaaaatctgtacagatataaagtagattactggttgcctaggggcagggaatgaggaagtggtcatgggagtgacagctaaaggatacagtgttccttttgccggggatgaaaatgttctaaaactgatggttgtccattgtgtaaaaattaatactaaacatccttgaattgaacactttaaatggataaattttacagtatgtgcattatatttcaataacgctgctagataaatttaaaaattaattcaaaatggatgatagatctaaaagtaagggctaacaacataacactcttggaagaaaacatacaagtaagtcttcataatcttgggttcggcaaagtctcttagatatggcaccaagagcacaggcagcaaaagaaagtagacaagttagatgtcattaaaatgtaaaagatctatgcttcaaaggacatcatcaataaagtgaaaagacaatccacagaatggagaaaatatctaaatcatatgtctgataagggacttgtatccagaatatataaagaactctgacaactcaattttaaaatattctgtacaaaaaaccccgtttaaaaattagcaaaggatttaattaaatagttctccagagaaaatttgtgaatctccaataagcacgtgaaaatatgctcaacattattaatcatcaggaaatttcaaatcaaaaccacaagatacaattctaaccactaaaatggttagaataaaaaagacagatagtaacaagtgctgccaaggatgtggagaaactggaaccctgatgctgctaccggaatgtaagatgatgcagccacttcagaaaacagtttagtggttcctcaaaatctgaaacccagctacaatatgacccagcaattctactcctaggcctctacccaagaatattgaaaccacatgtctatacaaaacttgtacacacatatttatagcaccattgttcacaatagtcaaaaagtagaaacaacctaaattccattaactgaggaatgaataaacaaaatatagtttatccatacaatgggatattttttggcatcaaaaaggaatgaatgccaagcgcggaggctcacacctgtaatcctagcactttgggaggttgagacgggcagatcacttgaggtcaggagtttgagaccaacctggccaacatggtgaaaccccatgtctacaaaaatacaaaaattagccgggcatgttggtgcacgcctgtaatcccagctgcttgggaggctaaggcaggagaatcacttgaacccgggaggcggaggttgcagtgagcctagatcccgccactgcactccagcctgggtgacagagcaagactccatttcaaaaaaagaaaagaaaagaaaagaaatgaactacagatagatgccaaacactgaatgaacttcaaaaatatgctaaatggaaaactcacttacggaagaccccatattgtgtgattctatctgtatgaaatgtccagaataggcaaacccacagagtcaggttagtaggtgagtagttgcctagcactaggagttggggaggggaaacaaggagtgaatgttaatgggttcgaggtgtcctctggggatgagattatttcagaattgggttataatgatggttacacatacaactctgcaaatatattaaaatcttttgatagcatatttttaaggggtgaatttaatggtatgtaaatgtatctcagtaaagctttttggaagataataacacattacagagtgctcctctggaaatgggtggctgatgggctgtatccagcctctacaagtgtttgatggatcattattgacttatgagtaaacagagatattcttcaggcttccccagtccacacttgtctgttgtctatatcaaggttttctttcatttcatttcctgctttggcccctggaaacatttgagtctgtgcctccttccaagggaagaaagtggaaggaatcattctacatggacagtgaagttacctgggctgtggaggggcctttgggagccaatattgtgatacttttctacatatccctcaatagttgaacttcttacaaggaatatgtagtatatctgggttgtttttttaactcaaaaaagtaaaagaaggaaaataatatagagccagaaaaatacctattttctgtatgaattatgaattttatgaactttttcataaaaattcatgtttaattgttttcactttgtcttattcactttttaaaatttgggattgtgctatatataccactttgcatcctccttgctgccctttagcagtgtagcaaaaatcattttcccatattttcaaaatctcatcataaacattattctagtttctatgtactattccattggatggatgcctcatcattcacttaaacacccagcttccctggacatttaggaggtttctaatttttgtattcttataagcaaagtgaaaacccttgtatgtgaaatttgtatacattattaagtattttcctaggacagatgcccagatatgaaattaccaaatagtaaaagttattagtatacattgacaaatttctcctcaaaaatctttaaccatttgggaggctgaggtgggtggatcaccaggtcaggagatcgagaccatcctggctaacacggtgaaaccccgtctctactaaaaaatacaaaaaattagccgggcgtggtggcgggcgcctgtagtcccagctgctcgggaggctgaggcaagagaatggcgtgaacctgggaggcggagcttgcagtgagccgagattgcaccactgcactccagcctgggcgacagagcgagactccgtctcaaaaaaaaaaaaaaaaaaaatctttaaccagttttcacgagccatgtatgggtccctgtttcatcaaacacttgccataactgagcaatatcttcatttttcttaatttttctaagttgcaacagcatccctcaaccctgtagctccttcttcccctatgcccagccacccactgctgtcaaggggtgagaaatcccacaccaagaacacaattgccccacctcaaaactgtcttagcttcatcccccttttcatcaaaaacattccttgaaacagaataaagaaacaacaaacagccacacgtatgtgggtactgggtctgctacggagggctcggctgatgggtggcactgggccactggacatgcatctcgaggacaggggccagccagcacggagggctgaaggagaaggagaagaaatcagactccacctcttgccattcaggagactcagcttggggttgattagacttaaaagttaaaggcaaaactgtaagacatttagactacaggtgattattcttccaggtctcaagctaaaaggatttttcaaacaagactcagaacatattaaacacaaaggaaaagattggtaagtttgcctccctcaagataaggacactctgttcattgaaagacaccaggagagagtgaaggcaagtcatggagtgattgacgagaattattcctagtatgtgaaggacctacaaatctttaagaaggggagtgtcattcactagaaaatgggcaagaagtttgagtacttactgtacaaaatataagcagcaagtatacaaaaggtgttcaacttcattaggactcggggaaatcagaagatcacagtgaactgctgctactaccacacatatgcccccagatgggcaacacttcaacaactgacaacacctgagtattaaagaagatccagagggctgggaacactcatataccaccggcaggaggacaagttggtaagacctccgtggaaaacaatttagcaatatgtcataaaactgaagctacattataatctatgacccagaaatcctatagtgggatccaaatttgtgtgcatgtgcgcctggatactcacaacagcattactcatgatggccaaaaaatggcaacaactcaatgtccaacaaacagtagaacagacaaattgtcaaggaaaattctacactgcaaggaaaatcaacaaactgctgctaacatggacaaacctcactgacgcagtgttgaaggaaagaagccaggagcgtgtctggccaattcataactttggaatgaaattgtttagggaggtgtgtcatagcggaaccttaaacaataacaagaaaatgattatcataaagccgaggatggtcattaccggggatggaaggagggttgattgggaaaggtgggggtgagggtacggacaatgttctgattttttacctggatggtgttcgtacaggtgttttgtacatttttctgcatgtgtgagtgtgtgtgtgcatatatacatatccatacatattttatatattctatttcccaattgaaaaatcaaaaataaaacttacatgccattagcatcaagtgtgggagagtaacctgctgtgctgtgggtcatgttaagggtttataaatgtgtgatttgttttagagtatttgtgcacaagcctctcagctcaggcaccatatgatgtgtttccagacttccatacctggtgcagtgcacacgttgtgcttgagctctgcctcccatcccaaagggctgttgtttctatgcttcttccttggcttccctccctgtttcagacacctatggcaaagcccctgcagccagttctcagagcacttctggcctgtgaatctgggttaagataaaatgcccataaaattcatttaatttgttataagccactaacactttagtatgaattagtggggctctaattagactttgctatctactcatctaagataacacaaactagcccaattatctgggagctacttaacattatcataatcttgcagcagggggcttctggtgagatcgtttccccctttcttagatttaatcatttttttcttcctccttccactcatctgtccttttcagaaaccctcctttgcttccgttcaggaaacactgaactttgcactgtctgcacaatcttggagttcctctttctcagaagatttctcaggcttccagatcagagtttggaagtaaagcaatgactaagaatagtccacactatgtcagaaagctggcgcttcttgcaggccctccttactcactcagccacgcagggagaaggagaagcagacccaggtcatagcccacagcttgtgctctcccactgtgaccacatctgtctgtgttacatgcacactcacacacagcagtaaatggcaaagtgtaggtgtttgttaatcgatataatttaatctaatcattatgtgacctgcacttttcactcatcactaagtattgaagaggatctggttgacacagatagatgtggttcatgcagttaacttcttcatggcatatcagtatctgaataacccatgcgctcgtccgctctcctgctgatgggcaggcgggctgtctttaatttctagctgttgcaaaccaagcgacagtgagctttctcacacatctctctgtgctctcatggaagagttactgtagggaatattccaagaagtagagttgcagggttgcagaccacgtgtttttaagctttctagatattgctgattgttttccaaaggcattctgccagtagacaccccagtaactgtttctgagattcactgtttccctgcatcatcaacacttcgcatcttcagatgttttcattcttgcgtgtgaaatagtatctcatatattttccccttcttaaactgctactatttcttgccttctgggaatgcaccataatttacttagccattcccctattcactgacgttcagttcatttcccatttgtagatgtgtttgtttgttttgggtattgcagtacaaacaatgctgccagaaccaaccttgtacaaacatcttgatgtactggtgctttaattaatggcagatccatttccagaactcagattgctggaacaaatcagcattttttcatcttaagaaataccgacaaaaatcctttcacaaaattgtatcgtaatttgcggtcctaccagctgtgtatgaaaagatacttttgcccatccatacatttgtcagtacccgatgaccttgtttgacagtctaaaaatccctaagaccttgtggttgttttagtctgcactcccctgaccactaataagcatcactgcattgcctatttataagctttttttccctattgttctttcaattattaatctaaaggagctctttctatatcaggatagtatccgtttgttacatatgtatagcatttattatttgtcttctgttgcttttgccacaggagattttagttctttattttattaactatgtattgtttacatctataacttttgggtttcctcctttgcttaagaaaaccctttccatcccagtgttacacaaatacttcccccgtaattttgtctaatacttttataatttcccctttgagtttagagctttcattcatctacctttttttttttttttgagacagagtcttgctctgtttcctaggctggagtgcagtggcatgatcatggttcactgctgcctcaaactaacccaggctcaatccatcttcccacgtcagcctcccaagtagctggggctacaggcgtgcgccaccatgccccactcctgccacgtgttttcatacatacctgggtggaactctcccggtagcattcgttcctgacttggatgacagggatgatgtctttcctcctgacttggatgacagggatgatgatacccacggtacaagctggcataggatggcagtcatgagctctggattcgagtgtctgggctcaactcacacttactggcactttctccagtcctgtgaaagttgtttaatctgtctgtgcctcacttccctcatctgtaaaatgagggaaataacagtgccttccttttaggggtttgagataataggttaaaccatgaaaacacagagaatagtagtaggcacatagaaagcactggataagtgttggcgagttttgtattatgtatacatagtctctgggtctgtttccgcactttatgtgttagcctatttttctactcgagaccccagcaccagcttttggttatcataactttctaataaatgttaatgtctgttacatatctcactgttctttcttaagtttttcataatgagaattactttgaacttcacataactgtgttatgtgttggcattttactgagattcagtctttccatccaggaacacagcgtgtctttccacctctctagatcctgtgtcaacgtacttccatagaatttctagttttcttcatgcaggtccttcacctttctagctactctacatttagcatttgctgttctgagtaggatatttttctgtttgcaaaaatattgctgggataaatgtaaattacttgtttcttacatttactgtgtgttggtcccttactgaattctttcattggttctaatcacttgtttttgtttgtttgttgttagtgagtctggttagttaatgtgctcatattatctaaatgttaataattttgtctcttactttccattatctacaccactgatattcttttcttattccatgtctggaattcccaaaacaagtagtggtagtagtgatgaacatccctctcatatttttgtttctttgtttactattatatttgctgtagttttataatgcatattctttgctgtatttaggagtttattgattcattctaatttaatttttgttcagctgaacttgttcaattaatttcctcagaaggtccatgtgtagtgtaagatctgagtctgtgcttgtcgtcctgtccccctacccatcccctcaaacaaattcccctgccctcattgatgacaatatgagaggcttagatgacgatctaaaaaaagtgtgtatacacttcagtcttcccattttcagaatgacagaggagaaatctaatgatagtttgtttcttttcctagagtttctatctccctccctcccccactttcttcctctctcgttcactctctgcatctctttccttctctctgtctctgtttctcctgtctcttggacattttaaaatgtattcagtatatacctaggtgtatctttttcctttttttttttcccccccacctaggacttgtcattgagaaaaatgacgagacaagtctcaatcattttaggaaatttatttgcgaaagttaaggacgcatgcccgggagacagcactatgcctttctctgaaggtgattttgagggctccaaatttaaagggaaaagggcgggatattgagaagtacacaattttcatgtaagagcagggcagggaaaaatagttattcatgcctttctctggctcagtgaatctgcattttttttaacataagatgacataaacaaatgaggcagaggaaaaatgcagggagtctgcattttacataagagaacatagataaagtaaggcaggggaacaatcagatatgcatttgtatctggtgggtgactgcacttgtaaagataagctatcaatttgcattgccatggtgaaattttaacggttcactaggaatttccttgtgagcaaaatatggtggagacatgtagcttttcatcatagccatcttatttaggaaccaaaagggggaggcaggtttgcatgacacagttcccagcttgacatttccctttggctaaatgagtttggggtcctaaaatttaatttcctttcacagacttaagatattgaagtatttttcagcttaaaggagttcttcttttatttctttgatttttttcacttctccatatattactctctctccttttggagcttttactccttgcatattacatctgtatctggctttcatgtctgttaatgaaaagagtcacactctgtgaaatatttgaaaagacttattctgagccaaatatgagtgaccagtggcccatgatgcagccccaggagatcctgagaacatgcacccaaggtggttggggtacagcttgcttttgtgcattttagggagacataagacatcagtcaatacatgtaagatggacagtggtttggttttggaaaggtgggacaacttgggggaggggagcttccaggtcataggcagattcaaagagtttctgattggcaactgcttaaaagaattattatctaaaaacttggaatgtctaggttaagataaggggttgtggaaacaaagttttttatcatgcagatgaagcctccaggtagcaggcttcaggtagaatcaattgtaaatgtttcttatcaatcttaaagagtctgttctaatgggcttaacatctctgtgttgatgtgaatgctgatcagttgtgcctgaattccaagaggaggagagtacaatgaggcacgtttagccacccattcctatcatggcctgaactaatttttcaggttaactttggaatgcccttggccaaggggagggtccatcagtcagttcaggggcttagaattttatttttggtttatgtctctcatagtttcatttatggcttccatttctttgtagtttcaccctgtatttgggttacatgttcttctattttgcacaaagcacttcctggcacatagtaggtgctccataattagttgtcgaatgaacaccttctctcttctaggtgttaatgagtttagcttaaacttttctccttacatattttaaattcagcctaaaagtttctctgtacatagtgaactgtaacctaactggatgtgtaaacagactgtcacctactctcatagcaagtaaccaagtctcagccaatcacagcggccagacttcagccactcacagtggccagctgttcaaactgggctcaagtaaggcaaatgctgagccatcaccaatctggctgtttctgtacctcacttccattttctgtacatcacgttcctttttctgcccataaatcctatccaactatgagacagcatcaaagtcactcggagcctgctctggtttaggggctgccctattcttgaattgttctttgctcaattaaactgctaaatttaatttgtctaaagcttttcttttaatacaagagaccaaacatctcacagtgattattctctttgtctgtttctctattgaagtcttcattcagaaatcatgtttgtggttacagaaagtctttttacactccaattatactaactgcatccccttaggatctctctgtctgtctgtctctctctctctctctctctctctgtctctctgtctctcttgctttctctctctctctttctctctctctctctctctgtctctctgtctctcttgctttctctctctctctttctctctctctctcattttttttccaataaattaaatgcctttctacttctttgttccttctgcctgggtgttccacttggtcttcctcaatggagtgggattccatctccaccagttaatgtctgtggccatgcaggccttcggctcctgtgcaggtcagcctgtcagggtctcttaagcagcagtgacctgcagtggaagggacataaacatttggtttcaggggggcagtagtgaactagcaagcaagctgtcctgtctccatgtgctgtgaggccatcatcttctaaccacacaagtggggcatttctgcccattggtgctgccaccctccatagaccagggcagggcatggggcaagaaggtctttttggtgctgaagaagtattccacatccgtccaagtggactattcacttaagaaaacattaatgccatttgctggcacagatgcccttgcatggctcattgtttacatactgaaaaacatctagctccactgagcttttaaaattaactagagcccttgaactgtccaggcaaagagaaaatcatcagtaatatttaaattgatatgactaatgatagctaattaattgatcattactaccagtgaggctactgaatggctcaattttagatatatattggagatgccttgagtcattttccaaaacaaacaaacaaaaaatgtgtagacttgtccacatttttatccttgttaatatactatcattggcattaatacaaacagcaaaaatggaaggttttcttaaaatctgaggacgtagaatattctaaataaaccaacagtgagaaatgtaaggtgccacataacagaaaacacttgacaaaatgcctttgctgtcagaaggatcatacccggtccctgttcacttcttgtgatcctaaggagaggctactgggccaagaggacactgtgacagttgggatttggggaaagtcaaagcacaagatcatattaaaataactcaggacttttttaagacccaaaatctcgatattttactttcctctcaaaagaaaattttaaaaggaaggagaattaggaatataaatgaaaaagctaaaaccctaaaatgtaaaatctggtttttaaacaaacacaaaatcattctccctccccaaagaaactaacaggatttcattttgtttttgttaccagaaaggggtcctgatccagaccccaagagagagttcttggacctccacaggaaagaattcagggtgaatccataaagtgaaagcaagtttattaggaaagtaaagcaataaagaaaggctactccataggcaaggcagtagcatgggctactcgactgagcatacttacagtcacttcgtgatcatgtgctaaacaatgagtggattattcatgagttttccaggagaggggtgggcaattccaggaactgaaggttcctcccttttttagaccatatagggtaacttcctgacattactatggcatttgtaaactgtcatggcactggtgggagtttcttttagcatgctaatgcattataattagcatataatgagtggtgaggatgaacagaggtcactttcatcaccatcttagttttgttgggttttggccggcttctttaccacaacccattttatcagcaaggtctttctgccctgtatcttgcatcaatgtcctgtctcatcctgtgacttagaatgcctaacctcctgggaatgctgcccagtaggtctcagccttattttacccagcccctattcaagatggagttgctgtggttcaaacacctctgacattttcacaatttaagtttactcaataagtaaacaaaaaagcaaaataaacatttttcaaaaacacaaatgcccaatgccacgggatacgtttcaaggatgtcaggatctgagcatgtttactggatgcagtccgtggcttgtctttggggaagctgttttgattgtaataatctctaaagctgctattggccagcaggtgagagagggaagccttttagccatctgtgcctgggtccctctcccaggccacctgctgccgtgtcgtcctattgtgaaggcagaagaactgtcccatttccccaaatgccacatgcaggacatgcacgcagtccagggcacacactgatcaagttggcagaatggtggatgtccaggttgggcgtggctgggcagccttaataccttctacctccagtgactggcaaggcaggcctctactgttcaatgtcacctctagtaagtgaggtctccctagactacctacagaactttttatgcagtggtgcacacctgtaccactataagcccagtctcagggttcccactctgatgctcagggcacagcaaagttggtgcgactggactttggaagaggtcccagaaccttactggacacagggtcagcctatgatgtgttgactttattttgagtacatcaatctccctgtgtaacatcgtctgacagtgtgggcggccctcagctgagggggcagaccaaaggctggcatttaactcaatttcttctcctttctcatgctcagatggatggagtggaaccctggcttccccttgagcatcgatgccaaatgccacaaggatttaccccgtgatatccagtttgatagtgaaaaaggagtggactttgttctgaattactccaaagcgtaagtttacgagaactgagggactctgggcagcccctccagtggctggtgctgggggtggaaccctcactcctttcctcatggggtccttgggttgggggaacagcctagctgagccaaacgctttgatgatatgttggccatagagtggattctcaacgcacaattgcaggacaaccggtatcttaaaaaaggcataaccagaggactccagacaccagacatacatgtgtttttggcccaaagcaggggtctttagttggaatgcctcctccccatccatatctcatgctctctatggccacttcaaaggtgtgaaggctttgtgtccaggctgtcaccaagatggcaggtgctatggtaagaatggccaaattgccagtgctgatcccaggacatatgtcccctgttcctccgtcacaaccccacgagggagccacagtcatcatccccattttacagttgaggaactgaggaatacggaggttgactaccttccttgcctaaggcccccagctaataaatggcagagatataggttctgtgcacctttgtttcatccgaatgtccgcagggctttttaaagcttgcccaggctatcgggagactctaggctgcttgttaaacatatggatcccccgaccctatcccaggactactgagtgtagggatctttaaatctgcacattgaccctatagggaattttaaaaatcatgtcagtttggcgaaactattccaatcaatagaaaaagagggaatcctccctaactcattatatgaggccagcatcatcccgataccaaagcctggcagacacacaacaaacaaagagaattttagaccaatatccctgatgaacatcaatgcgaaaatcctcaataaaatactggcaaaccgaatccagcagtacatcagaaagcttatccaccatgatcaagtgggcttcatccctgggatggaaggctggttcaacatacgcaaatcaataaatgtaatctagcatataaacagaaccaatgacaaaaaacacatgattatctcaatagatgcagaaaaggcctttgacaaaattcaacaaccattcatgctgaaaactctcaataaattaggtattgatgggatgtatctcaaaataataagagctatttatgacagacccacagccaatatcatactgaaggagcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgtagatgacatgattttatatctagaaaaccccatcgtctcagcccaaaatctccttaagctgataaggaacttcagcaaagtctcaggatacaaaatcaatgtgcaaaaatcacaagcattcttatataccaataacagacagacagccaaatcatgagtgaactcccattcacaattgcttcaaagagaataaaatacctaggaatccaacttacaagggatgtgaaggacctcttcaaggagaactacaaaccactgctcaacaaaataaaagaggacacaaacaaatggaagaacattccatgctcatggataggaagaatcaatatcatgaaaatggccatactcccaaggtaatttatagatcaatgccatccccatcaaactaccaatgactttctgcacagaattgggaaaaactactttaaagttcatatggaaccaaaaaagagcccgcattgccaagacaatcctaagccaaaagaacagagctggaggcatcatgctacctgacttcaaaccatactacgaggctacagtaaccaaaacagcatggcactggtaccaaaacagacatatagaccaatggaacagaacagagccctcagaaataacaccacacatctacaaccatctgatctttgacaaacctgacaaaaacaagcaatggggaaaggattccctatttaataaatggtgctgggaaaactggctagccatatgtagaaagctgaagctggatcccttccttacaccttatacaaaaattaattcaagatggattaaatacttaaatgttagacctaaaaccataaaaaccctagaagaaaacctaggcaataccattcaggacataggcatgggcaaggacttcatgtctaaaacaccaaaagcaatggcaacaaaagccaaaatggacaaatgggatctaattaaactaaagagcttctgcacagcaaaagaaactaccatcagagtgaacaggcaacctacagaatgggaaaaaaattttgcaatctactcagctgacaaaaggctgatatccagaatctacaaacaactcaaacaaacttacaagaaaaaaacaaccccatcaaaaagtgggcaaaggatatgagcagacacttctcaaaagaagacattcatgcagccaatagacacatgaagaaatgctcatcatcactggccatcagagaaatgcaaatcaaaaccacaatgagataccatcttacaccagttagaatggcaatcattaaaaagtcaggaaacaacaggtgctggagaggatgtggagaagtaggaacacttttacactgttggtgggactgtaaactagttcaaccattgtggaagacagtgtgacgattcctcaaggatctagaactagaaataccatttgacccagccatcccattatcgggtatatacccaaaggattataaatcatgctgctataaagacacatgcacacgtatgtttattgtggcactattcacaatagcaaagacttggaaccaacccaaatgtccatcaccgatagactggattaagaaaatgtggcacatatgcactatggaatactatgcagccataaaaaaggatgagttaatgtcctttgcagggacatggatgaagctggaaaccattattctcagcaaactatcgcaaggacaaaaaaccaaacaccgcatgttctcactcataggtgggaattgaacaatgagaacacttggacacaggaaggggaacatcacacaccagggcctgtcatggggtggggagaggggggagggatagcattaggagatatacctaattaggagttaatgggtgcagcacaccaacatggcacatgtatacatatgtaacaatcctgcacgttgtgcacatgtatcctagaatttaaagtataataataaaaaaaaagacatacacggaaaaaaggaacacaaatccacaggaacagttggtggactgtgcctttttccgaagatgtctttaagggcatcaatatttaaaggagaacaggctggaaggaagaaagggagggcatggtcacgttactgaatccacatgttgcaaaagaaaaggagcaggtaggggaatagtcagttatgtattcctcttgcgcttagtacatcagcacttgataaggtgaacaccaagagctacctgtggaggttttcaccttttatctgtagctatcttcgtttcttgcatcactcagctttcagcttaatttttcccttttggcagagtgaattggggtccaaagattttcatttccttttacacctagaatcctctgaggagcattagcacctgctagtgccaggccaaccccacacccacagatgacagtctatgagggtgggaccctggctttgagtctgcacacccagcaggtagacgaggctgagaacccagccagacttcaaagcttaaaataatattatttatttctaaacattgtgtcggtgttttggggggtacaataatctattttaagcttcatggccatcctgggaggtaaataatattattgaccatttctaggtgaggaaactgagtctccaaggggtcaaggtcaaggagtttgcctaaagtcatttaggcagaaattggcaaaaccaggatttgaatccaggtctgtttgtgtccaaagctggggcatttttctcctaccacaattggggtctactggagagaaaaattaaaacctaacatctggattagtaatgcagcagtatccaccatctccctggaaacatcacggcagttaggggctcacttcccttcccctactctgggattgggattgttgatcaaagccatgtagctttagtgggataggtcccagaccaggatgggacaggcaggacagaaggcccttgtgaaagagacagtttggagggaataataaggatggtgaggtagtgaggtggagagtactgccacccagtttggagggaatggaggaatactggacagatggacaatcaaaccgatggacaggcagatggatgggttgagggatggatgatgaatggatggatgaagggaaggaggaaggatggaagaagaggtggatgggggatggatggagagatagatgagaaattgatatacggatggatggattcatggatggtggatggatggatggatgacagatagtgagatggatggatggatagatgggtggatggattgatgggtggatggtgaatggatggtggatggatggaagtatagacagagagatggatggatagatggatggatggatggatggaggaattaatggtggagtgaaggccagactgtgcctttcttatctctgttcagtgtttctgaaggtcattgtcatctctgtatctcaggagcctctgtatcttagcagctgtcacagaataggtgctcattaaatcctattaaaatgaaagtgtgacccacctggcccctgagtgcccctgagtgccagctgggtcacagtccattttaacagggtttaatgagcacctatcctgtggtatagaaggtaactgtgcacctccttttcatgtatccccatcatggctaacaacagcctagacatatggttctcaatcctgtgtgtttagtgttacagactccatgctgcccactctgcacaaactgtggaaccaggggaagtccagcacagttatattttagggctactggtggattccagtgtatagccaggattaagaacactggcctgtaatgcctttctgggcctccccaccccccacatatggttgcatctatttgctgagtcaagtccatctgctgggtcccagggagtgcctcctcctctcccagctccaccatctctcctgagtgagggcaggagcatctttccagctgcctccctgggctccatctctcaagacagtgggagggcttattctcaagtgcttgtataatttgttggaggctcgctctaaaaagtaaatataatttcttggttggctcaattgcaggtgagagcccagatgtctctgcccagaaatggagatacatccatagggacgcacccgcccctgccatctctcaggtcctacatgcataggatgctccaccgtggggagccagcagggctttgcagagcatctcttgtctctgacctagctgtttcctttgccacacccaccctccccacttcttggccaagacatgggtgaggggccccttcttgcagaagcttctagaagcctctggccccagtgaggtcccctcccctgtactccccagtgccgcccaccctgcccttggccccagaagtgctgcagcccacgtttctccacatcgtcctgtcattagccccttgagtgatggcctattggcaggagcagagcgaaggaatcctgagaggggcccttctgcccctcctggcccagcaggctggacagtaagcttagccccactctgagcaccgcctctgtgctggcacagtggatggagacccttgagttctgcgggggagagaagaggtgtccctgtatttgaggagctgagccaagggggctggaccacaaggaagcagcttagaggagcctgtgtggggatgaggggtgcctgggagagggccctgggccggtgggggttggggggaccctaggaaagtcgtctaagttccctgagcctcggtgtcctcaaatgaacaatgagacccggccccagctcctccccagggttgtgagattaaaatgggatcgcacacatcagcccctcagggaagtttctccctaaagacagcctttgtcttctccattcttggttcaggccctctgggaccgcgtctccaccatcacacaccggcctagggctgcactcttggaagggcccctgcgcttgcagggtgggcaggggaccctcgcttcacctgggcgtcctctctgatggggcccaggaaggctttgcagccgggggccatctgaccaggtcttactgggcccaggcagaggtacgtggggcctggagaatggcacagggggctgcagcggagagagactgtgggcacaggtgtggcgaggccaggccgccgagagccaagtggtttgcgaaatttcctggtggtgtggagggaggaaaagctgatgtgttcacctccccactcgctgtttgcagcctggaagacgattgcagggggtggcagggctgaaaagacaatgtcctcattaaaggaaattgagaaagagagtttccttcccagtggggcgggacagtgcagaaatgcggccggtcctggaagaggtgggggcgaggggtcgggggctcacacgccctgcgatttcctcccatgagaatgggcgggggcagctccgggaagggtggcggatggagccgccctctccccaggaccacaggggcgctttccagtgaaggcgccgtaggaaacgccagtctgtgccgcagtgtacgtagaggcgctatgagcccgagtttcccacgtccagggacaaactgggagccgtgactgtcaggccgcgcggaggctgccctggccgcctttgcggtcaggtgaaggcgcagaggcagggaggccgggcgagcgcaggcgggcggagagcagaccacgcggaagaggccgagagagaaagcggggcacccggccgggggggtcatttacaagggacgctgggcacgaaggaggctggggcgaagatgagtccaggggttgggttgagagcgctgcgcagccgggctgagaagagaagctgacgagtgactcccgacaagggacgggggagagggaacctgggggcaggcagaggcctagggggtgggctctgagggcagccactcccaccggccctcccccagccccgcaggccagccacatgccccgtgctccagacgacccagctacatggatggcagcgtcctgaagggggatgatcggtagggagtgggtgcggaggctcacgcctgtaatcccagtgttcggggattcccgagcgggaggatcgcttgagccggggaggtggaagctgcagtgatctgcgccactgaactcccgcctgggcggcagagtgagaccctgtttcaaaaggcaccaggggtgtagggaaggagcgatatcccccaggcaaggaaggctgcggaggggccaggccaggagagaagggccctgagctcagtggacgggcagggtgcctgtggaggaagggagggacgtagcagcaggaggaagggtgaggacccaggctggggatcgggagaagtgatggcggaggaaagagaggccggaagaggagggggcctgctggcctggcactggaaagcaaagcgtgggtttgtatatgggaagaagaccacatcccctcttatcgtcatcccaactcagaaaccatttggccccaagtcaccaaagcactcataggaaccacttttcctgtgacacaagtaggattctcccacttttaacttcccaaatgctacccgaaagcctctgaaatccttggaaatttaaaaaataatccccttctattaactgatgcctataaaacatattgactttcattaaattttgttatgaaatcagggatgtgtcccattgtaaaataaatttgtttggaaaatgtagggtggtatcccatctaaaaatcagacgaggctagaaaatttcaattttatttgctaaggtagcatcatgttgttaaaaatgcatcataaaataagaccaagagttaatacaaagcatgaagtcatgtttccctcaaaaaaatgatttgttctgtagtcaaattaatttggaaaacattgcaaactcttcagcagtggttctcaaagtatagcttgcgtcagaatcccctggggcccttgctaaaatctggatggctacactccccgcctagagtgggttaaactcagtgcccactggcaggaaactgaaacttggctgaagtcaccgaggaggccttccccgttaaacctctggctggcgacagcttggtttcctcgccgctgcttctgagtaattctggcacgcagttcctcctagccacctgctgtacctggaagggggccagccctcctcagcaggctttgctcctgccctgcacagcacaactgtggcgtaaaaaatggaaaagctggtagcagaaggaaagagcagggagacagaggttaggtgaacctcaatggcctcattaaagcaaattgagaaagagagtttccttcccagtgaggcgggacagtgcagaaatgcggcccgtcctgggagaagtaggggcgaggggtggggggctcaccgggcacatggccaacagctggtgcccagcctgggccacagtttggcacaggagaaagctgaagatgcaggagaaagctaggtcactgcccctaggccaggtgatcaaggtggctgttacctgcctgtgtggccttgaaaaagcctggtgccctctctggcttgcagggtccttctttttacaaaagcgggtcttcgaagccctgaatattccagttatctgtaaggatatagaaatattttgcctctagatgacatgtaaatatgttcctcctaactccacttcttcctacatctgtggcttcttctgagaactaccagacccaccctgttttcagagtaaacctcctgttttgaggtcaaacagacccagctgggtaattggtgactcactcctggttcctccaaagaacaggggcaagggaccacccgggacctcaggtgccccagcacaggacctctttctggggcaccctctggcactgggccatcttcaggccctacagggctctcggggcctgcgtaggcctctcatctcccagaaataagttcttttccccacccagactgacaccagatgctacagtgaggtttacccctccagcttgacaagcattcctagcccagaacactcagctgacgaggggtgctgggggaggaaggaggcagcaaggctgaaagaagcttctctgggtattccagtgcctggctgctggtcgtagccatggtgagaccacagcagcctccctggaagcaagcacctgtgtaaaagcccctccttccccacaaggggctggatccaagtgaagaaggtaccagaaggactggaagatgatgctggtattattcgacagctccagggtgctgtagcactgagcacctactgtatgcagcccatcacaaagccagccacactgcccaggctgtgccatggcaacttccagcagtacaccctctcggtcacctgcaggctccttgttcatcctgacacatgaggagaaaaagacagtactcacaaaggcctctagccttgtggccccaggaccctctcctgagcatcatggcctcctaggagacccagggtagccaggacaaaggagagaagcatttgctaagctaagaaaggatggaaggggattgctgttctgcctggatgcacccctagacctggcagggcaggcaggagagacccccagtgtctcttgcttatcctaggagttcccccctgtggttgctccagtttgctgccttcatgcatgttcacagggtgattcccctgagacaacagagctgggatgtcaccaagccctgtgtcccatcagccaggctctccccagcctccatcctctcattctgctggatcaggaggatgtggggaggtccctgactccccagctttccccatgacaaggtgtgtgtctacagctcagacccagccatgctccacctgagaagtgggtccaggcagagcactgggtcctggccacctagggctgcctcctcaggggtgggcaggaaggggagccactggaggagtgccccgggcacagtcccctgcaccaggtgaggtcacctcttagtccatgaggcgatgctgcatgagcccctctggacactagaaggcctgggctcaatgctgagtaaagtgcaggcatgactgtgccctcagcatgcatagggcagcaggcatagattcatacacgtgagtttgcacttaagctgcagtaagagctacagaggaaatgaacagagacagcatcactccagtgagccctccagatacaccccatgtgcgcagtaagagaatggcatagtctattgggacagccacatcaaaataccacagaccagatggcttaaacggcagatatttgtctctcacaggtccggaggctagaagtccaagattagggtgccagccaatccacttgctggtgagggccctcttcccagcttgcagatgtctctgtgttcccacagcatggtcacgtggcagagagagggggacagggcatgaataagccctcggtgccttcctcttcttacgaggatgctaatcccatcacgggtaccccaccctcgtgacctcgtctaaccctaatcacctcccaaaggccccatctcctaatgccatcacactgggggtcagggcttcaacacatgaatttggggagcacaatttagtccacagcagaaaagaaaggggcacagagcattccagcctgaaggaaacagatgtgcaaaggcccaaggcaaaggcctgagctctgaggggcaaccagagtcaaggctgaagagtgggcagtgattgagcactgacggtggagaggcaacaggctatcttgttaatctcagtcttttgtgtgccagagagagaaactgaggcacagtgtgtcatggtgaacactgggcagcactcccacgctcctgtcctgcactctgcagggttatggaggaagcctgggaagtctctcccctcttttccacctttcctggacccatcccacaccctgcctcctccaggaagccctggggattgctcatacactcacatctcactccttagtacctgcagcctgcattctgaatttagcaagctctggccttgggtttctattttcttgtcctgtgcagtgagcatttggaaacttctcctcagcaccaaacacggagccatttagcagaaaatacatgagttttcaagtcaattgaactgttcatcgccccaaaagccaggcaacacggtagagcagctggatctctgttcgtagaagctttctcagggactggcccaccgagtgggggactgcaagtgcccgatgagtgaatgaatgaacacatgtgtgaatggaattcaaggcactgcaggctattctggagggtactggcctgtctcttcgacaggtgaggtgcagtagaacagcatcccgtatagatgccagtttctgacctggttctgaaaagccagtcacctacctctgcagagctgcctggagggggcgggggttgtgaggacccctgagagcttggtgtgaaggggctctgcagagggaggcatggctagtgtgcgcaaggtgacctctctcctggtctgcaggatggagaacctgttcatcaaccgcttcatgcacatgttccagtcttcttggaatgacttcgccgactttgagaaaatctttgtcaagatcagcaacactatttctggtgagtgtgcctctgggggcccaagtggtgctggggacaggggatgctgctctcctgtctgatacttgccgggaaattgacaagggccttcctgcctgctgcagcatgggggcctcgctgccaccatgccaccctggacagcaccccctacactccacaccttttaccatcactgtggtcacccttgtgcccagaggtttctcctcctcagatattcaagctcgagcaccctcaacctcatttcactatcaaaagtctcaaaagtatcagaactttttcttggcacaaatcaatcatttgtgcttctgaacagagcaaaggcagaacttggcttgtgttttaggtatttacacaaaagcaactttgggttcctttggactaggatgtgtttgatgagagcactagcttcatagtggccagtcatggcatgggaaggacgttaggaaggcaggaatggctggacaagaagaggtgctgaaatcaggacatggggaaccaaacttggcaaactgcccccagggactctcctccacgccctccttcttccatcctggacactccatgctgggctgaaggacctgagtgctccaggaggcttctgagccacgaagggccagctcaggtatgatgagttggtgccacagcctgacccagtgatgggcagggggcagcagttggagctgtgcccatccagggagcactcgggagaggagaccaagcagggactctgctcttaggtgaggtcaggagggccatggccctggctgccctctactcagagctcagggtgggcctcgcttttctcctggtagagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccaggtaggggttgatgggctggggaagtggccaaggtcacagtctgtcaggtggaagccagttcctcctggccagtgctcataggccaccaagacgctaactgcaggcccatctggcctacagcagccgcttccttttcctggcagcagtgtcagccagggtcctgggcattatgcagactgtcttgtgcaacatcagaggaggaattgcggggaatgtttctccatgatgctcgagtctgggaacataatgtcaatattttcactatcagtatcaataattacaggagctacccttgattaggggcctgtggtgggacaggcattgtgacaggtgctttacacacaaggtcatcagttgtcacccaccttgcaaaggggagaacactggagaaagaagcagaccttgtgtgagaataaaaaaggggcacgaggagaaacccaacagaatggttgattttctcgttagaaatgctgctgcccatgctcctgtcgcaccctcctccccaccctcacctgcagactcagctgcctccggctgcaaggctgacctagtcttgagacagaagaagttcaaaccaactccacctggatctggtggggctcagcaacaggcgctggcccatcagcctgcctcttccccatggatccagcgtgatggggcctcctgccacccaggccctgctgcctatccccaggtgtccaggtggcctctgctgcttccagtcttttgagctcagcttaccctgaggccctagttggagagggatggttggtgccctttagagataaacctacagccccagtacctggcccacctgaatctagagggccacccacccagctgaagtccctgggcaagtctcctgccccagtgcaggcagtgtttcctaacctcctcctcctcctgcacccaaccaggcccagaacacttcctggtcatgtgaacagctgacagttacaatcccccacacactgagagagcatctgtgttcctgagtggactgaattgctagatgtagtaacattgatttggtggctataggtttcaaacttcaagtcagagatcatagaactttaagccatatagaatcctagaattggaagactctgagcagccatctctgcacccagcagccaaggagtggccatcctcagcacctggcagggcatcagcctcccactgggagtcccggccacctccagggcacgtgggttatgagtcacctttcctttgagctgacccacccctcactgactagactcttaaacacacactgccccgtctaatacacaccagcatgattcttaatccccacagtcattcacgctgcccatctggcagcaccttaatgatctacagcaagcttgtggcctactaaaaacgcctccattgttttttaaaatgtgcagttattttccggatcatgaatagagaaattgtatccctgttgttggtattgattcagtgttccagctcaagtttgagttcttagactttatatttggattctttggtttcaaatcacaaaaatcaactccatctggtttaatccaagaactctattggctcaggcaacagtaaaaagcaatgctaactcatttgggaccagggctcagatcatcccctgcactgtctctctctcgctccatgtctcaatcctctgcctctggtgattttttccttaggagggtttccttatgtggaggtaaaaaatgatcaccggcagcttcagatttaccttccaccagcttagcaaacaccacccactcccagcaagaaagaccctgtttcccaatgctcccagcagatgtcttaggccatcctcgggcctcactgattctgtgagccagtgcccacggccaggagaatggaatacactgacctagaggggacagggactctagacaggcaaaaactccactgtcagaagcagaatcctaaaatgtcagaactgaaaggtaggcccgcccctcgttttccagaaatatgaaagggaggcttgggataacagagaaatgctgcaggcattggccccaaatctcaggcctcctattcccagtatcaccttcaccagcctgggtggtctcaagattggattagcagccattccttctgggtagagtctgatggtcacttcagctctcaaagtccagctatccagccatagtcctagaaggcaagacatcactgtgcccgaccaacccaagggtctccacctgcccccctcaacacaaggtgccctgagtgcctccgcggggatagtccccgtccccacccctgcttcccccgcccatcgcgacagatgctcagagctcatccctggtgtcacaccacataaaggaggagggcggtggccaggctccgagctcctgccgtcctgggtgggtggcttctgtcctgcgtgccgccgggcagcccgggggtcctgcgcgcgggcgcggtcggtggagctgcaggggggcgctctgggatgtctccaggcagagtagatactgacccctccgcagccgggaccctcaccctttccttcatcactcaggaaacagaaaaggcttcagaaggagcggccatgcccccggcctaagcgctgcgttcccggcccagcaggcctaccctgcacctggcgttcctaggggcccctctgcgggacccactgcgcggctcgcagcggccgcccgcctcccacttcaccggcacgctcgttgcgtgtcgaggtgtgttgactcctacagcaaagggcacggatccgcgggtcagcaagcccgacgaatttacaccaatgacccgccgtgtcgccagtctcagaccagggcacaacacgccaaccctgcagaccacccccacctccccagccactgcagacccttccccctctgcttctgcagcacctctcccgaaacacgctcattcccgcccccgcagaccttccctacctcctggagacccccctcaacccctgtagagtcccctgcccgtgcagaatcccctcccccttcccccgcagcccccctaccccacccggcggacagccccgcctcgcttcctgtctcttcctcccaagggagacccctgtcctggctctgactggggttgagttcgccagttttgacttatgtgtagagtccggcagcatcattttttggcatttaactcgtcacatctatttcacctaacctctttcttcttagtaaactgacactcgggtcggtctctcatctttcgtgccagtcaagcaggtttcagacaccacaaatgccgaatgagctgctgccattccttcatcttaccccgaactgccacaacctgtgaacaccttccatgtgaatcaatcagccttggagtcagaggagagaagtacacattctgagctccgctgagtcgcaggaaagggagaggggtgcccagaggtcatcactctttccccaggcctgatttttggtccgtctgctgagcctgatttggacacatctctctgcctcctgcagcaagggaacattttcatcgtggactttgagctgctggatggcatcgatgccaacaaaacagacccctgcacactccagttcctggccgctcccatctgcttgctgtataagaacctggccaacaagattgtccccattgccatccaggtaggctgctggggggcacacctttctgagcagctcagtcctctgcgatccagggctcctgggtggctccattcacactccagctgaggaagctatgtcttgaaagacactagggcttcctgcaggccctgaggtgggctgtccataggggcggagagggttctactccccaaggcacacttgagaagcccctggccagtcgaggcacactgtggaggacctgccctgggatcatattctgcactctccaccccagcaccctgaccaagggcccccagtcaaggtgctgccaggggccaggcaggtgaagctgtggactaagctggagaccaagaccactgaggggcaccatgggttctggggtcaggaaccaggccagtcctggtatgccacctttgatgatgatgtgagttcttatgtccaccggagatgaggcaggaggaagagggagaccctggaggaaaggcaggcgggcacagggctttgtctccccctgttcctggcaccagcctgctgccaggctgggagctggtgtgcagacagcaggggccaaggccaggactggactgggcataggtccctgggagtagggaggaactgcgcagaggacaccgtgggagactggcagatgagcattcagcaaataatgtccatgaactggaccttgggagctgtggacacaatagcagctggataggtcaggcaccagccacatgccaaggctatcctatgggttaacctgcacagtccgcaatcccttaccctcgattctaaatctaaaaaatctgaaaactgctgcatatttcaaaactgtgcagcaaattcattgtttgtaaacaaaccttctttgaagcaataggtgaggttatttagaggctttttccattcaatgtgatatgtatgtggatcactgcagaaatactgctctgttcgattgtaaaatagtatgttgccctagactgggggtgggagggggtatggcacataatgaagtatacccactgctaaaatcctaaaaattctggattctgaagcacatttgaccactggggttttagataacctatctttatttgtgtaatcatcaccacaaccatcctaggtagtgggctctattgatgttgatcattttacccagataagaaaactgagacacaggtgcccacagccagccacagagctaggattcaagccaggtcatctgactctagattccagcctccccacagtctcccaggggcacgtagcctcagaggagcttcctgtctgttaccagagagaagccctgtgcctaagaaactgaagcagcaggtaaagggacaggtgacctaaaagaagacaaaattgctgggagatccccggagatcccaggcaccactgatggtgccttcaaaagcttggctcagagatctcttggagcagcctggagtcaggggcctagcttaaattccagttcagccacttgctagcaggctgtgggaccttgagcaagccacagaatgttcctgggtctctttcttcttctgaaaatggaaactttgcaaactataaagactcaagcaaatgaaagccagaggatagtaaatccaagatctggttctttgaaaggtccaaaaaataataataataacctcctcatgaggctgatggaaaaaaagagatagaaaaaaaaaatgcaagattcggaataaaaaaggaatcataaaaagagtaattatagccaggcaccatggtggtacacaactgtagtcccagctacttgagaggctgaggcaggaggctcacttgaggctgtagtgtgctatgatcacacctgtgaatagccacagcagtctagcctgagcaacatatcaagaccccgtctcttaaaaaaaaaaaagaacagtaattatgattacatattttttaaatgagagtaatatggcaaaaatttgaaaaattagagaaatggataaaaacctaggaaaagataaattagaagaaattgtagaaaataggccaatttccatatagtgattggaaacagacctacacagcgagcagctgagtctcacccagccactagacagctgacatttccagggctctttatcagccccaaattgatcatataaagctggtgtaagcttagttctgaaactggatacaggcaggcttcaaaagaaggctgaagaccaatccaagtattaaataaagatttaaaagaaaactaaaggtgatattagcgaagtgagtgcagcagtgtattaaatgactatatgtaataaccaagcagggtttattccagatatttcaatatcaagagagctaccaccataatttattatacccataaggataaagtttatgattatatcaattcacactaaaagggaatttaataacatttaatagccacaactaataaaaattaataggaggaaccttactttatatgataaagatagctaacatcaaaaaggtgcaactctaatgccatttccattaaaataataagaatgctgatatcactgtttttattcaacattattttagaggtcataccacatgataaaacaggaaaacaatcaataaacatattgtcaaagaacagggaagatgatcttttctggtaatgctatggtagacctagaaaacacaagagattctaatttttttaaaagctactagattaataaattcatttggcaaagtgtttagataaatatatttctcaaaaaaatcaatagcctttctccatactaacaataaaatataatgcccatataaggaaaaactataaagttatttatttatttatttatttatttatttatttatttatttgagatggagtttcgcactgtcacccaggctagagtgcagtggcgtgatctcggctcactgcaacctccacctcccaggttcaagcaattctcctgcctcagcctcccgagtagctgggattacaggcacctgccaccacgcccagctaattttttgtatttttagtagagacggcatttcaccatgttggccaggctggtctcgaactcctgaccttgtgatttgcctgcctcagcctcccaaagtgttggcattacaggcgtgagctaccgcacccggccaactataaagttattttaaaggatatacaatgaactcttaacagtgatttgatattggggaggaaactgtaaaaatgtcagttctaccaaattctattataaaaacttaatgcacttccaagtaaaatttcagccagaattttttatctttcttggtgggggtgtggtggtggtgaagaggaactaaaaaggagagaaaacaattaaaaaattgaaagattcatatggaaaaagaaatctagcatagtcaaaaattttttgaaaaaaattaaaaccacatagagaggcagggcaaccaagtgagacctcatgtcttaaaaaaaaaaaaaattaatagaaaaaattaggtatggtggcgcatgcctgtaatcccaactgctcaggaggctgaggtgggaggatggcttgagtccaggagtttgaggctgcagtgagccatggtcgctccactgcactccacactgggcaacagagtaagaccctatctttaaaaaaaaaaaaaaaaagtaaaagaaaacacagaaggaacactttccttgctggatttgtaaggttactgttaagcagacactgtgcttgaaaacagagagaattgggggacagtatagagtaagatccagaaatggactcccccacagaggaattcagtgtatcacaatggaggtttttcaactcagtgaaaaagggatattattttaatgatgctatcacactgcctttgcatgagaagaaaattaaattggactgctctgtcatgccatttacaaaaataaatctcatcatgtagaggagttgcttagaagaaaaagaaaaaattcagatgaagtaaaaattaaaatgaaaaaagtaaacgaatttagaaaaactaattacgcagacactcagaagacttttagaaggaaaaggaaaccaagaagttataaggggaaagctaagcatatttgattatgtaatgttttaaaacttgagtgataaaccataaacaaagccaaaaagcaaaacagagattagggtgagtaaccataacagaagtgacagctaagagatgcctatctatgatacacaggtagctcctttacattgacgggaaaataccaatactccagtggaaaaatgagcagagaatatgaataggcaattcacaaaagaagaaatgtaaatgggcaaccagcatatggaaaaactcctaacttcacctgtagttagagaaatgcaaatgaaagttaacaatgagatatcatttctgacatgcctggttggaaaaacaaaggggtaactcccagacaccagcaaggacggagccccatgctctgctcatgagttgttgcagcctggcagtgttcacgggataactggtgggcctgggcagcccaaggtcagagcttcggccagcaccggagcaaggtcagagcttcggccagcaccggagcagatcccacagcgcctgctgtaccaggtgcatgttgcagtgggcggtcagagggtcctggggttgaggctgtcgtggcgaggacagttgtgttaccgagctggactgggatctgcttgcccagtgcagcaaaaccaaacactgagattgggatataatctacgagaacacaaggcatttattgcggggaccaaaaaaggagaattgggcagctcactcttaagaccggaactccctgatggcttgcaggtaagggtttttaaaggcagagtgaatttcaggaattgcagaagttaacaggcaaaatcattaatcaatacatggagggtacacattggttttggcctaaaagggcgggatatcttgaagtgggggtgggcttccaggtcataggtagattcaaaaatttgttgttttgaaattggttaaggaagagaagtttcatttaaaaatttgggttaccagaaaggaatgttagctgtggcttgtgggcgggacttcccccaggccccccaggaagaaatttagaacaaagagcctgctcagagttcagtcctcagttccgtcttatctgaggtctctgtgccagtggatcggtttggtgggggtctgggtttctgaaaaacaactcagagacacatgttcaggggttctctttagtttccagagggaaccaaacagcccaggactctggcttccttggctgttgttttaggctgctgttaccctcttgtttgtcaagttgctcatttatttctcagggctagctaggtgcctggaacttcccttcaaggaactcgggattttccttcatttccatgccctgttgcggggctggggggctacagtgccctaagaggaggcccctgccccgtctcaattggaggagcactggaggggactttattgtttaagtgttctgacagccagtagcactgaacaggtgtgcaccaggagagtgaaactgtctgaggaacagtagggcaggcactgtctactcgaaaacatacccaaacccccaaggctcagccttcgctagcagccactcagcagaaatgaaagcacaaatgtgtgtgggtagcaacaggagcatagtttgtgatggggaaaaaaattgaaaacagtctgaaggcagaagaggattgagtgagtgagcccttccatgtcctcaccataaaatgttgaggcgtctttgaaaggaatgctttggttcccttccagctgacctggaggggtctccacaatgagttaacagtggaaaaacaagacacaagggaccgataaaggatacatatctgtcgtatacaaatagctccttcaaactgctaaggcaatgggcatggtctcacttatgtaaaatgaatgcaaggatgcagcaggcctactgtgccagcatggggacacaaggacgcagtgtcaccaggtaggaacacagtgatggcccagtgggggacaggtgagcaaaacaaagagacagatgttgattataatcatattcagttgatggaaaattggacagataaatgtgcacacatgcaaagacctatgaaaggaggctccccagaatttggtggttatccctgggcgctggaagatgagatgatgttttctttctcaggctctcctgtcatgactcagatttctttttacgataagcacatattcttttctaatcagaaacgcaaagctacttccttacccaaaaaacaaatttaagaaacacaaattgctcagggcaagttctggcatcccatggcaggccaaaatcctggacaggagtgggaggatgtgaaggatgggttggggaaggcccagctcagtggtacaagagctcaaggagatgggcaggtgaggcccggtcaggccgggaggtgaagagaagcagaagggagagtgatgggctgaaataggcagagcactgggcccatcctcattcagctctttttttactggtcagaacagtttttttttttttaatatataaaattttagattcaggtacatgtgcaggtttgttacatggttatattgcataatgctggggttaggcttctattgaacccatcactcaaatactgagcatagtacccaatacccagtttttcaaccctttcctccctccctccccttcctggagtccccagtgtcttttgttcccacttttatgcccatgtgtacacaatgcttagctcccacttataaataagaacatgcagtattcgattttctgtttctgggttaattcacttaagattatggcttaagtgccaatcctaagctgcatccatgttgctgcaaagaacacgatttcattcttttttatggctatgtagtattccttggagtacatgtatcacattttctttatctggtgccactattgatgggcacctaggttgattacatgattttgatattgtgaacagtgctgcaataaacatatgtgtgcctatgtccttttggtaaaacaatttcttttcctttgggtaggtacacagtaatggggttgttgggtcaactggtaattctatttgcagttctttgcaaaatctccaaactgctttccacagggatggaagtaatttacactgccaccaacagtgtgtaagcattcccttttgtctgcatcctgccaacatctgtcatttttttactttttaataatagccattctgactggtatccctttgtggttttaatttgcatttctctgatgattagtgatgttgggcattttttcatatgtttgttggccacttgtatgtcttcttttgagaagtgtctgttcctgtcctttgcccactttttaatggtggtgttttttcttaagttcctcatagattctgggtattagtcgtttgtggatgcatagttgcaaatattttctctcattctgtaggttgtctgtttactttgttgatagtttgttttgctgtgcagaagctctttaatttgattaagtctcatttgtcaatttttgtttttgttgcatatgcctttgaggtctagtcataaattctttgcctaggaaatgtccataagattttttcctaggttttcttctagaatgtttaaagtttgaagtcttacatttaagtctgtaatccatctagaggtaatttttgtatatggtgagaggtaggggcccagcgtcattcttctgcatataggtagccagtttttccaacactatttattgaataggatgtcctttccttattgtttatttttgttgattttgtcaaaaatcagttggttgcaggtatatggctttatttctgggttctctgttctgttccattgatctctgtgcctatttttgtaccagtataccatgctgtttttgttactgtagtcttgtagtatagtttgaagtcaggtaatgtgatgcctccagctttgtatttttgcctaggattgctttggctattcggctattttttggttccatatgaattttaggatttttttttctaattctgtgaaaaatgatgttgataatttgataggaattgtgttgtatctgtagattgctttcttccaacccattagctgggatgtttttccatttttttgtgtcatctatgatttctttcatcagtgttttatagttctctctgtagagctctttcacctccttggctggatacattctttggtattttattttgtgtatgggggactattgtaactgagatcaccacgttcctgatatggttctcagcctgaacctgaacattgttggtgcatagaaatgctactgatttttaggccaggcacagtggctcacgcctgtaatcccagcactttgggaggccgaggtgggcagatcacctgaggtcaggagtttgagaccagcctgaccaacatggtgaaaccccgtctcaattaaaaatacaaaaattagccaggtgtggtaacacctgcctgtaatcccagctacttgggaggctgaggcaggagaattgcttgaacctgggaggcggaggttgcagtgagctgcgatcacaccactgcactccagcctgggtgatagtgagactccgtctcaaataaaaagaaatgctactgatttttgtacactgattttgtatcttgagtgtagaaagtcaaaagttttttttttgttaaggagtaaattatgtgttagaaataatagttttttctaaagactaactttttttaagccttttcgctttgtgctaataactttttgttaagccctatcatatgtagctgttagatataagggaatgagtacattctatgtccttgtactttaaccaagatatttgtgctggacgtgctcacaggcatgtcccagcttgcagcccatgccccttccttatttggaaatgttattacttttctaagtcctttcataagcaacttcctcttttcctttgtctttccactgcttttacctatttagaaaagttttaagttattagccagtcgggttttagtttagactgtgaggtttggctccagccaatggagacaggacacggtagcagggacaagctgcgtaaggaataaaaattgcttctctccattattcaggtgtgctctcgccattgttccatctgcgaggagcaccctttctgcagaaagtaaaattggcttgctaaaaaaactttttgtctaaatgctgatttttccttgcagtaccgaggaacaagcattctgtttctaaacaagcattttacttataacattgagactttactgaagttgtttatcaagtctaggagtcttttggaggaatcttcagggttttctaggtatagaatcatatcatggatgaacaaagataatttgacttcctctttttttttttttcatttggatcccttttatttctttctcttgcctaattgctctgactaggacttccagtactctattgaataggaggggtgagagtggacatccttgtcttgttccagtttttagggggattgcttccaatttttgcctgttcaatatcatgttgccggctgagctctttacctactgtgtgacttgggagagctgctaaaccagctggagcctcagtttccccccatgtaaaatgggtacagcaaggaatatctgccttgcagggtcaaagtgaggattaagtgagatagcatgggtaaagcccctagcacacaacaggggggctcctcggccccagaggatgtcaggaacatgtcagtgtcccagagccatcaggaacatgtcagtgtcccagagccatcaggaacatgtcagagcatgtggggacatgtcagaaagtgtctcagagcatgccaggcagcccagcattctagggcacagatcaggtatcagtggcccaggcatctcatgcaaacgggtgtggcagtggggaccctgagagctgggactctgtaaaagggacaagagcgtagttctgtgagaacctgggtgcagagttctgagaccttctaatttttcaagaaaaccaggtcattcaaatttttatgtgaaactgtctggtatttaaaagcagccaactaatctcaagtataaacagacaggcacgcctaatgtgcaagtcacactctgctctccctcctccctcccccctccttggtcctcagggagtgctgaggcttctggggtctctctgaccagggtggagccactggccaccagggctctggagcacttgggatttggctcgtccaaaccaaaacctgctgcaagtgcaaagttcacacctgatttttaagacttagaataaggaggtggggaatgtgaaatatctcatttaatagttttagattggtttcatgttgaagtgataatattctggatatattgggtaaaataaaattatattattcaccggcatttcacctgtttccttttatttttattaatatggcttcctgaatatatacaattccatgtgtggggtagcattatatgtctattggacagcactgttttcgagggagagacgcccaaggaccccaccttccacaatacttatagcaagtgacacagctgtgtgctctgggacagttctccctccccagccatgaccactgtgctgcagtgacactggtctttcccagcacctaaagtctggccatgccccttcctggccgctcttggctgcagccctgccacccacctcattctttctgtcaacccctccaataccccatgtcttcatgtaaaaatgggcaatgccagcacctgctgccggctcccgtgagaactcactgtcgggtgctgaggctgtgctgggctctcaataagggggcaacgtgcagggctgctggcatggagggacctggggctgggtgctggtgtgggggcacgaaagtgaggctgtgtgtacagaggcatcagcaaccaggtcaccacagagcttggggattttattttctggcattaagaggtgattgaggaggcagttaacatgacatgatttgcattttggaaaagaaaaaaactcaccttgtcccagtgtggagtggaaactggaaagggaagacaggtccagcctctgctacaggaggtgcctggccacaggtgtgggctccaggcagagctcaagctgcagaccctgatctgggaggctcagtaccaggagggccccaagcctttaaacaggaggagctgacttagggcaagaaaagaagacaggagcaccagggcagaccctggggagctccagcatttcagggaagaggagagggaggaaagtatgagagaccaaggagaggcagtagaagagggagcagggcaaggagggaagagggggacagcgatcctccccctccgctgctgggccttcggcctgcccgctccttccatgctgccagctcctgagtaactgtgagccgagcgatcactgtccccacatgacagatgctgaagccggagcttagaaagcccagtgtgtcatccagagtcatgcaggttgtaagtaatatggctgggacaggaaataccaccgcagggccctttaccccctccaggctcttctgattccaaagtcactgttaaagaaattcagatacttctggaacttcccaagaggcgaagttctccaacaactatactctgaagtgaaatatagcagtgtgtttcctttcccccaatgtatcagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaaggtacagccagctaccgccccacctgctatgggagggcatctgagatgtggagtgggagggatcactgacatcccacagggggacctgtggctgggagtgggtggcagaaagggagccctggagagatgttctcagagtcagtaatgcccctaaaggaagaaaacagctaggagcctgctgttccccaggacacgcggctggggcatgggcctgacacacgggcctcgctggccagccagtagagttggaaaaggcaaatgagttcatggtgatcctcggctgatgctgatggccgcccctgccatcactctccgtccctgttctcgaatcctacaagcattggctgctggggtgactgcatgctaaaagtacccatgtgcctcagtttcctcaccagtaaaacaggtcaaatagtacagctgccttacagaatgatggtcagattaagacagtgaactcagggagcaaagaggtaagcattgtacaagtgctggccaggaccctctgaatcattatcatgcttagtaagcatcagaggggtgcaggcctccagcacttattcagcagaaagatcagcacccagccttcacttcctccctgcgcccagcatcatcctatagggcaggcctgggtgggggagctgcgggtccctgaggcaccaggtcacctgactgggccccctctgaggcctcctcctctcccctccccagctgctggtggcacacgtgagattcaccattgcaatcaacaccaaggcccgtgagcagctcatctgcgagtgtggcctctttgacaaggtgggtgccctcctaccctacttgttgcctggaagagcccagcctggccgccttcactccctatctgagatctagacaccctttcaggaggcctggaagggtgaaggctggagtctgctcagagcactggctccagcatcctcctgatgtctccagcccgtgccattcagccaggagcactcctccaggcgcaccaccaggtcttccttctcactgatggctcctggtcccctcctcccacccctcccctctcccagcctctgggacctgggtgtagacccccctctggaacacactccttatggccccctgacctcctacgcaccaggaacctgtgtctgcctcttaatctgccacacccctgccaccctgacctggacctccccagcactctgcttcccgggtcccaaccctcccaacccactgtctcctgcatcggggactccaggccctgcccagccctcgcatccctcaggtagcaccccacctcgttttgagccctctgtagccttaccaagcttggactctcacatgggcccttgccccaaccttcctcctttccccagcccattagtgaccaggccagatgaccactgaagttgagacactgtttgggctgcaaatgacaaaacccaactcaaaccagctgcagctggacaagacatgccttatctcaaatacctggacacaatagagggtcgggggcctcagccagaaatggatccagggactcaagcaatgccccagggtgcatgcacactggctccctctttctgtctctttcacctgtgttggcatcacactctcctgctgcagacaggcccccatgggagagggcacaggagctcatcatagtagctccacctcaggttctcatgtggccattatctcccagccgcatctaaacagaaagtgctggggggcagctctggttggtcctgcttgggctgaatgcccaccgtggaccaatctctggcaccccagcacccaagtccttcttcaaaacctctgtggcaccgacagcccagccccctgggtgtatttgcatgtgtgtgtgtgcacgtggacacacatatgtgccagtgagcttgtgagtgtgtctgcatcactcagaagccgggatcgggatcaggaccaggatccctccttgtgggtctctccagccctcacctgagcacacaacaggccctcaacagagttgcatgggtcctggaaactgagggtcactgagagcaatgactgagggtcgtgtgctcagcactagagcagacttcacagcccaggcccgctggtgctggggtcccccacacacctgcccacgcctgctgccctcctgtggctgggagcgcacccttccctcttgtactctgcagccccacggttcagtcccttgcattggattgggcgggaggctcctccctagcacctctccacccggctgcccttgtcattctctgcgttaaacatccctcccccatctcacaggacaagggcttgcacctctgcctgcctggcctcctcgcctcccctggcacatttcctcagggatgggtctggacagctgtgggaggagccacccgctcagggcactctacctcccactccaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgtgagcgcccgcggggcggtggtcctgggggaggagccgggacccctgcctgactacctggggcgggcctggcccctccaccgctagcgctgaatggggacggggtgggggagtcccagcgtccgtgagggggttgccgccgggcaccgctccgcagacctggctgggtcgcccaccccggctgcgccccctgagccaggttcacggccgaggtggtagacatctactacgagggcgaccaggtggtggaggaggacccggagctgcaggacttcgtgaacgatgtctacgtgtacggcatgcggggccgcaagtcctcaggtagggcctccgggacgtctccggacccggctcccccgcagtcggcagcgctggcccctccgccacccctccggggtgtcctgcccagggtgccctccggccttggggcagggaatccgggcacggggtgggcgccgggccctggggtcctcagggactgggcctcagcccgccggtggttccaccctaggcttccccaagtcggtcaagagccgggagcagctgtcggagtacctgaccgtggtgatcttcaccgcctccgcccagcacgccgcggtcaacttcggccaggtaggcagggccgggcccgctgggcagggctcccttctcaaggccgctgcctcctcccccgccccggttctgcacgcgtactgcaccctcggacagcctcggggcctggcacgggacttgcaggatggattctgcccgctcagccaagggcgctggccgcggggaaagaggatggacggactgcagggcccgctggagttggggggcacggggaggacggggcccagggggcagctgggcagcagggcttcgggggtgcccacgcttgctggcggtcgtctccgcagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgaggtgaagctgggcagggcggggcacagccccaggtcaccccaggttaagcggttcctcagcctcagggctttgtgactcgggccccaaggctcacttggagcaaaggaatcctgacttccaaggctggaagggcccagaaggctgcagccgccaccaggtcccccggcctcagcctggacagagctcagggtgtgcagggcaggagagcacacagcccaggctttgctcactgtcaccagagggtcgtgtgtgacgccccctccccccagctattgacaaagttcttgcacatgtgttttaccctggtactccagagggaatgaccaagagtttcctgggttccttccggacacgtgcatctcatttaacctaacaactgaatccggtgtgtcttcgtggatgcacccgctttggggtagctcagtactgcatagaatggccggaccagtccaacctgctccagactgctgggtgtctgagttgttcccggccaatgtgttggtccctcactggacatccttgtttttgtggctttgcacatgtgttcagtatgaccgcacacattcctagcagacaaattccttggtcaaagaatattgatactgaattgccctccacaaactaaattcaaaatcccattatcaatagcctatgtttcttggacctttccagctcagaagctttgtgatcttaatccaatacagtatttttttaaaatgatatctagctctgccccgcagacatctgtgtgagaatgcaaataagcacaggaccccaacagggcagccaccccttcaggctccctggcccgctttctgccttcctgggctggagaggccagtgctggccccagcgcccctgatgggaggtgagagtgctgcgcaggggtggcccaagacagcaggataccatggctgcaaacaccagcagcccccagcttcatctgcatcatctcgtaaccacttggcagcaggcagttattttcccacttatccatgaagccccagccctggagccttccttagagaagcaggttggaggcgacgacacttgccttcccgaggccctcttgtcaggcagcagagggtgaatatggggaggtgaatagatgctccctccttcatctcccaaacggtggctggccccttgggatgagacaggcctgtcagtttacacgggtagtggattgacctatgtgtgtgtccatgtctgggccctcagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaatgggtcttgttccatgtgttatattccaatcaccccaaacagctcactgccatctcccacaccaagagaaaaaaaaagccatagtcaccgtgattttatcaaggcaaaagcctccccacccaagtctggatagaaggtgctttttccctcaagcagtgtctactctctttggaacacatcccaaatgtcaccacctctgggaaggcatccttggttcctgtctctaccctggatttgtcagaacctctgttcttgccccctctgtggtctctcccttgggacaggagcccctggaaggacagaaaacccactttatttatgtctgtgccccagggctggcataaggcaccagcactcagctgttctctccttttcctcctggaagggcacctagctaatggatattaggcattgtcttgggagctgggggcttattttttcctgaggcagggttcttaacatgacataaaaaataaaaatgggcagggcgcggtggctcacgcctgtaatcccagcattttgggaggccaaggtgggaggatcatttgaggtcagaattcaagaccagcctggccaacacggtgaaaccccatctctactgaaaatacaaaaattagccaggcatggtagcaggtacctgtaatcccagctactcaggaggctgaggcaggaaaattgcatgaacctgggagacagaggttgcagagagtggatatcgcaccactgcactccagcctgggcaatagagcgagactctgtctcaaatagttaataaataaataaattaaattaaataaaaacgcattctctttccccagccccaagtagcagagcccgctctgagcctgggcatggtgacccattctcctcgtgctcacatgcccaactcccagccctccagcccctggcttcggaatcatgtcatcagggtctcccatgtctctggaaggtgcttccagtgtggcaggccatcagctcagtgtctgggtaaaggcttctacagggccagcatggcataggggggaggtgtgcatgcgttcctgaagccacaaggtcttctgaggagacctgactattggggtggggactagagactgaggtccagccccttaatgccccagactccctgccatccctcggagaatttcccaccacacttatgaatgatcttcgggacaggtgacataaacatacagctatggtagaggcattcagctccatgccactgtgagaatgaacataccaacttttaggcaacaaggccatgtggtcaaggagagaggagaaacgaataggagtaggcaggggtggtgaagcaggtctgacattggcaaaagtgacagagaaggattgggttggaagggcttcagatggcagagaacctctgaaaaagtctcatgccagctaatgaagagtcctcaaagtcaccatcacagaaatcttacatctggcagaaatgacagcaatagtttggcatgaaccccacagtggatccaaacgtgtggcagctgagatcgtcagttaattatgttctctgcagctggtccttctggttccctggagctgggtatctgagtagcacagctccactgctaccacaggagagggagaatcccaaattctgtgcatagactgtctaaacctctggatgacccctaagacacatgtacataaggcaaactgcaaacagcccaatttaggataaaacagcctgtcttactctgtttgtgctgctataataaaatacctcagactgggtcatttatatagaacagaaattgattcctcacagttctggaggctggaagtctaagaggaggcactggcagtttcagtgtctggtaagggagggatcagtgtctgctcccaagaggatgccctctgtgctgtgtcctcacccagcagaagagcaaaaaagggcgaacattctcaaaagcctcttttataaggacatcaatccattcatgagggcagaaccctcaagaattaatcatttctcaaaaggcccctcctcctaatgccatcaccttggggtttaagttccaacacatgatttttggaaggacacatacattcaaatcattgcacaaccaaagtgatatttgaactttcaaatagtttgcagtttgagatcaactaagttaattgcttgcttgaataaaaacatcacagccgggcacgatggctcacgcctgtaattccagcactttgggaagccaaggtgggcagatcacttgaggtcaggagttcgaaaccagcctgaccaacatggtgaaaccccatttctactaaaaatacaaaaattagccaggcggccgggcgtggtggctcatgcctgtaatcccagctctttgggaggccgaggcgggtggatcacaaggtcaggagattgagaccatcctggccaacacagtgaaaccctgtctctactaaaaatgcaaaaattagctgttgagactactcgggaagctgaggcaggagaattgcttgagccgagatcgtgccatcgcactccagcctgggggacaagagcaagacttcgtctcaaaaaaaaaaaaagaaaagaaattttctggattaggataatgttctatatttggataagggtttaggttacctagatagatacatttatcaaaagtcatcaaatggtacacttcagatgtacgcatgtcactgtatgtaaatattaccccaaaatcaacaagaaccatgagcaaatactgacttctagtgaacgacatgcatactgaaactttcgtagtgaagtataattatggctgcagttgactctgaaatacataaaaacctaagttgatgggtgaatacagtgattaatagatagaaatctgtggtaaagcatacggagaaaaatgttaattgtagattctagggtttatatatattctcactatataattaaacgtttttatgtttaaaaatttttataatgttgaaaaaccatgaaatcctacctaacgcagtaagacaagaaaaagagataaaaggtatatgtactgggaagtaagaaataaaaccgtctttgttagcagatgacatgctcatctatgtagaaaatccaaaagaatggataaagaaactcctggaactaataagtggttacagtaaggttgtaggatacaaggttaatatacaaaagtcaatcactctcttattcaccagtaatgaacaagtggaaattgaaattcaaaacaaaatactatttacattaatactccaaaaatacatacttaggtttaaatctaataaaatacatacaagatctttatgaggaaaactgcaaccctgatgacagaaatcaaagagaaactaaagaaatagacataagtaaatattccccagaaagactcaatattgtcaagatgtcagttcttcaaaacttgacctatagattcaatgcaatcctaatcaaaatctcagcaagttatgttgtggatactgacaaacttattctttttttttttttttttttttttgagacggagtttcgctctgttgcccaggctggagtgcagtggcgcgatctcgactcactgcaagctccgcctcccgggttcacgccattctcctgcctcagcctcccatgtagctgggactacaggcacgcgccaccatgcccggctaatttttgtatttttagtagagacggggtttcaccgtgttagccaggatggtctcgatctcctgacctcgtgatccacccgtctcggcctcccaaagtgctgggattacaggcgtgagccaccgcgcccggccaacttattctaaaatttagatagggaagcaaaagacccagaacagctaacacaacaatatagtaggaaaacaacaaatttggaaaatggatactacccaactccaagacttactataaagctacagtaatcaagatagtgccgtattggtgaaagaatagacaaatagatcaatggaacagaatagagagcctaagaaatagaccttcataaatacagtcaactcatccttgacaaagtagcatagacactacaatggagcaaagattgtcttttcaacaagtggtgcaggaacaactggatatccacatgcaaaaacaaacaaacaagcatgaatctagatacagaccttatgctcttcacaaaaattaactcaaaatggattatagatctaaatgtaaaattcaaaactataaaattcccataacataggataaaatctagatgacctaggtatggctatgactttttagacataacaccaaagccatggtccatgaaagaaataattggtaagttggacttaattaaaattaaaaccttccgctctgcaaaagaccacactaggagagggaggaaatatttacaaagacacatctgataaagaattgttacttaaattatacaaagccttcttaaacttaacagtaaggaaacaatctgattgaaaaatgggccaaagactttaacaaacaaaagaagatatacaaatggcaagtaagtatgtgaaaagaagctgcacagctggggggcgtggtggctcacgcctttaatcccagcactttgggaggtcaaggcgggcagatcacctgaggtcaagagaccagcctgtccaacatggaaaaacctgtctctactaaaaatataaaattagctaggcatggtgatgcatgcctgtcatcccagctacttgggaagctgaggcaggagaatcgcttgaacccggaaggtggaggttgcagtgagccaagatcgcgccattgcactccagcctgggcaacaagagtaaaactctgtctcaagaaaaaaaaaaaaaagctgcacattctatgttatcagggaaatgcaaatttagaataacgcaataacaagataccactacatacatattagaatggccaaaattgagaacactgacagcaccaaatgtggaggaggatgtggagcaacaggaactagagagaatgcaaaatggtatagccacttaggaagacagcttggcagtttcttacaaaactaaatatactcttaccacacaatccagcaatcacactccttggtatttacttacatcccaacaaaaaccctcatatggatgtctagagcagctttgttcataattgtcaaaacttggaagcaaccaaagatgcccttcggtaggtgagtaaataaataatatccagacaatggaaataccattcagtactaaagagaaatgagctatcaagccatgaaaaggcgtggaagaaactgaagtgtgtatcactaaaagtcaatctgaaaagggtgcataagtttccaaagatatgatattgcagaaaaggcaaaactgtggagacagtaaaaagattgccaggggctagggcagtgggagggatgaataggcagggcacagaggattttcagggcaataacactactctgtatgacactataatgttggatacatggccagatccacagaatgtagaacaccaagagtgaaccttgaactatggactttgagtgatgaggatgagtcagtgtaggctcatggattgtaataaatgcaccactgtggggggggggggatattgataactggggggctgtacatgtgtagggacaggagtaaatgggaaatctctacttttgttaccggtggagggtgtaccgcattttgaacaaaaaattggacaaaacgcacaaagcaaggaaagaatgaagcaacaaaagcagagatttattgaaaacgaaagtacactccacagggtgggagcaggcctaagcaggtggctcaagggcctgaatacagatttttctggggtttaaataccctctagaggtttccattggttacttggtgtataccctacgcaaatgaagaggatgaagggaggttacaaagttatttacttggtgtagaaaattagggtttttcccttttatttagttgtaggaagcccttaggttacctgcctccagaccctattctcctgcctcattttattcctaattttgttgtgaacctaaaattgctctaaaaaatgaaatcttttaaacaagaaaataaacttataaattgcaaatatgtgtcacttacataaaaacaaagaattagtgtccctacatcaggaaaaaaacacctataattcaatgtaaaaatgcaaaaaagccaagagaaatggccaagccatggaaattcacagaagtagaaataggcagtaaataaacaatgctcaatttcatttatctgagaaatggagagtaaaacttcagtgacatacaaaggagtaacaatcattttaggaacaattttaaaaataacacttgtgatgtggctcaggaaagattcatattctcactgtaggaaggtaagtgaatcattttagaggtcagttttgcaacttagaagatcaaatgcatctaccctttttctacttctagaaatgtatcttcagaagtgcccctccctccctcacacacccccaagtgtacaaaaataaatgacatggatgtggactgcagccttgtttctaataccaaaaatcagtaaacaacctaaaaatctgtatccatgaggatttaaagaaatcctgcatgagttagaaagaataaggtagatgcctgggttctaacatagaaaatatcaaactggttgttagatgaaaaaagcaagttgcaaagtgaggtaatgtgtaaatgcagtaagcaaaatacatcatatatatagtactttctatgtatttacctatatgagcgtgatgcctccaactgcatagctgtggctccgggagcaggaccttgtaacagagcctctgcccctgactgtcctgaggggcctttccctgggaaaggaaccaggtttgattttcagtctcttttgttatcaccatgctgacagctttgcttgtcatatgcctttccctccgctgtactgattttaccttacagaagctctccttagtgcttcatcagacactccctcttttccaaagaaaagacagccgcattccatggtcatctggttgagctcgaggtgagccccagggatcatgtgcctcccaccaggctgacaccccagtggtgaggagttgccccttggctttttcgaggccaagcaactcagaggtgtggcaggattgcatgtcacagtggcacttccaaggccctggagagtgactcaacgcctctgttattaagatgtcacacaggctgtgcagcaacaactctagggacacccttcacactgacagagttggcaagcttttcctataaaggggcacacagtgaatactgtaggctttgtaggccatactatctgtcccaacaattcaactttgcccactgtagctgtgaatcaaccgtagataatattaagtgaatgtgcactgctgtttgctaatagtttattgacaaaaacagctgcttttgagcagtttgctaccccgacagagactgtggggagtccctggtggcagcgagctacaggcagccagtaccccatcagtgtggctggttccatcctctcaagcctgcctgcacccagacactgtcgagtgtgtcttcagaaaaactcctaaaattccccaaaagcacagtggctccccgagagccacctccctcaccttcttacaggggcaggttcctcttccggttccaccctcctcagcacggagctcaggggccatccccacctcctcttggccgcaagcacagaccttcccacacaggctcagcagctctgcgggcctgtcccccacctggagctgcaggcctccactcctggggacagctgtgaccatggctctgcaaagcagccttgtgcctagctcccaagtcagctggcagcccagagtggaacaattctgtggatcacctctgagacagcagcacatctgggcaagcctggcttcccacccctcacctcctgcaacctctgacccttgccatgcatgtggtagggaagctgcaaccaggcctcagcactcccagacctgtgggcggtttgctgtctgaggatcgtggcactgccttccctcagaggccttgccagagccaggggatgcagcgtggcagagctgtcactggcaaccctgctggtctccctggtgctttctcagctgggctgtgggtcaggacaaatttctatggataaggctggatcataatctagtgctccatggtcatgcagcgacagactcgagtctgccttctctcagggtggtgagctcaggtaggaacgggatgtttgaagcaagcacacctgtgagaaatgcctgttttcactcccatcccacacactcgtccagacactgccagcccacccccgacacacgtgtctgagggaggctgaggaaaacagacacctccaggagccgcatactatttcctgatgtgtaagccagacaaccctggaaaggaggtcagggaaccggagtgcctgccaacgtccccagcctccctgcagcaaaacactctcatggcaaaactcctttttaaagaaaggctttattgctgcaattagacatcccagtgtatagcacaaacccccctgtacagagaattattcaagtggtaatactgagaaacagtgaacacacacaaaagaatacaaaactagacatttagatcactagaaactttctaaggtaagaaaaatttcaaatgtgaagtgccttttagaaactacaccacacatgccagtgtaaatttggtttaacaatcaatttctataaacattgcatctaactgtgcactgatcaactgcacaacttcaacaattacttccaagacaaagataaatgcttttatttccctatgttttggtctttccttgggctagagacagaagctgcatgtttcaaaccagattcaaaagggaaagcacttcaaaacagaaagtacttcaattgtgtatttgccttcagccacatccagagacttgtggatctcacccggttggtcccagcccttctccaaccctgaagcccacagcaggggtgcagaggcagccccagatcgtgcagacatcacccgaggctcccaaactggcccagctgcctgaggcctgcatgcctgtggccaggtaggacacatgtgcaggtttgaaaactaggcctacaagactgaagagtggactgaagcaaaaaggggagaaacattagaggcctacagtaggaagagaccttttatagagttttcaggaaattctcacaataaacttgggcacaaagaccaaattgctgaggccagaagcctgcttatggtactgtgacttatggggagtagaggccaaatcagagagggctggctggtgataccccagaccacttgcctcttccccttccctggcctacaaataccaggcctcctggccctgagacctcattctgggtttctatatgggtcaaccaaatgccatcctttcactaaacccaggtgcaaaatggggggggaaggggggaagctggggagtacacagcacccaaaagaaccgagagagcaagttttccaaggctacaggaacattggcagagctggtggccacaccagatgggagtaccacatccccaccaggcttcatgcttcactgctagatgcagggggctagaagggtctgatgaatcaggagctgaactagaaccttcaagaaaagaaaaggcaagggggtggctctgtgccccgccaggagaggaaagaagaatgtgtgtggattgtccacagtgaggccagaaacgatgagatggtgttaggcagaaaagaagggagagggcttcccatgagaatctggctgggcatgggagggatacagggctcagttatcaaggcacctttgccatagtggggtgccagctacattgggtgggatgcccaggggctgtccctacctaagcactttcttgtctacaggaagtcttggtgcttttcaagttcagcataaggggttccatatgtgaagtggggattcacacttagaaaatctatcctggtcttcacctgaaacactcatctactgctgggtg

SEQ ID NO: 322 - DNA, 134056 bp, Homo sapiens
tgagaccattgctatttttggactgcaatgggcgaattgataatgactaaacaggactctggtaatgggccagtatctttttactgctatgattcttctgctataggagatctgtggttggccaagcaaaggggctcacatttataatttcaccactttgagaggccatggtgggaagattgcttttgaggccaacagttgcagaacagcctggggcacataatgagactgcatttctacaaaatatttaaaaattagtcagccatggtggtgtgcacctatagtgccagctgctcaggagacttgaggcggaaggatcacttgagtccaagaatttgaggttacagtgagctatgattgtgccactgcattctaccctgggcaacagagcaagacattgtctctaaaataaaataataaataaataaatagaaattataagaagaaataatgtggttaaagaccaggaagtgatctgtgatccaataaatatatttggtctttgcccctagtccctgacaggcaggtcctaaaacgcttgcagtccctcagtgataagcatgattttaatatggcaatgagatgactatggggtgaggggctcctagatagtttcaggatggaggctgcttgccagaaacaccagctgtgattagaggattggaactttcactgccatccccatcctctggggaagaaaagggggctggaagttgagctcagtcatcaatggccaatgatttcaccaatcttgcctacacaatgaaacttccatagacacctctagacagtgagttttggagaacttcccagttggtgagcacatccgcatgtccacgtgctgggaggacggcacacctcatctccatagagacagaggcttctgcgcttatatctttctgtaaggcagacacccttgtttctaggagggacctagggtggactgtggattctttctctggggcaaataaaaatgtagaatcagaaaattcaggcactttgcactcctcatgggacactccagcagcactcacgtgaccatcctgagaatggacaggacacctgaggtggggaagggagcacagaacccagacaccagcctggacacaggcacctgggataatctcctattccttggaaagttccagtatctgagggaggaacagtgacttctggtcctgacctgagtggagaccgagggactcagaagagctggaatcagacccccacacacactgagtatgagtcagagaacaaggcctgagagaaaaagtcacagtgcccaagactgctgcaggggtcaaaggggactgctgatcagtgttccagggatttgctccagattaatctgagtcatggaaaaactgcctttcttttgtttctaaacaaatacctgcaaagacaaaagaccacataaatccccaggtgcacaactttttcagatttaaagaaaaaacaacccccgtctttccctccattcccaggagaagctcactctgtggcatcaagctgcctgggtgagctctcttctagaagagtccagggggacaggcaaggaatgggaggcaggaagtccagttcagggagggggattctgggatgaaaagtgaagggagagggactgagcccatgctgagggtttttctctggtttctcagacagctccggggccaagattcggggagacattgagacagagcgtttgatataaaagaagggggtaagagccaagtcccagggcccggagcttggctctctgggcttcaggccccgagggcggtgcctgggatgggccggctcagctttggggtttcccgagctccgctctctctcttccacctttcccaacctgtgtcaggtccttttacctggatactcatgatgcggcctcagttctcacttccattgggtgttgggttcctagatcagccaatcagtgtcgccgcggttcctggttctaaagtcctcgccggcccaccgggactcagattctccccagacgccaaggttgcgggtcatggagtcccgaaccctcctcctgctgttctcgggagccgtggccctgatccagacctgggcaggtgagtgcggggtcgggagggaaaaagcctctgcgggaaggagcgaggggcccgcccggaggagtaaatctgcacatatatttaattacagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatcacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctggggatcaggatctattacctgtgcctggagaggaggggactcctcttctcacccgctggtctctggacacatactgtccaattcccctgtggcagctgtaatgtgtagttcaatgggcactcatttgtccccttttaagggtaccctcctttagaatccaggaccttctaccctgcagagtgtggttttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggccagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttacacagatgctaattcgtaggggcacttggaatcacatggttgttttgtgtcccatggtcaagcattctatcttatcagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcgccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaatcactttatatccacttttgtgtgtgtgtgtgtgaggcagagtcttactctgtcacccaggctggattacaggtgcacaccaccatgcctggctaatgttttgtttttggttttggttttgtttttgttttgtttttggacagagtttcactctttttgcccaggctggagtgcgatggcatgatctcagctcaccgcaatgtccgcctcccaggttcaagttattctccttcctcagtctcccaagtagctgagattagaggcatgtgccaccacgcccggctaatttggtatttttagtagagagaggttttctccatgttggtcaggctggtctcgaactcccagcctcaggtgatccgccctcctctgcctcccaaagtgctgggattacaggcatgagccaccacacccgggctatatccacttctaattggaatggaagggaatgcactcaccacatccacagctgcacactgtgtgcctgaggccttattaatctgctctaccagatatatccagccagcatgctagctgcaatcaggactcctacttggtcacatctggagtaatcccattcattccttagtaatcccattcattccttaggctccatcaggcttatttgctaaattacatggagataataggcaaccccaacaccaccccacatcctccagctctctaatggtggtgctacccccacagcacttgcagtgccttccacaagattcaccctgggacatacgatcatttttgatttggccagaatggaggcagtttcagaggtttccctttggccttcagcacaatgagagcccttactccacagactagggatgcagtgtgggggtgactccagctgccagggcatcagtgtcaattatgcactaggagaatggggagataaccagggctgggtctgtggactcagtgaccccatggtgagccgtgatgtgtccaggtttatttcgtggtctccgtaatccccaatgtgagggggtcatgatgatgctgtgggcctctgggcatcaatgtcatctcacacccaaagtcagtactcccccaagttctccctatttccctttcccagggtacagtctctaaagtaaatggctgtaggtccctttgcacaatggctcagggaattgacccagcatacacttgccacagggttgcagggtccttcctcctaggaatatggacacctcctccgtcactgggttctgaatctgaagcttggctgagatctaggcactgagaatggatcatgattttgtattggttcaaacaccctcagcctcctgctcctcaattcttgctttcttatcatagataccaagcagtgctcttgctggctgcccttctgttctgaccctggaacaccaccctctattaaccttacccacaactgcaggcaggtcaagccccctcggctgctcctctggggttgccatggtaaccgtgtcctctggcttttgcaggtcactgccaccacttgttctctatctcttcagggccacaccctctccgtggatattaatgagcccaactctgggacatcttttcctaccatcaccctcagccttcagagaacaatacaatgaaacttcttagtgatgcaggtccctgttgccagcacgttcctgaggctctggtggaaggtgggccccctgggtcctcttataaagcacggttccggtgggctttccggcctcacgtaatgtctccatcccacaggccaaattcccccagcctcattattccctcttctacatgttccggggcaactaagtcaggtctagcttgtgagataccggcatcattttttcccagtctacatggatcaccccagcagtgggtttgccccatgccctggggtctttgaaaaacccatgtgatacggttggctgtgtccccaaccaaatctcgtcttgaatttccacgtgttgtgggagggaccaggagggaagcaattaaatcatgggggcaggtctttcccatgctgttctcatgatagtgaataagtctcatgagatctgatggttttaaaaggagaaatccctttcgcttggttctcattcttctcttatctgctgccacgtgagacatggctttcaccttctgccgtgattctgaggcctccctagccacatggaactgtgagtccattaaacctcttttggtaaattgcccattctggggtatgtctttatcagcaacatgaaatggactaatacatcatgccttgagaaagtgttcccaagtcaaaggatttttatctatctagcttgaaattctgtccctttgatcaaatgccctcaaattccaatcccagaagtgttccccaggatcctatgtggacatgccagctagttcctgcaaagctcctgagtggaattcccgctgcattataagggtgaggcttctgcagcatcttccagcgtaggaagtgggaactattactggaaaaggcgagccttctctgcatgcccagagggtactggagggcacccatctgataatgctgtcctagtttgcagaatctcatgtttccccaccagggccctgattttccacaacaggcctgccttggctgaatgtcaaacatctctggaggtctgtaaccctcacaatgatatcttcagctaccattccacactatctaccctttcgctacaggaaacaagggcctctccatgagacactgcagaggccctcacacatagccagtgacagctgttagaatccctcagattctcattctccttttatagggcatcaacacagctgagcagtaaccagccagcttccctgttgtaggttttccctcccaccctgtcattattgtgtagaggcttctatcacaccacctgccatagcacccggtaaccagggcatcttctcaggtcggtgctggggatatccacagcagctcagctgcaccttgtgccatggactttctctgtccccaaccaacgtggatggcattcttggcctgccaggcagtgggcaagctcaggcccaatccccgtttttgtctgtgtctatggaccactcctgaagccacttgtgttggttagcatcccctgaggagcagactgcaatacagaattaaatgtgccaggatttattaggggaaatagccatgaaagaaattggggagcaagacagaaaagactgggaaagccataagactgtgatgcaagtggcttttttatttttattttttgagcaatctcagctcactgcaacctccacctcccaggtgcaagtgattctcatgcctcagcctcccaagtagctgggattacacgcatgcaccaccaaacctggcaaatttttgtctttgtagtagaggcgggttttcaccatgttagctaggccggtctcaaactcctgacctcatgtgatctgcccaccttggcctcccaaagtgctgggattacaggcgtgagccactgtgcccaaccagactgcaatgcaagtttaaaccccagtgaaggagagagggaaggaagtttggctgaaagtatcctagacccagtgcaggttaagagaagttcagtaatggtgagccctggagcctcagtgggcctttaaaggagagacaatcctgtctttgtttctcctgttctctcaattattgaatcgaagaagccaatggcaagtatggtctgagagcaaacgtagcaatagatttcaggcggcaacagctggagcatcatcagctgtgcttcctctagctgaggggctgggatgtgcattctcaagactgccacaacaatccagtggggagaaaggacaaagggtaatgatcaaagagaaaaaaaggtatgaactgatgaactgatacctttaagtagatgagaaggatgatgtttgggacaccagtagagggactgcctctggctgggagcgggaaggttaacccacaacaaccatccatgtggtagaagacccagcatgcagtgcagctgcaaatgcatgagcagatggaatctgtgaaattgtcttctagtgtgttcagttttctcagtgaagtaggaagcaaggtcatcagctgaagtaagaatgcagatagaaggttggatgtgtgagcagagagaaggtgtgtgagagtcacccagaccagtaggaggctgagggtgagccatgcttggagagggtgattgctggtcgtggtggggggtccccatgaggtttgggtcatgaagttagagagagaagtcagcatgctgtgtgctgctttccagcctccttcagctcatgggggcaggtgcagcgtaggcagaggtggattccaccagctgtgtagttttgccaaacaagtatggcaacgcaagggaggggcaagggagggatggaaattatttacaatagaattcaaaatggctgaagagggaggagaggacatcaagggtgagggacagtgagtagatggcaggatcactggattgggaatcccagagtgggtggaaggattgttggaattgatgtactacagggcagactccaagcctggaaagcaggcacataggcaatgagtggttcactgatattacgtcacagcatatgataaaatgatagtataagtatcctcagagcctgtggcctccgtgcaaggggatgagtggaaagatggtcagagaatgggaagtgtgagatagagagtatggaagggctggggttcttggccatgatgagacctaggactctttaggggagaacaacaacaaagcaacaggatcctggtgtcagggacagaccatggccatggcgggatgatagcagctctcctacaaaataatgcttatatgacaagggcatgagattcaggcagagggaggagaaggtcatggaggagaggagtcccagcatctgagaagccagagggcgatgcatcctctctgctctatgggtgtttattgctgccataaaaattaacacaaaacaagtggctttaaacagcatctctttatcatgtcacagtcatgtgtgttacaacttcaacagtctcatggggctaaaatcaaggtaaggggaggtctgtgttccttctgactctgaggaaaaatctactgtcaagctcattcaggttcttgtctgaattcacttccttgcagataggactgagatccccacttccttgctggctcctgtccaggggccacccttagctcctagagccctctctcagttcctcacacatatcccatgcaacatatccaatcctcctgcttggaacctctgacctcccccttctgcggtgtctcctctgccttcctcctctgcagcatctgactccagccagagcagcttctctgcttttaatggcttgtgagatttgatcgggcccacacagatagtccaaaataatcttgcaattttaaggtccttaatcttcatcacatcagtattttcccttttgccatgtaatgcaacctactcgtgggtgcccaggattgagattggacgtctttgggaaccattactcggcccatcacatctgagtatgttgaagtcaccgaggatcaaggagacagcactgctggagagggcgatagtgaaccaggaactacaagagtcaggactgagaggaacggcctggggcccacagggaatggctgcaatgaggggagtggggcctgaatctgatgacagctttgggggcttaggaaggaaggaggcagaaaggtctgagaaccacagtgaggagtgaggatgccaccccacctctgggccaagggtacaaggtccctgtgcaaactcccccatgtgggaggactttggaagggaccacatcctctggcagacacagacatcgctggagctgtgaggtccaggaacatcctgagacaggatgtggaggttttgctgatcatgggctgagaattccaaggggcacagcgggaagacttctggatttgggaatggggtatggggagacaaaataggggtgtgcagagccttgtggggatgtgaatgcagggtgtttgggggacccagtgtgactgacacaaacagggaaaaggcatgatgagctcagtcctggtggactcaaggcagatgatggtgctgaggctgtgggagacgagggaggaggctcaggggtggctttcacctgggctctgtccatggaggtgaggacagggagatagttgggcctcagtgctgtgtggaccctttcttgtctccctgatgactggatggagggcctggaggaagaggggtcttagaggattcactcatgtccctgggggagggggactcactccaggtctcaggtctgcactgacacatttgtttgtggcttggggctgcctgctataaactattgggggttcgtccattttggagttataacctaaggcagaaactcagatggttcaaatgtcctcttcatgaagcaatgttatcagcgtatcatttagattgtcttgcaagagtctcatttgttgtttttctaaatgcctgccaatattgtttgaaaatctacaaatgtgataaatgtatcttcaaagttaactggttgcaggttgtttaaccttatatgtacagtttcacatatgtataaaaacagtagtttgggcctcttatattctaatgattaagactttaagctgtgtacacattgcaatgcaagtatgcgtcatgcataaccctagcactaagagtcaagagggaaagtacctctcccctaacattttacaaagtttctgtgttctttttccactgagtgggaacaagtcagctagtgaggaacatgaggcctttggcctcatctaaagttactttagctaccaattgtgagaagcactgaccaccgggaaggcctccctgcctggttcctggacctctataccatggcagaggccatcttccctcctagtgcagagtgatgtcccaggtagtgacctggttagccattgtccactctcgggcagttttgccttctaagacattggtttttctctgaggacctccctgttttcagatgatcaaaactggggccatccactcccttctgaaccacctctgcccagtggcctgtggctgtgccctcagtcacaacaggacaccccttcagaacacgctgcaggaagccgacatctctacacaggctcacacatgcacagtgtgtgcacggagctttggttctagttcaggaagaatgggaggaggctcactagtccaacagagcttgagccctgtaccagtgtcatattccaggagccagagttacaagggatacaaagtgcccagacctaccagagaaggcaaacccctacagcatgcagggctagacaggggcaagaaacaaggtcattctgggccagcaagaagagggaaagggaaattacagtcatacttcagatatatgcaggtttggctccagaccatggcaacaaagcaagtcacacaaatttttcagtttcccagtgcatataaaagttatatttacacttgactgtagtctcttaagtgtacaatagcattatgtacaaaatgaactatgtacataccttaatgtaaaactactttattgctaaaaaatgctaacaatcacctgaggcttcagctaatcctaaccttcttgctgtggagggtcttgcctcaatgttaataattgctgactgatcagaagggtggttgctgaaatcgctgtggcaatttcttaaaataacacaacgaagtttgcagcaagattattctcctcacttggacacttagaggccattgtagggttactaatcggcctgccttcaatatttttgtgtctcacagaatagggaaggccgggagagagagagagagtcaagaaaccagccagttggtggagaagtcacaacatacacaacatttatcaataaggttcaccattttataagggtgtgggtcatggtgtcccaaaacagttacgagagtaacttcaaagatcactgaccacaggtcaccatacaggtgtaataatgaacaaggttgaaatacttcaagaattaccaaaatgtgacacagagacatgaagtgagcacatgctgttggaaaaatggtgccaaatagacctgcttgacacagggttgccacaaacattcggtctataaataaaaaagcaagaaaaaagaaagaaagatggaaagaaagaaaaagcaaaggaaaaaatgcagtgtcagcaaacagtaataaaggaaagcacagtggaaggtgcacctgcaaaggggaaatcagcactgaagcaaagtcaggaaaagctttcaagtcagatgggcctggacctgggcatgaaccctccaggtcctcccaccagccagctgaagaggcctgagcacatctgacccagagctggccccgacagacacttgcccagtgagtgagtgctgaatgaaaccatctgagccagtttcctcatctgcaaaccagtgacataattcctgccttgcagagtttcagaagaataagtgagaaaagacacagtgccaagagaaacagacacaagacctgtggcgggctggacaccagggctctaaagcaagttctgcctaaactggcaagaacatttttcaggtcaggaacaggagttgttctggattctgtctggggtcaggctgggagggagctgggggtggcagagtaggatgggggcaagggctgtggcagggcctggcactgaagtgaggccaaagcctggagagagtggctcctggtggcttttgggcagctcacgcaactccctgcctcacccactgtgtgagtcagcgttctctagaggagcagaactaataggatgtatgtacatatgtaagggagtttattaaggagaattgactcacacgatcacaaggtgaagtcccacgacagaccgtctgcaagttgaggtgcaagaaagccagtgatggatcagtccaagtcccaaaacctcaaaagtagggaagctgacagtgcagccttcagtctgtggccaaaggtgtttggctgcagattccaggacaggaccttcttgtcctctgcagtgaccccccacctcgcctgactatatctgtccaacttgatggtgccaccgagggttctgatgcagggaaggagctgtgtgctctgtgtgggaggatgccttctgcctttctagctgggcctcaggtcagggctttgagcctgagcagggagaggagatggaagggagatggccttggagcaaacgtctgcccctgccagtgcatcccgtaggtatcatcccatccaccagtgccttggcaggaccccactcactcaaccctccccctggtggtagtccctggtggtgcctcctcaggacctcctgcctccagccgcacaaatccccaagaatggcacgtgggtacaagggtgttgggaagtgtcatcctccagtgctgacttgagtgtgtgtgtgtggctgcacacgtgtgtgcatgtgtgcacaagtgggaattggagtgtgtgtacacgtgtgtaagtgtgagtgtgagagtggagcatgaatgtgcaggtgcccacaggcagcagttggggtgccagtgtcctcactcctgcctgctttcctttctctccaaaacgtgaccacacagcaacttagtgactatctagatttaagtctatcaaacagaagggaaacacaactaggattcctgtagtgtagggaagggaaatgcctagcccagctctctgattccccttttaatgggtttgagctgcaatatgggtgcagaagagcctcccacagcgccactggtggtggaggaaatagcccctctcattggcccattttcacgctgctgataaagacatactgggaagaaaaagaggtttaattggacttacaattccacatggctgaggaggcctcagaatcatggcggcaggtgaaaggcacttcttacatggcagtggcaagagaaaatgaggaggaagcaaaagcggaaacccctgataaacccattagatctcgtgagactatcacaagaataccatgggaaaaactggccccagtgattcagttacctccccctgggtccctcccacaacatgtgggaattctgggagataccattcaagttgagattcgaatggggacacagccaaaccgtatcactggatgagagcaattagattgatgtcatgatgtatatgggtccatgggaacttgaaaaagtcttccccttccacctagtttaacaagataaacaggaaaggaacttcccttaagggaagatattgactctatccctgaaattaaatcacaagaaaataagaaatgcatgagatctaaactaagccatttgggtaaactgtctcagaatttaaagcatcagcagtcacaagctatcagtatcagtgacgattctttcactccatggtctagtccaacgagactggtcagggcttgccgcctgctcctcggtgctgtcctggtactttgaaagtatctgtgattctgtgaactgcaccgccagctgcccaacaacttccctttgctgatctgagccagactctgcttttatggcttacacccaaataattcaagttattttaaaaaaataataataaatcaagttattcatttatgagttatacagtcccatgtggggaaagggaaggagagtgaggtaatactcaattttactacctgctatgcatttataagtgagatacttctttttaaagtcatatttttggattagaacaaactctggtatatttaagtaaattccctgaagaatgtgaacaccgtaagcaggtgagtgcattattctctgcttcccctccacagagctgtggttcactctcctccatcctgccccctgcactgggggcaccacagagacagcacggcctgtgctcctgcaccacctgcttctgcttgggtgtggatgataacaggcacctgcaggagatgggagcgtggggggagaagtaactcagggttttcacttccctcactccctttggacagctctgcggttctgtaatcattgccgtcctctacctacagccacaggcctgcagggctgcccctagtgaaagctacagatttccgtgagttctggaaactgctccctcttccttgttctttcaactcagagatggaaacagtttcctgccactgatcatcccagggagcttcagcaccccttgtggctttcttaggcctgccagcacctctgtaatgtgtgtcttctttctttgtcatctctttcctgccaggaccctgactgtcccacagaagaagtgacaagaatttatttatgacatgacaataacacatgtattcatggtgttaattcgatttgtttcatagagacagggtcttgctatgttgcccaggctggtcttccactcctggcctcaagcaatccccctgacttggacttccaaagtgctagcattacaggtgtgagccattgtgcccagcccttaacttgaaaatctgacagtataataaaagaaaaaaatagaagtattctggaaatggaagaggaaagaaggctaaggtggaaatcatcaatctgtgtcatctgagaagccccacgtgcagaggctgtcccgggactttaggggagaacaaaaacaaagcacccaggatcctggtgtcagggacagagcatggccacggcgggatggtagtggctctcctatgaaataatgctcataaacatcccttgtgagaaggatcagatcaacatataaaaatatgccaaataaagtgaaactcaaggcaggagtgggactggccattctcagcccgtgacctccatggacttggagaaaggctcagcctggagatgtgtgaggcctccgacctggagcagcacccgcccctaaagaccaggcacaaatcccagcacatggagggatccagacaaatacacaagagatgaccacagcaggagctttactgggcacagagcgaggccacacaccactcagctcctgcccctccacctgcccttctctccccacctgcccctgccccagcacagcagatcctcagaatccaaaaagagaacctaacttccatgttttattaatggcttataatattttatcacatcttcagaaaacactatgcagaagataactgtagagcaagacatctatttagggtgagtgagtcacagtggagatctgggagggagaccctgtaaccctttcattccaagaaaagaaaggtcgatccaaagaaggggaccccaggcctggatattgggattacatgaaaggggttctggggcatcaggggaatgggtccctctccctacatcctcccggggctgtgcttgggaggacagcagctgggggaagaaaagtcagggtccacagagatataagggggctgagaactatctgtgtcttgctggtctgcacaaggcagctctcaaactgtggagaacatggtaatgaccagattcagctcagccactctcagcctttacacctagagcattatgggcagcccatcaccatcccctaccttcaaatccaaagatcgctacagcccaaagctgctccctggcctcaactcctgttggtatcaggccccaaggaagctgtgagcacgtctgcctgggaccctgtcaccatctggagaatgacaataaagaggacccagcagcctgcaggaggagactgtatttgaggcaggaccatgggatgggtgaggcacaggactgtggctccatcctctctatttgaggagttagagatgagctgcctctgccaccccttccatggtgatatttctagagtacacccctgtgctgaaattcttatgaggaaagagacctgatgagatgctatggtgaagaggggccataagggtcttgaataccaagttaattttgctaccagctgagattaggaagtgaagcccaggacccaggagaggaggaggaggagataacacaggaccctgtgatcactctcctggccatctgtgtacagtgagatgcttcccttcggggttgggagcacccagtgtcatggtcctgagtgttgctaccctgctgttctcatctgtgaatgcagccagaccactttcttcctctgatataaataacttggaggatctgtcaccagacacctcatatctacatattaataaattctgtacagtggtttggcttaatgttttatatgttataagaaataagcaaaacatagggatgatatttttagtaaaggtatttcagggtatatgagaatcagattcctagggccctgggtacctcatcttgctgtttaaagtcctcatggaggatcagtggagtgcagagcccagaaatcatcctgaaggctgaagctccctggtgaaaaggaccctctcctgcaccctggggctcagagggaacaacaaagctccctcccagggtctccagcctctggcctatactgtcagcctgcactttcttggccttcctggctgctaatattccagttcccagcagcctcctctctcacccttcacctcttctgactgggtgcgaatggtaactagaccaggcagtgccctccttgtcagtctgcctgtctgcctggttccctctcagagtttgtgtcttcactcggttcatcatccccagccccagcaggaacagggagaagtgacttggcaaatgccccactcaaaatgggatccctcaaccagagaccacttgtgaaagtcagttttccctgactaaagaaacaggacatttaccctgttagaagttgatgtctgccagagacctccacctgggaaatgctggttcatggcagggtctctcttttagtaaagggaaaaattcctggctaattgatagctaataagtcatttagaatccagttcatgtaaaaggattacctacttaaaggattaactccattataataaggacacacatcccacaccgcacatccaatgtcatttgtgagattgctttgattcgctcatgtagaatgttactctgctgctttgcagagaggcttgccacacatttcaaatctctgctcctcatttcacaccatctggctcatgaggtgaaggtgatgagaagtgtcttcagacaatactccgaggtttgtctatcagagtcatagtcatatattacatatagagattattttcttagaagttgtaatttattgatatgtattttactcatggcatagatagatactatccaacaattcgtttttattacctctacattacactgcttaggtagccactactggtacctctgcattttctttcttgtatgtgacattaacgtataagattgtatgtacatggtggcttggtttccaggaattgctgattaggtaatttagaccattccttccactgagtacaatgggaaaaggaggaaaacatacatatttgaaaaatctggttgagcaaatggatgggctaacaaagcagtgaagatttgcctggccaggaaccaggagaggggagaaatccagaagagcaacttgagctgtggggctgcttttgtggatcagaggcagtaacacctgctccctggccagaagccaacttccaggattcaggactcagaattcagaacttagacagtcccttggtctctctagaattcagtgctcatttagaccgggctaagaccctcacactcaatggctggaggatccaagcttatggcatgactgcctctggagcatttcatgctagagagatcccaacaggtgtaggtaaatggtctagagggtactagccaggcttccatggaactctgtgtaaggcacttccctgtgttgttactcatgttggccatgtcctcgggaatttagtggaacggccatgtcgtcttgagtggaagtgaggacggtgagggggtccctgggcagtcagagattttgtgtccctgcgtcctttccttccatctcaaccagagaccacttgtgaaagcccaagaacaaatgtcattaaatgtccgaggcgaatccaagaccaccgatccattgcgcccaggagccttgggccatgtagcccagcagtagtgaggtctgtgaggccttggtcacccccaaagtgttgccccaagaggagctgccgctcgttgccatcaggcacctcaggagctggacatggtattcattataatttctgatgaggaactagagaggtctcatagcatatagaccttgatcaaattgggtcatggtggagtcaggcaaaactctgcaatgactcacaggtacctaagtataaaacaaagtctcaactcagagcatccatcagagcttcaggctcagtagtcattcctttatgctgttgctgtgtttgtactgtgataactggtgcttgaagggaggacatatagttacatgttgcgggaaaacacatgtcattagaaaacttggcatgatttagggaccattgccttttccatggtagatgtgggactctctgtcatcttcaccttgttgttccaagtgcagaagagaaagcttcttcctgctttcagctgcgtgactgacaagggaagctggaattcagagaatcagtggcagcctctgtctctccaggccccaaccctgcaggtttaaggaatggacttaggtctctggcactttgttctcaacacacattttccttcactcattcagaaaaaaaaaaataataatagaaaatgaaccaaaggctgcaattctcatggcacctagagaactggagtacggaccaaggttgccacatgcctgtcattgctccaccacactcggttgccatgtgacctcgggagaagctctctaccactagggacttttaaactcatctgtgaatcctggataaacacagacattccggtaaccttactgaaatgaagtgaggaccaatgagttgacaggtggagaaaaattttttttttttttttttttgagacggagtcttgctctgtcacccaggctggagtgcagtggagcgatttcggctcactgaaagctccacctcctgggttcatgccattctcctgcctcagcctaccgagtagctgggactacaggcgctcaccaccacactcggctaattttttgtatttttagtggagacggggtttcaccatgttagccaggatggtctcgatctcctgacctcgtgatccgcccgccttggcctcccaaagtgctgggattacaagcgtgagcctccgcgcccggccgcagaaacagaaaaatttaagtgatggcctttactcctagacagggcttttttaggaacatgcaccttaaaagtaggaggaaaacataatgccagcaacaccctgcctaaaagcccctttagtgatgataattatcattcatctttctataaaagtacagcaagactttctacctcaatatctcaaatcagttaaatatatcttctgatcatataccagtgtggacccacatgttttgctccaagtgaaaatgaaaaggaatgagaacatctccacctttgtgtggtgaccatgggaccacggaggcttggaagccagcctacatctgcccaaactctacatcacctgccattgtcaattttcaatctatccgttctatgctttggaatcctacataattcatactcttgaaaaatctcattttcatatgtagggcagggtagaaaaggtgatatctctgttttaatttgctaagacttccataataaagtggcacagactgggtaagttaaacagtagaaatgtattatctcccagttctggaggctacaggtccacgatggaatgtattgcagggctgattgctcctgaggcctgtctctggcttacagatggccatcttctccctctatcttgtcaacattggcctcaaaatatgtgtacagggacacagtttagcccataagagtctgcgccatccttggcggtgcatattataagaaataaaagagaatacaaccctttggctggactctgttgatattttgaaatgttggtcttgcaataagaacaccaccaaaggccaggcgcagtggctcacgcctgtaatcccagcactttaggaggccgaggcgggcggatcacgaggtcaggagatcgagactaccctggctaacacggtgaaaccccttctctactaaaaatacaaaaagaaaaattagccgggcgtggtggtggatgcctgtagtcccagctgctcgggaggctgaggcgggagaatggtgtgaacccaggaggcagagcttgcagtgagccaagatctcgccactgcactccagcctgggcgacagaccaagactccatctcaaaaaaaaaaaaaaaaaaagaacactaccaaaacaagggagccgaagtttagttttccctggaaggtgagcactccctgagcctggccgccccagggcagcaagacccagtgctatgtagttctccaaagtcctatttactttagtgattctgattctgtatttttaactgggaaaaggattctctttcaggaaagcaaccacttctgatgctatttaggtattattctccttatacttataggagaaaaaattgatgttaatgaacaggaaatatttgccaaattatcacacaaataatttttgtatcattttaaaatactccttattgtactgagcttgttggtattttaataaaaattattggcatataatatttatacatactttggggtacacataatattttcatgcatgtgtagaatgtgaaatgatcgagtcaggatatttaggatactcatcacctcaagcatttatcagttatttgtgttgggtgaatttcaaatccactcttatagctattgtgaaatacacaatacattgttgttaactacagccagcctgctgtgctatcgaatattagaatttattcctcctatttaactgtatctttgtacccattaagctacctcattttatctcccagatcccccacacacccttcccagcttctggtaactattattctactctccacctccataagatcaactttttttcagttctcacatgtgagtgagaacatgtgatatttgtctttctttgcctggtctatttcacttaacatactgacctccagttccatccatgttgctgctagttattatgaggtagttctagctggaagaatagagaattaaaagaaatctttgtgaagcccctacccaggtttgtcaatttgtaacattttaatattattggctatatgtagtatacatagaaaataatagaaatatatgcagatagccctgattctccacagttctgttatgtatgtgtttccgctgaaacacatacagtacagtactctatgtactgtacagtactactgtactgagtactggactgccagtggggagtggcggatgtcttgaatttggtgaatgcctttatattgctacaaagtgttttttttttttggttgtttgttttgagacggagtctcgctctgtcgtccaggctggagtgcagtggcgggatctcggctcactgcaagctccgcctcccgggttcacgccattctcctgcctcagcctcccaagtagctgggactacaggagcccaccaccacgaccggctaatttttttgtatttttagtacagacggggtttcactgtgttagccagggtggtctcggtctcctgaccttgtgatccgcccgcctcagcctcccaatgtgctggcgtgagccaccgcgcccggcctacaaagttttttaaatcctttcgtttgacatgattttagactttgtaaaaattgttttttgttgaatgtatcattctgtggcttgctttatcgtttaatatggtctatgaggtgaacccacacacccatagaaacagttcatttgttttcagtgctggatagcatttatgagacgaatatcccacaatttatctcttctcctgtccgcgacctttagcttgtttctgttacagacactgccacaatgaacatcctgggtcatctctctctggtcccctgtgtgagttccccaagatacggatgtaggaatgggattactgtgcttttaccatgtgatgttataggatgtcaaattgttctctgaagaggttgtatcaactcccccctttaaaatcttctttgacattttacaggtcaagttatcttcctccccaactagctgctcagcctcagtcccccttcattggctccttttgctgtagatgctggagcactgtggggttttactgcctcccaatcactctagtgtcctccactcccaggattttaaatatcgtctagacacagatggctcccaaatgtatatctctacatatttctataatcaaaaaactaatggtaccaaaacaggtactctgatatattgcagatgggcctgcaaactggaaatgttttcaggaaaggcagtatggcaatttctgtctaaattaaaaatgcatacacccagtagtcccacttctagaaatgtgtccaaaaatagacctgcattcctgaaaaatgactgtattcagaattatatgatgcaaccctgtttgtaaaatcaaaaaggaaagaagaaagaaaatgaaagataaaagaaaaaataatccaaatgtctgtcactagcggactagttaaaaaagcattgcaagctgggcacagtagcattcacctgtgaatacactctactccactctgggtaacatgaggaggcctccctaccttcctaagaaaacccaaacaagcactgcatatctacacggctgagtctacaaacatttaacacaaaagaagaaagacataggaaactcttgatattccctcatgggatggtctccatgatacattgttaagaagaaataaagcaaggtgtagaataacatatagagtctgctaaaatttgtgtgaaaagggacaaagagatatatatacacatttatatttgcttgcatatgcataaaatatatttggaagaataagcaagaagatatccctggttgcctgttggggatgagacaaggtaagaaagagacattttaccttttgaatattttgaattttgaattttgaactatatcaagaaataaaagataattcctagggcaaccaaacaaaccccaaaaaaattcaaaatgaaaaaccttttaaaaactaatagaatttttttacctttattaaaataaattttaaaaattttctaaatattatattattcctttaacaaggaggtttactgccattttaattcagtacgttgttttctttttaatcgcatgatctttctttacatctatcttttttccattacaaggtaaaataacagcatgattaattaaatgcaatttgtttggtgaaggaaattttgttcaaatcttggtctaagtgggaaagggattctaggggatccagtgcagcagttatgggtttcagtatgctcacgacgccctccagtgtttgtgtgggctcatggatgccatatctagaaaacactggaattctcaagcacacgtgactgaagccatttgccaaatgttcaaggtcctattaatggcccatctgagtacttgtcatacgcggtcaccctatctttggatcagaaggtacactcagagctcctagtgtcacatcccaggcccaacctgctgagattagtcgaggaaggtctggaggtcagtgtcgtgaggggtgggaagactgagggtgtgggggccagttgtggagtggcgggagccccaggtgctgtatgaagccgagcctctggatcaccctgtgaccccacatttggtcccttcctgggtgtcttccattcccaggactcccaggaaataaaatgctgcaagattggggtggggagctgtccagggtaggtcaggtgtgttctcactgatcccacacctctgcctcccagcccactcccagccctcttctgatattagaaaccaacacagattgccttagggtggtggttctcaaagtgtggtcctgggggaagcagcattggcatcacctgggaacttagatatgcaatcttcagggcctggcctggacctactgtatcagaaactctgcatttaacaagcccccagcagaattctgcttttcaaatcagatctctctctctctctctctctctctctctctgtttcaagtctcaatattgagtagctgtgacttctggatagtcaggtgtcagacaccctttcttgccaggaggcaccaggctcctcaatcagcttagtctcattcttggcctggcccagggaaagatgttcacttcctggattctgagcaaagctctcctatcctgggtgcctgtggggctcccacttacaccacaaaacaaagctcaaataatatttttttcttttatgagatttttggtattccttcattagtcagagctgaagatctacatatatgtctaccaagcaagtgtgcatgtcccactagccagtttgttagtcttgccaatgcaccacaacgtagcagcctctcagtctctccttgtgaggtgttacctggagttctttgtctcaccaccaagagaattaaggagcgtggatacaaagggtgaggttggagcaaaagtttaataagcaaaagaagaaagctctcccctgcagagaggggacttggaagatggttgccatttttacagctgaatgcaaaggcttttacaagaaactgatgagggctgggtgtctcatttgcataaggcacgaatttccggtagctccaccccatcctcctagtgcccatgcaggcccttagcttgagttactccatattgctttgtttccctgactgcccacgtatcgggggacagaattttccattgcgggcatgtctgggcaagtctcctgtgcagcctttcttatttgtgcagctgtgggcatgtcttaggcaagcccccctgtgcaagttcccttctctgtgcctgcaggccgttcttttgtttgaaataattcaactgaggacccaccataactgcccgcctgaccagtttcttccttttttctctctcaatttgtgttatgatttccttactgatctctgcctgagcaagactgggcacgccttgagggcaaggagggtttatttgctcttacctcagttccagctcctcttaaaacaatgccccacgcacagtaggtatttgataaatgtttaccaaatgaagggattgcctggaatggcttggcagacaggaaagcagaatgaaaacccacaggccaaaaatggctgggaaaagattttccaaatcctagtgctgggcacagggcccactgaaattcactttcggaaacttcccatctgtctcgttctcctctcatcaggatagagcccacctagtcacacactacctttcaggaccaccttccagatcagccaggtacaaatcccacagacttcctgcctgtggctccaaatgctcagctgaaattctgaggctaatttcagtggagttagaggcttatcccttaggagtggcaatggctggctttaagattcgagaagtagtgtttacatctcaaaagagaagaccgctccaccagaaatgcagagtttttgtatgtgcgggtccggggtcttcaggagataaagaatgatagctccaggagcgctgggacccccgtgcagccaccagtcaccacagcctaggcaggggttgggctctcacctcggcccctcctctgcacgtcctggatgtggatggtccccgagtgtgaactagcctgggctctgaccctgggtgctcttcccgccgttgtggagcctctgcgggtgtggtgcatgcacagggggcttcacaggagacccggggccctttagagtctcaaggccaacattcttggagaatccatgtcaagcattcaggctctcagggactcagatgcccaaactatgaaaatgagggaatctatcccactctctcaggtgtggtgagattcctattatatgactatcggtcatctatacatggattgtactctcagagttgcctttatcagtcggccaatgcctaaaacccaaagataggtcaggcatggtggaggacgagttcctttcttaccttctgaaggtgccatcaacaggaatttctaccctgtggagtctagaggagactttccttgaagctgagttgggaatggacatttggacttttttttttaagagttagtaactccgtggagaaccacacatttatttgcttactttaattctacagcaacattcgaggtggcttactgcaacaaacccagtgtaataaatacatacgaattactttaaaataacaccaaggaaaatatacattttaaaagattaaggctggggtaaagctggaacattactaggcgggaaggaacatctgaaacatttgctgaaatggagttgaccctttacctggccatagatttgttgcctcacgatttcattacatctgagcaccagggaggggggtggcagttcaggtcaccagtcccttgtttcctgcttcaggaacagtgtcctgttctacacttacagtcaaagcaaattacatcgttgtaagatgtttaatgatgaagtcaaagtccacagagtcagcaagtaagtgtaaaaacctcaggagtccaaggacagtctacgtttctccccagaaatggcctcactatgcactgttgaagggagagggtcctttcaaggggccccaagatgcaggagcaattgggctgcagctctaaataaagatgtcctttctacctgcagattccacaaaacctcacaggcaaatttggtgatctcacctgagctaggaattcggttttttgatgttggttctctttgagccattgtgtgagctttaaaatgtgatgtggagattttgctatactggtatttccttgctggaatttgacatccacagtggctctggcttccctgtctggtcccaggaggaaatggagtgtcctgcactttttttcagcatcgctttgtgtaagaaggatcaggagacctggagtcaggggctcctccaatctcactctccttcataaaacagtgtcccttaagctttctgggggtgagggccttaacaccgtgctgttctgatgaatataattgtcccagctcccgaaacaaaagcacaggtgcacaaaataccgactgttgcaagcaatgccaaggtggggatgtttcctaggtgccaggtttagcactttgactttgtatatacacacacaggggccaggcgttgtggtttatgcccgtaatctcagcactttgggaggctgaggcatgagaattgcttgaagccagaagttcaagaccagcatgggtaacaaagcaagacccagtctctaccaaaaaaaaaaagaaaagaaaagaaaagaaaaaaatacacacacacacacacacacacacacacatactgggtgtggtggctccagtctgtagtcccagctactcgagaagctgaggtgggaggattgcctgaatccaggagttggagcctgcaatgagctgtgatcgggacactgctctagcttgaccatcagagtgagaccctgtctcaaaaacaaacaaacaaaacaaaacaaaatacatacacacacacagccagagccagcactgagggagaggctggcctcaggggtggggtcacaggcatttctcaggtccctctcagtggtctttgtctctttttcctggaggtggaggagtctgtacttcatgaggagaagtcctctgaagaaggcgggagatactcaggagcggggtccggagagggaaaaggatgaggaagtggagacaaagtggagggggcagggcaagaagggcacatgtgaggaatggggagggggaggaccttccagctgtcagaaaggtcccacgcagaatttggctcttggtttttctgctttatcaggatggatttgggaaaccagccggagcgggagataaggagtctactttgcaaaggacacgtgtgagtctcgtcctaatttgaactcatgagtagcagctgacagccaggacccttgcgtggggcgcgtgacgcccctttgcaaccagggcgttttctgcaccccaccagccatccctcctgggaccacgctggtcctctccaaccctaacagggagagaaggaaggagaggtctggaggctttgggtcctccctcgtgctccttcttcctctgccatttattccctgagtgtccttgactttcctccgctacccggaccccactacagcaaagcacatcctgcacactggcctggactccctttgtaaccacccagtgtgttcaccttgctgactgcctagacaaagccgatttatcaaggcaggggaattacaatagagaaagagtaattcatgcagagccggccgtgcgggagaccagagttttattactcaaatcagtctccccgaaaactctgatcagtttttaaggataatttggtggatggggggggccagtgaatcaggagtgctgattggttggctccggtatgaaatcatagtgagtggaggctgttctcttaggctgagtcagttcctgagtggggggccacaggactggttggcaggtccagatggggtcctccagttgttagaaatgcaaaaacctggcctggcgtggtggctcacgcctgtaatcccagcactttgggagcccgaggcgggcggatcacgaggtcaggagatcgagaccatccttgctaacacggtgaaacccggtctctactaaaaatacaaaaaattagccgggtgtggtggcgggagcctgtagtcccagctactcagtaggctgaggaaggagaatggcgtgaacccgggaggcggagcttgcagtgaaccgagatcgcgccactgcactccagcctgggcgacagagcgagactccgtcaaaaaaaaaaaaaaaaaaaaaagcaagaaaagaaagaaagaaaaagaaaaaagaaatgcaaaatacatctcaaaaggccgctctgaggttcacaatagtgatgttaccttcaagagtaactggggaagttgcaaatcttatgacctccggaataatggctggtaatattcagaattccagcccctctcatcctaacttaatggctggcggcctttcattcgttttaaaagaacactttccctttaaactataaattccttcccaaggctagttcggcctatgcccagaaatgaacaagggcaggttagcggttagaagcaagatagggtgagttaggtttgatatctttcactgtcatcatttccttacttataattttgcaaaggcggtttcaccttggcttcagccccacccatgcagtaacactgtgccctgtccttccaaccactgccactaggtgaaagcagagagagcatcgcccagatgggctagattcttctcacaggctcactgctagaacgaacattcttgagactttagatctaagccagcctgatttctgaaagccttggaccgtttccaaaatcaaatcaatactccaggaacaagatctgcctcgactttgtctccatccaaggacgctatggcaacgcagttttcaaacgtgctttgagaataaatggaacagggtcccctgtgtccccactcatttgcgttttcctttttattacagccaaccccttttgtaaatattgttacacatctctctattccactgaaaacatctctttcaaaggcactttaagaaagattcaatgacatgaaaatatgaaggatcctcttgaaagagtttctggtggtgggttttaaagaacattttggtttttaaaactctgtaaccattttggtgtggggcttagcttcgtattttcaaattgaaatattctcttccttaacgtccgcataaatccaagttcacaatttttattattttaaaattttatttatttttgttttggggacaggttctcctcctgtcacccaggctggattgcaatggcacaatcatagctcactgcagcctggaactccccggctcaagcgatcctcctgcctccaattcccaaagagctgagattataggcatgaaccactgcaactcacccaaatccaagtttatactaaaagataaaattccaacatttcagagaaaatgaaagtcacaaagttatcccagtctctgaagtcactgtcaaaactttggtgaggaatcttccaggttttcccctacttaaaatatatattaatattatgtaagtaatattagcggcattttcacccaggctggagtgcagtggcacgatctcagctcactgcaacctccacctcccgggttcaagcaatcctcctgcctcagcctcccgagtagctgggactacaggcgccggccaccatgcctggctaatttttgtattttcagtggagacagggtttcaccatattgaccaggctgatctccaactcctgacctcaggtgatctgcccaccttggccttccaaagttctgggattacaggcgtgagccactgggcccagcctccttaaccttttaaaaaaggttaaaagtatgctgggcacttcttttcatagcaatacttaaaagcaatcttactctttttaatgactgtatagaattttataatataactcttctttgggagacaattgaaatgttctttatcttcactgtggtagtggagatgtgggtgtgtacaacagctaaaattcaacaagttgaacactttaaatagatgcagtttattgcatgcaaagtatgtcccaatatgatgatttaaaaatattatcgtctttgagatttgtactttgcttatgtgaaacaaaacaaaacaaaaaccctgttcttgtgcccaggagacacaccctgacacatctggaggtagagggtcatgctgtctgcaacttaccctcacaggctctgaaataacaataatagcagtatatttacagattcagaaagagagaaagctatagtaaaaatgttcataagtaaaactagataaagggcaaaaataaataataaaactacgtcttttaaattttatctctcctttattttttctctccccttttcttcctatctcttccctcctttcttaacacgtccccctatccttccctcctttcaccactctctgcacttgatccccggtgtattccagcctccaggccaacacacttcaccgcgtccgcctggggcaggtcagaaaagggacgcgaggcggcgctgtcacagcattctatgcgccccagcgccctgggccgcgctggtcttgtatcatttcagtggtccctcccgtctttgacggggccaaactcggggtgtaaattaggatcctcactgaagcggcgggaccctgagaggctttttcctggccccttagttgtgggttttcctgcgggcggtggagcccgtttccatcagaaccgcccagaggcgggcgctgccttccaggggtgaagtgttttcggaccccggaatctgtgggcggcctgcgggaggggctgaggcgcagttccctactcacccaggtccgaatccaccgcggtgctgtttccagcgagtcagattccagatcgcgctccagcctggactcggaattcctgccccgcgggtctgcattttcacagcggcaggtgtgagtgccgcgcagctggagaccagaagcctgaggcagctcggccctccccagcccaaagtgccgttattccgtttctgtatcagtaaacacgtttcattttccgtagaccagggaagggtgatgggtgatcccagtcctcgcagtgaattccgggccacaaaattcaaaacgcttgcgggcaaagccgtgcgcggtggctcaagcctgtaattccagcactttgggaggccgaggcgggcggatcacctgaggtcgggatttccagaccagcctgaccaacatagagaaaccccgcctctactaaaaatacaaaattagccgggggtggcgcatgcctgtaatcccagctagtcgggaggctgaggcaggagactcacttgaacccgggaggcggaggttgctgtgagccgagatcgcgccactgcactccagcctgggcaacaagagcgaaactccgtttcaaaaaaaaacaaaaaacaaaaagctttcgggcgccgagggcagccccgccctgaattttgtgagcgaccgcgctgggccgtttctctttcttttccggaccctgcagtggcgcctaaagtctgcgaggaggaagtcgcctctgtgctcgtgagtccagggatctaaggcaagtgctgagggagaaaacatagttgatggggcagagcagagggggctggaggtggggtggagggggagggctttgaacagaagacctgggaggcttggtgggggaggggacccaggcctcggcgctgagaagcaactcccctggagctcaagaccttcttggcctcccctagcccaggggaggactggcttcatgtctccctgaaaccgcttctaaatgccttagaacaaaccttaaatattcattattattattgaactattaaaagtcttttttggaggcgagctgaatgagaccctttgctggagctggcacacggaggaagtcctggagggagggtagacaccgtggagggaagggcttgggacctgtgtcaggagagctgggtccatctgcctctctgtctcaaactatgcttatgatctttagcagtgaaaataatctctctaaggtggggacaggaccccagtccctgctgtgcttaataaattatgaggatcaaaataaattatcagtgaatgtgtatgggaagactaagaaattgttaaaattctcgaatacattacattttcatccacagaaaagtgtaggctagggatgataggggaatagttagtaatgacagggatagttgaacttaaaaaaaaaggttgtgaggccaacaaaaaagaaatggacacagttcctgatcctggagggttcatagtctaatgggggaggagggtagaagatggtaggtgatggctgggtgtgtggcactcgcctgtagtcccagctactcaagaggctgtggtgggaggattgcttgagcccaggcatttgaggctgcagtgagctataatcacaccactgcattccaactgagtgacacagcaagactcctctcttaaaaaaataaaataaagtaaatgaaaaaaataagattcaagacagggcacagtcggtaccatcaggaaggttcaaaccatgggctagatcagtagttctaaaacttgactacacatcggaatcacgtagggaactttaaaagatactaaggtttaggtccaacctaggtttactgatttaactggttgtggctgtggcctgggaacatggatattaaaaactctccaggtggttctacgcagtggctaggtttgaagaccactgcctagatgtcccaatgactaagaatgtgcgctggggacaagccaattctcttagtagaggctttccagacagaattcttattattgagaattgagaattcacatgccacacataatttatcgttttaaagtgtacagatcagtggcttctagcataatcacaaggttgtgccaccgtcaccactatctacttgggaagattttcttcctttttttcttttttttttttttttttgaggcggagccttgctctgttgcccaggctggagtgcagtggcgcaatctcagctcactgcaagctccgcctcccgggttgaccccattctcctgcctcagccttctgagcagctgggactacaggtacccgccaccacgcccagctaagttttttgtatttttagtagagacggggtttcactgtgttagcaggatgctctcgatctcctgacctcgtgatctgcccacctcgacctcccaaagtgctgggattacaggcgtgagccaccgtgcccggaccctttttcctttttttttttttttaaaggctagtcaagtgaaacagtgggagtgaagatgaaacaaaaacatctataactggttgtgatcaattagttgtaaacaccactgcactcagaccagcctaactgggaagattttgaggatatgctgtggtctgatgggttccaaggcagaggtgacagtaacctggaagagggagactgcttaggcagtggcatcctggtgggatagggtgaggagatcccagagcccacgtttactgcaaccctggggaaatgtcaccagagaaatgggggtggtgccagacaatagattgtgggagctatggtttccatggtagagtagaagcatccaccatgtgtgacattcagcagatggggcgctgtgggtggcttggagcactctggttgtaactgaggcaggcacagtgtttaggaagcctgtgcagtaatccagactgaagggaggggaaagcctagactaagactatggctgtgggattgaaatagcgttgaaggagctgactttgactcccggagatgaaggagaaagaggaaatcagaagggaccaaggatggtgaagttcttaagagaaactgaggaggaagagaggatgatgtggtgggagacgtgtagagagtccttgtagatctgtcatattgaaggggactatggtcccagaggtacagatgtcctaaaacaggctggaaaagggagtctggagagagcttggtgttgtaatgaaccatggggagccgcctcgttggccctgtgattacccaggaactgaatagagagggggccctgggagacctcagacacttagaggatataagggggtgaaaggggggacctggctttgagtcgaagggaggagaaggagattatatagctgaaacgtctaagagaatttgtgatctgagcgtttctactggggcaagtgcttctgaaaggcagaggcggctgagatctggaaacaggtctgcaaatctggtcactggtctcattgcagtaacgctgtgcgcggttgagggagtgtattgggagaaaaaccacgcgttgtctgtcccggaaggaacaagccagtgagagccggcctgatgggaggaccggcgaaaggggcttggtgaagcccgcgctccttgggggtgggaatgcggggatggggtggtcgcgatgcagggagggcgacagggtccaggtcgtgctcataagtttggagctgtactctcagctactcggggctggtccttgattttggctgcgctcgcgcacgctcccccttttctggccgccaggtcccgccttctaaatttccccaggtctccaggccgctagaattttctcttctgaacgtggccccgccctctccactcatgattggccctaagttccgggcctcagttttcactggataagcggtcgctgagcggggcgcaggtgactaaatttcgacggggtcttctcacgggtttcattcagttggccactgctgagcagctgagaaggtggcgacgtaggggccatggggctgggccgggtcctgctgtttctggccgtcgccttcccttttgcacccccggcagccgccgctggtgagtggggttcctggcggtccccggcggagcgggagcggcggggcgtttccgggggtccgggtgggttgccgcgagcgctgtgcggtcagggcggggctcaggtgtgctgtctggagtgcagggagctggacgccgcctgttcccgccacacctcagccctgctttcccatctcccgtctctttttttttttttttttttttttttttttttttttttctttctgagacggagtctctgtcgcctaggctgtagtgcagtggcgcgatcttggctcactgcaagcgccgcctcccgggttcacgccattctcctgcctcagcctccctagtagctgggactacaggcgcccgccaccacgcccggctaattttttgtgtttttagtagagatggggtttcaccgtgttagtcaggatggtctcgatctcctgacctcgtgatccgcccgcctcggcctcccaaagtgctgggattacaggcgtgagccaccgcgcccgacctcctgtctcctttcagtcctcctcgggatcgcgcatcacccgcattttctggtctctcctgcacttgctctcctcgcctctcctccgtctcctctcacttttcggacaaaccagtccttctgaggcccctgggttcccgggctgctcctgtgaatggcattggaaggccgttccagcgcggccgctgaggcagccacttcccccggtgctgggggcggatctcaggtccctgaagtcctgtcctctcccggagccgatgtgttctcagctcctgggccgcagctcctggagttggggccctcctttcttgggacccggaggtggtgcttcttgctgctgtggggactgtggggggtcctgactctcaagctgaggggttggagtctgcaggctccgggcagaggattcttcctgcgacttctgtcatccccagctcattctcccctcgcctccggctccgggggtcctctcctctctcgcatcccacccctactaatgaccaatgatctaaggacaccagattccctctcacctcctccctgcccatcttacggcgccctgggtcctgttgctctcccagctccctgctaccccttcctgtgtgctgttctctgatccatttctagggtgtcctctgccttcatcccccgcccccgccactgaaggtccctcctgcctcctttatgggcctttcctgcaagcagccttcactccgtgctgcccctatgcctccccattcccaaatgtccctgactctaactttctggtgctgccttttgtccgggggggtcttccctccatcccactcccctccagacccccaaggagagccctgatgctaatggcagttgggccttaggcagggcgcagggcagcgcagatgccccctcccctccagtgcaggtgcctgctctgggccctgcctcattgtggccccttccccactccttcatcctcagcctcaccctcttgaggaccccaccctccagcccacaggtgctggaccatccctccctggtccctccgcccctctccaccttgggaccttgtgctgctcctatctcttgcccagctgcctggggccctcagcaagttctcatctttcagtgggaaagtgggagtgctggagcatatgacagtgctgagaatctttcccaagccccaccctcccccagagcaccctcccctcctgtcctcaccctaccccaagttctcccacagtcactcctgccccatgctcatgccgccctccagttcttgctctgcccatctcccctccccaacccagacctaaaacaggctgttgggccagctgttccttgaccttccttcttttcttttggttccttgaccccagtgggctctcactccccacaccgcatatctaaaatctgttttgcctgctcttggggtgccactgctccccctccagcattactccttttggcaggtccttcctcaggctgagaatctccccctctaccttggttttctctctctggccagcacccccaccccttgctttgtttttaatttttaacttttgtttgggtacgtagtagatatgtatgtatatatttatggggtacatgggatattttgacacaggcctacaatatgtcataatcacatcagggtaaatgggttatctatcacaacaagcatttatcctttctttgtgctacaaacaatcccattatgctctttcagttatttttaaatgtacaataaattattgttggctgtactcaccctgctgtgctatctactagatcttattcattctaactatatttttgtacccattaaccatccgcactcccccactccccactacccttctcagcctctggtagtcgtcattctattgtctctccccatgaggtccattgttttaatttttggctgccacaaataagtgagaacatgcgaagtttgtctctctgggcctggggcttatttcacttcacatgatgacctccagttctttgcaaatgacatgatggctgaatagtactccacatacacgtgtgcaccacattttctttctccattcgtctgttgatggacacttaggtcgcttgcagatcttggctattttgaatagtgctgcaataaacatggaaaagtagatagctctttaatataccgatttcctttcttttgggtatatgcctaacagtgggagtgctggagcatatgacagctctattatatttttagtttttggaagaacctccacattatttcccacagtggttatactagtttacgttcccaccaacagtgtacaagggttctcttttgctacatcctcgccaggattccttattgcctgtcttctggataaaagccagtttatctggggtgggatgatatctcgtaggagttttgatttgccttcatctgatgacgaatgatgttgagcaccttttgatatacctgtttgccatttgtatgtcttcttttgagaaatgactattcagatcttttgctcatttttaagttggattattagatatttttcctatagagttgtttgagatccttatatgttttggttactaatcctttgtcagatgaatagtttgaaaatattttctcccattcttggatggtctcttcactttgtttattgtttcctttgctgtgcagaagctttttaacttgatatgatcccatttatgcatttttactttggttgcctctgcttgtggggtattacttaaaaaatctttgccagtccaatatcttagagagtttccccaatgttttctttcatagttttcatagtttgaggtcatagatttacatctttaatcctttttgattggatttttatatgtggtgagagatagggtccagtttcattcttctgcataaggatatctagtttccccagcaccatttattgaagagactctcctttgccctgtatgtgttcttggtaactttgttagaaataacttcactgtagatatatggatttgtttctgggttctctattctgtttcattggtccgtgtgtctgtttttatgccactaccgtgctgttttgattactctagctctgtagtataatttgaagtcagataatgtgattccgctagttttgttctttttgctcagggtagctttatctattctgggttttttgtgattccatatacattttaggattgtttttctatttctgtgaagaatgtcattggtgttttgatagcaattgcattgaatttgtagattgctttgggtaggatggatattttaacaaaattgattcttccggctgggcacggtggctcactcctgtaatcccagcactttgggaggccgagtcaggtggatcacttgagatcaggagttcaagaccagcctgatcaacatggggaaaccccgcctctactaaaaatacaaaattagccaggcgtggtggcatatgcctgtaatcccagctactcaggaaagctgaggcaggagaatcgcttgaacccaggaggcagaggttgtggtgagctgagattgcaccattgcactccagcctgggcaacaggagcaaaactccatctcagaaaataaaaataaacattgattcttccagtccgtgaacatggaatgccttttccattttttgtgtcctcttcaatgttttgcatcagtgctttatagtttttattggagagatctttcacttcttcagttaagtctattcctaggtattttattttatttgtagctaatgaaaatgggattcgtttcttgatttctttttcagattatttgctgttagcacatagaagtgctattgttttttgcatgttgattttgtatcctgcaactttactgaatttgttcttcagttctaatagttttttggtggagtctttaggttttccaaatatcagaccacatgatgtgcaaacaaggataatttgacttcttcttttccaattttgatgccctttatttccttctcctgtcagattgctctagctaggacttgcagtattgtgttgcataactgtagtgaaagtagtcatccttgtcttgttccagatcttaaagaaaaggctttcagttttcccccattcagtatgttactagctgtgagttgtcatatatggcttttgttatattgaggtctgttccttgtatactcagtttttttagagtttttatcatgaagggatgttaaacttatcaaatgctttttcagtatcaattgaaatggtgatatggcttttgtcctttattctgttgatacgatgtattacattgattgatttgtgtatgcatacctggaatacattccacttggtcatgaagaatgatctttttaatatactgttgaatgtggtttgctagtatttcattgatgatatttgcctcaatgttcatcagggatataggcctgtagttttctttttttgatgtgtctttgcctgattttgatatcaggatattcctggctttgtaaaatgagtttggaagtattccctcctcctctgtttttcagaacaatttgaataggactgatatttcttgttctttaaacgtttaattgtggtaaattatacattacatacattttactgttttaaccgcttttaagtgtatactcggtggcattagatacattcacatttttgtgcaacccaaaactctgtacccattaatcagtaactccccattcctccctacctctggcccctggtaaccatcattctactttttgtttctatgaatttgaccactctaggtacctcatttaagtagaatcgtgtaatgtttgtctttttgattctggcttatttcacttataatatttcgaggttcatccaggttgtagtatgggtcagattttcattccttttaatgatgaataatactcattatatgtatgtaccacatcttggttatccattcctcagacaatggacacttgggttacttctaccttttggatattggcaaatatttcatttctcttgggtatatatttatttcttttgagtatttcttttgggtatatatccagaaatagaattgttggatcatacggtatttcattttttaatttttagaggaatcaccatagtgttttccattgcaggcgtgccattttgtatttctagaagcagtatacaggggcttcagtttctctacctccttgccaaacttgctgtgtgtgtgtgtgtgtgtgtgtgtgtgtgtgtgtgtgataatagccaccctgattggtttgaagtggtatctcattgtggtttggatttgcattttcctaatgagtactgatattgagcatcttttcatgtgtttattgatcatttgtatattttctttgaagaattggccattgaagtcttgcccatttttctcccccacatagcttctcatggctattttgcccatttttgagtgggttgactgttttgttgtttttgtcaaacttttttgcatattctggaaactaatctctctctttttctttttttttttttttttttttttgagatggagtcttgctctgttgcccaggctggagtgcagtggcacgatctcagctcactgcaagctccgcccgctagcttcatgccattctcccgcctcagcctcccgagtagctgggactacaggcgcccgccaccacacccggctaattttttgtatttttagtagagatagggtttcaccatgttagccaggatggtctcaatctcctgacctggtgatacacccgcctcggcctcccaaagtgctggaactacaggcttgagccaccacgcctggccttctggaaactaatctcttatcagatatatgacttgcaatatttatttcatttcaggggttgattgctttctcactctgattgtgccctttgatgcacagatattttgaatttttcatgagtccagtttgtcagttctttctattctatctgtgctttggcgtcatatccatgaaagcactgtcaaaccctatgtcatgaacattatacccaatgtttttttctaagatatttttatgttttagttcttgagtttagagtttaggtctttgattcattttgagttaatttttgtatatagtacaaattaagggtccaattttatattatttgaacatccagttcccccagcactatttgctgaaaagatggacttactctttgagaccctgtcacctgcccaccccagtggacactagctggtccatccaattgctgtcctggggccttgtcatgctactcttccactttggacccaagcccacatcattgctcccctctgggatactgaccccactataaacttcactggggctacaaccttcctaccccttgtgcctcatgaccaccccctcccttgtccccaccatgcccatgatgagtcttttctcaaggcagctcgccttgcctccatctcaccctcacctgtgcaccacagccacactggacatgggtccctctgagcctgagtcccttcccattcccactgtcccctctggcaagaccttccttccaacactgccttcatgctcctcccttgcccctgcagggcagcctctccccttggcccctattcccttagggggcttgtggccacccagtcctggcacctgacctacaagtttgccatcttcattcccccttcttctgttcatcagccccctcctctatcctcccaccctcacagttttccttgtatatgaaatcttcgttcttgtccttttgcccatgcgcatttcctgcctcctcagggaggtcgggacagcagacctgtgtgttaaacatcaatgtgaagttatttccaggaagaagtttcacctgtgatttcctcttccccagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaaatgtcctgggagctaagacctgggacacagagaccgaggacttgacagagaatgggcaagacctcaggaggaccctgactcatatcaaggaccagaaaggaggtgagagtcggcaggggcaagagtaatgggaggccttctccaggaaagttggagacagagagcagggacctgtctcttcccgctggatctggctgggggtggggatgaggaatagggtcagggaggctcagcagggtggtgagccggaactcagcccacacagggaggcatggaggagggccagggaggggtcgctgctgggctgagttcctcacttgggtggaaaggtgatgggttcgggaatggagaagtcactgctgggtgggggcaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacaggtaccgaccctggccaggggctctactgttcccgcaattctgctagagttgcctcgcctcccagctctgtccggggaaaccctccctgtgctatggatgcaggcgtttcctgttggcatattgtgtcctgatttgcctctcctgttagagccattggataaagacagtgggtctgggactgaactgtccagtgttgtaatctgggaaagcagtgggccctctgacagaagcctgagcctggtgtgggagttaggcaggagaggaagccctcagggccagggctgccccctctgcctcccggcctgcccatcccggagagttccctcctggccccatgacccaggagtccacccttgacatccccctcctcagcatcaatgtggggatcccagagcctgaggccacagtcccaaggcccatcctcctgctagcctggaggaattaggccccagggtgaggacagacttacagaaggtccggtatctgtgagggattcagccagagtgagaacagtggagaggagcagccctgttccctgcatctcccttagaggggagcagggcttcactggctctgccctttcttctccagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctggtgagcctggggtgaccctggagagggtcaggccagggtaggaacagcaaggacggctgtggctctctgcccagtgtataacaagtccctttttttcagggaaggcgctggtgcttcagagtcaacggacagactttccatatgtttctgctgctatgccatgttttgttattattattattctctgtgtcccttgttgcaagaagaaaacatcagcggcagagggtccaggtgagaaaaggggacagtttctggagatgggaaagctcctttctaggcagtagggtctcctcattgctcctgcccagacaagacgtaggtgacaaggctgctgggacaggggatggaagctggggtatttgggaggggaatgggagctgcatctccatctacacccataagtgcttcccaagccagggctggggcaaggccttcgaatatccagctgtggcctcctcctgctgcaagtgaggagtgggcagcagggagggctgtggcacctgctctgtccccatcccagcctctctgtctctcgggctcactagggtgcgtccaggtggggtgagttgggaatcacgtgctgattgctgagggcctggatgatcatggtgtcagagggaggaaatagtaaaggtggctgtgatctggggagggccagaaactggagaggaatccaaggagaggcgatgcccacccgtgtgcctcctccaggaggcactttccaggttcccactacctggcctccctgagtttccttgcagatgacacagatgaatagataagcagatgtccctgggccatttgaggagcggggcccagcccctcatcagggcagatgtggtccctgttttcatcctacctccagcgtgttttcttctgcagtccctgagggacacagtccccaggcgccatctctttgaggctttgttctgtgctctgtggccttaccttgccctccctgagccaatttccctttctcaaggtggtcactgcctggtaagtttggagtaagggacagtcagaagcatttcccccacagtcaggttgtttgatgggagatgaaaagagacagcagaagttttgtgtttctgcaaaaacagaggcagtgcaggggacagtgagaggctggggtgtccaggagacctgagtctggcggtaggggcgctggtttctcatccttgaacctagttgcactgtcagtcggcccctcatgcctgagcagatgggaaggttcgtcccctgccctgcagcaagagggccccatccaggaggcacccacagcaggggcagtgcaggtctgtggtcactcctgctctcacctgcggcgtctcccgtggagggattgtcacttctggttccctgtgggcaggaatggtttcctcgtaggtcactggggttttggccaggaaaagggtatgaaattcatgtgccagtttctcaaaattcctgctttcaatgttgatgtccaataaagatgttcgtaatttcagctctataatcttaataggatttcctctaatactgctgttgtaaagcatattaaataaaacaggaactcaaatttggagccccctctccagaagggtctgtgtggagatggtggctgtggcagcggcagttcccaggtgcagagggtgggcagaggcagcctcaggctaaggggtctcccctactccacgtggagaaaagtccttgtaggttgcaagggcagtggcctgggtggaatccctgctagggacagagcaggaaggcctcacagcctcaccaagcagcagccctggggtgaagtaagtggaccaggagtaagtggaccaggcaggagcagtagtgactcaacagcaggtcacaggcctaggtgggtgctgaaggtcatgggaggccaggcctcctcgagcaaggtggggggtcccagggtcaggtcaggtgcagatcctgtggcagccacgtctttccatgctgggcctgctgggccccccaggcttcctgatggggtccccagttaggagctgcctgctcagggctgggaggggaggagtgctgagctgcagatagagggcagggcccacagtgggcagggcctgccctggtgtgcaggtgcctctgcaggagagaagggcctggggactgagagcaagggtcagggcctctctttggggaggcctctcactgtaacaggactggtcaggcctgagaggagggcactgggttccctcttgggtcttgtccttttgtcttggggccctttcactccctgcacggtgagtggtgggcacaggacaggggctgatgttgatggagtgatgggagagaactgacaggggctgggaaaagcaaggagggaggaagaaaaaagtgggggcctcatcttctctcagagaaagggcgaatctgattttggggcaactgaagagagaaaagtccttagggaataaacacaacactgcacccagtggagcatttacccgtttccctcttctccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaatagacatttctggtctgtgttttatttcatgcgtctgggagcggataaagtgtgaggttcagggagaaggagaggtctgtctcaatgccttgacccagcatcaaagcaatctcccctccttgttccctttccctgctagttcccaatgactgacagattcacagcagaacagaaaggactgggaagggatggaggtgggacatctggcgccaatattcaggggctgaccctgtgagggaacatctgccctgaagagttggagccttcatgtgatgacacagagatctctgtcactgtattcagggaaaggatcaagcctcactccccatgcagggaggaggttctggctgtgatccggcctgtgggagaagtgaggacccgctccctctacagtgacagccaagaacctgcaggtgacagagaaggcttcccctcaactgtctcctatcaggttcttccaggcatcaaggaatagacctgggacattgcctccagtgacatgaacacacccagaagtgaggtggccctgccagggggtcctggtgctgccacttgttttgggagctcagtgtctggagaggggtgtggagagtaggctttctgcaaaacagtaatcatgacctataaattattttattcttcattagctttttgccataaaataaaacaggtacccaaaaagaaaaactgtctgaaaatgttgccctttaataataataataaataataataataaaagataaacactctttaaccaccagagatatagaagtttgtcagccagcccagaaaccatcatttgccccagctcagtgataaaggcttcccttccccacataaaatcacagcctgacctttatgatgattgcttctttgttctattttatattttcatcctctgaaattgtagtttagttttaccttgggatgtataatttttgttctcttttttctttttttttttaagacggagtctcactctgtcacccaggctggagtgcagtggcatgatctcggctcactgcaagctccgcctcacgggttcatgcgattctcctgcctcagcctcccgagtagctgggactacaggcgtctgccaccacgcccggctaatttttttgtatttttagtagagacagggtttcaccatgttagccaggatggtctcaatctcctgacctcatgatctgcctgcctcggcctcccaaagtgctgggattacaggcgtgagccaccgcacctggcctgttctctttttttctctatgctcctccttgaaattttattgtctggctgagttttccatagtttgcattttgctggctccaccccaaggcatagtttaatatggacctgttttatctgtactttctacaaattggtagttggctacagagatttgcttatagactgacttgattttcttcttgaatacttcatttatggcactccattgtattcttccatcaggaggaagaacttagtactggttatttacttctactctacttttaattgccattgcttttcaatggctaaatctgttaattcgttatgggttgcaaaagaattatagtctcagtctctcattccttccccattcactagctgaataatttctaaaataagagatttacccttggctggatgcggtgacttacgcctgtaatcccagcacttggggaggccgaggctggtggatcacctgaggtcgggagttcaagaccatcctgaccaacatgaagaaactgtgtctctactaaaaacacagaactagccgggagtggtggcgcatgcctgtaatcccagctactcgggaggcggaagtaggagaattgcttgaaccgggaaggcggaggttgcagtgagccgagatggcgccattgcactccagcctgggcatcaagagtgaaactccgtctcaaaataaataaataaataaagtggagcacttgacggccatgggagagaatcggctatgaccacacacagcaagatgatgagcccagcaaagatgatgagcccaactacatgaaaacaacttctaatttcattcaatcagaaccaacagaactcatctacagtgttaaaaatcaagacagtggctactctagggtgggggaggctggtttatgactcaacggtgtttcttggagggtgaaaatgatgttgcttgatgaaggtgttgtttatccgagtttttacttgggcaaaatccactgcccacctgtgatttgtccacctttctccatgcatgttgtccttcattcaagtttacatttctggtgttttgaaacaattctctctaagctaatatagaatttctcctactccaagtccttagaaatgctgcattgaaaataccagtgaatttttttttaattccaggaaataaatgcccatgactcagatataaaaaggagaatctacaagagcagtaggcttgggagctgacaccagaacagctttggaaagggctgtcgagccaggaactaggaatcaaaacccaaacaagaccacaggaggtagagggtagaaattatgccccagtagtgcatgaatgaatgaatcaagggcagtgactcatgggttgcctggccagtctggaacttggggaaaataaagttggaaaattggcggatggaagagagaagtgtgcactgaccactttccatgggaagagcatgtgaagatagaggttgcatatggatgcctgccagagggtctccaaggggctggggctccctgtaaccaggtgagcgagatggcttgatggatgatgccactcagccgcacaaggcttgctcatgagtccctgcacaaagtggccgtggtggctgggatggacactgcatggacagagcaattgagtcaccactcaccaaggctgacctggcagctgccactgctgaggacccagcctgccaaaagcagctgtttctttgaacagagaaaaaaaacagacaatgttaattaagagcaagacagtgttatgacagataaatatgccactgcagctatagtagagatgtaaacaatcttgaaattataaaaaaaaaatgtcgatggaaaagacttactgcaagtaagaagttaaaacagttgtaaaaattctatctctgcccaactatatacagattgtttcacagggaagtcctactaaaccttcaaagaaggttattggacttatttaaaatattcaagagaatggagcaaaatacagaaagctaggcaactcactttatcagctatgaatagtgttaattctaaagccagttagggaacaaataataaagaaacaagataggaaaatcactattagtaattagatgtaaaatagatgagaaaaatagtagactgtgtccatcagtgtgctataaacaaattaaatatcttgaccaagttatgaatcccaagaataaaagaatatttaaactttaaatcttttaatgcattttaacacttaattcaataatttaaaaagagacaatcatatttcactagatgtagaaatcactgtagatgaaatctaacactacacctgacctacatttcttcagttatctccacttttaagaatttgtgatcagtgcagcactattcacaatagcaaaggtaaggaatcaacccagatgcccatcaacagtggaatggataaagaaaactgcggcacagggccaggcgcggtggctcacgcctgtaatcccagcactttgggagggtgaggcgggcagatcacgaagtcaggagttcgagaccatcctggctaacacagtgaaaccccgtctctactaaaaatacaaaaaattagccgggtgtggtggcgggcacctgtagtcccagctactcgggaggctgaggcaggagaatggcatgaacccaggaggtggagtttgcagtgagccgagatcacgccactgcactccagcctgggtgacagaatgagactccgtctcaaaaaaaaaagaaaagaaaagaaaactgcagcacttatacaccatggtacgctacccagccaaaaaaacaagaacgaaatcatgtccttcacagcaacatggatggaggtggagaccattattctaagcaaattaatgtaggaacagaaagccaaataccacatattctcacctataagtggcagctaaacattgagtacacatggacacaaagaagggaacaatagacactggggcctccttgagggtggagggtgggaggagggggaggattaaaaaactacctattgggtattgtgctgattacctgagtaacaaaattatctgcacaccaaacacccgtgatacacaatttacccatgtaacaaacctgaatatgtatcccttgaacctaaaaaatcaaaaagaaaaaagtaaaaaagaattcctgatcagattgagccaggacaatggccgggcgtggtggctcacgcctgtaatcccagcactttgggaggccgaggcaggtggtcagggtaggcctcttggaggagccatgtgagcagacttgagaaggagagacacagccatgcagatatttgaaggaagaaccttccagtatcccgctctaagcatacccaggactctgctctggggcagaccctaaagctgcagtggaaatggaggtggccacactcacagagactgtggcagagagtgatggggatttgggtctccccttcctgctgtggctgttagaagtgctggagttggggagggaaaggcactggcatgtggaggaagactaggagaggaggggaggctgaagtgtgtcccactctcactccacctctctgttctctatctcctgcatccggtgcctccccgacttccccaaagttgtggtccctgacaaggaagaccctgagggcaaccacaccttgccatgtagagcacctggcttctcacttgccaacatcactctgacctggctgcaggaaggggaggagccaactctggactcaagactcaaggggaccagacccaggaagatgagacatatcagggctgggcagctgtggggggccctcccagagaaggcctgagatacacctgcctgcaggtgctcctgggcctggagaagcccctcagtgtgactaggtgaggtgttgtcagaggaccagaggctgagggtggggtgtcccatccagatcctgcccctctctctgccccagcacccaaggccccttcctccctcctctatggagatgctggggatgtcctcattctccctctgagcactcacatctcacccctcatctgtctctctaacctccttccttcctgctgcagcttctgccccagccccaggctctggcctctctctccccagttccaccctccagggggtgatggttcacttccctctgaggagccagcactaggtgagaggctaggagaaggaaaagctcatgggccatgggttgggagggagaatgggcactgaaatggaagggtagggagacagaagaggcaggtatttccaaatcaccatttttctgtcatggtccaagggtgccatccttctcccaggcccagggatgtggaaagagcagcaggaattgggaaatactccacaggaaagaacaatgtgcctcctccctccaccggcttcttcctcttgcctattctggtcaattctctaagtgaatcatgtaaccaaaatgtgaaatgtttattttaggaaagtctccaaatattagggaataaaattactagtgcctaagccctgcatactgaaaaacagaagctttaagaaataaagacctgcatggaaaattgctcatcaagtcggggaagtcaaagtctgagctgaatcagctctttttttctttctctctctttttttttttttttttttttttttttgagacggagtcttgctctgtcgcccaggctggagtgcagtggcatgatctcagctcactgcaacctctgcctccccgactcaagcaattctcctgtctcaggctcccaagtagctgggattacaggcatgagccaccatgcccagctaatttttgtatttttcagcagagacgaggtttcgccatgttggccaggctggtctcaaactcctgacctcaggtgatccgcctgcctcagcctgccaaagttctgggattacaggcatgagccaccatgcccagctgaatcagctctaaagtggtgctgaagtgagagccatttatgtgcctgtgtgagttcacacaggtcttgagacctctgtgtcctccttagaagagtgaagtgagcacccagtgcctagaccttggttgtgctaagtcattctctgataaaaggattcagggctccatagaaaaacagctgattctagggctggcataggaaaaatataaggtgagcctggaacatcttgtaatgccagaaagtaaccgccacccatctcccaaccctcaccaccaaaaaataagggcatgtcagagggacacaggagtcagcctgaaagagctccctatggacaaagccggaataatccgagcaacaaagttacaatagtattggattatgacccaaaatataaataaatattcattccacactgatttatttaatcaaaaataattaaataaataaatagggaagaaggggcaaatcttccttacagaagaatttcaaaacatatattacgagaatctctttcccaggagattggaattttatttctctcaccttgaatatgggctggacttgctgacttgcttccaaagactagagtatgaaaaaggaaaaataataactttacagtggagaaatgtagcagacactaccaagcaatcagagtcatgttaacatcttgccccccagaaatgatgtgatgaggacactcccctctatggtattcttcccttaaacccataaccccaatctaatcataaggaagcatcaggcaaacccaaagtgagggacatcctacaaattatctatccagtattcttcaaaactttcaaggtcatgaaaacaggtaaagactgagaaactcatgatcagaaagactagggagacccaaaagctaaatgcattaatgggccctggaaaaactggtgaagtccaaataaagtctacagtttagcgaatagtattatagcaatgttaatttcttagtttcttagtcttgacagaattttgttagatgttaacattaaggaaagctggggtttatggaaactctgtgttctagctttgcaactctttaaatctattattgttattgttattgggtttttttgtttgttttgtttttgttttttttttgagatggagtctcgctctgtcgcccaggctggagtgcaatggcgcgatctcagctcactgcaacctccacctcctgggttcaagcaattgccctgcctcagcctccccagtagctgggattccaggcacccatcaccacgctcggctagtttttgtatttttagtagagatggggtttcgccatgttggccagggtggtctcgaactcccgacctcaggtgatctgtccgcctcggcctcccaaagttaaatctattattattcaaaacaaatttaactaaaagtgaaatgaagctaggtacagtagctcatgcctgtaatcccagccctttgggaggccaatttaagcccaggagtttgagagaagcctgggcaacatagtgagaccttgtcttataaaaaaaattaatttaaaaaatgaaatgaatagacatatattaaattaaatcgataattaataacattcagaaacagaaaacatcagccccaaatgggtttactgataaattctatcaaacatttaaggaaaaaattataccaattttctataatctcttccagaagacatactttcttttgttgttgttgttattcagtgttaatttcataatcataaacttaatgctgcaatccagctaggcatggaagggaacaaggaaaacatgaaacccaaagggaactgcagtgagagcacaaagattctagatactgcgagcagatggatggagggtgttctcctgagctacagaagcaatggtctagtggttaagataaaacacaagtcaggccgggcgcggtggctcacacctgtaattccagcactttgggaggctgacgcaggtgggatcacctgaggtcaggagttcaagaccagcctgaccaacacggagaaaccccgtctctactaaaaatacagaattagccaggtgtggtggcgcatgcctgtaatcccagctactcgggaggctgaggcagaagaatcgcctgaactcaggaagcagaggttgcagtgagccgagatggcgccattgcactccagcctggcaacaagagcgaaactcagtctcaaaaaaaaacacaagtcaaacttagtcaagttgtgtacagtcagcgatggtgatcttcttgatggtcttgccattcccagacccaaagtgctccatggcctccacaatattcatgccatctttcaccttgccaaagaccatgggcttgccatccaaccactcagtcttggcagtgcagatgaaaaactgggaattgcccgggctaggtggctcatgccgtaatcccagcactttgggaggccgagatgggcagatcacctgaggtcaggagttcaagaccagcctgaccaacatggtgaaaccctgtctctaataaaaatacaaatattagccaggcatggtggtgcatgcctgtaatcccagctactcaggaggctgaggcaggagaattgcttgaacctgggaggcggaagttgcagtgagccaagatcgcgccactgcactccagcctgggcgacagagttaagactccatctcaaaaaaaagagaaaaaagaaaaaccgggaatcatttgtgttgggtccagcatttgccatggacaagatgccaggacctgtatgctttaggatgaagttctcatcatcaaatttctccccgtagatggacttgccaccagtgccattatggcgtgtgaagtcaccaccctgacacataaaccctggaataattctgtgaaaggaggaacatttataatcaaatcctttctctccagtgctcagagcacgaaagttttctgctgtctttggaaacttgtctgcaaacagcttgaaggagacacagcccaagggctcaccattgacagcgatgttgaaggacacggtggggttgaccatggctgatagtatggggctcctgatggtggcgtctgcaaagccaagacagacactttctatctcatttcatgaggccaggattccatgagggaatactttctaactaattccatgaggccagcattagccaaataccaaaatcagatgaagacttcacaaaaaaagaaaaccacagaccaatatctctcatgaacataggtgcaaaaatcctcagcaaaatgctagcaaatcaaatccacaatgtatgagaagaacaatacaccatgcctaagtaagatttatcccaggtatgcaaagttacttcaacattggaaaatcagttaatgtaatccattaaatcaactggctaaagaagaaaatcacatgatcatatcaatagaggcagaaaaagcaattgacaacatccaacacccattcatgatgattaaaaaaaaaaatctcttagcaagctaggaatagagaagaccttactcaacttgataaacaacatccacaaaacatccacagctaacatcacacttaatggtgagaaactaaaagcttgcctgctaagatcagaacaaggcaggaatgaccctctcaacacagcttttcaacgttgtactggaagtcctagctaaagtagtaagacaagaaaaggaactaaaaggtatacaaatttggaacaagaaataaaactgtctttgtttacagatgatatgattgtctatgtagaaaatcaaaaagaatccacacataaaaaactcctggaactaacaagcaattatagcaaggttgcaggatataaagttaatatgtaaaagccaatcacttttctatgtatcagcaatgagcacgtagaattcgccatttaatttttttttttcaagacggagtcttgttctgtcgcccaggctagagtgcagtggcgcgatctcaactcactgcaacctcctcctcccaggttcaagcaattctcctgcctcagcctcctgagtagctgggattacaggtgtgccccaccatgcccagctaatttttgtatttttagtagagacggggttttaccatgttggccaggctgatctcgaacttctgacctcatgttctgcctgcctcagcctcccaaagtgctgggattacaggcgtgagccaccgtgcctggtccagaatttgccatttaaaacacaataccacttacattagcacccccaaaaatgaaacacttaggtacaaatctaagaaaatatgtacaagatctatatgaacaaaactacaaaactgacaaaagaaatcaaagaactaaacaaatggagagatattccatgttcatagtcaggaaggctcaatactgttaatatatctgttctttccaacttgatctgtggaatgaatgcaatctcaataaaaaacctcagtaagttattttgtggatattaacaaactgattcaaactttatatggtgaggcaaaagacctagccagcacaatataggagaaaaataaagtcaaagaccaccactacctgacttagactttctataaagccatagtaatcaagacagagtggtgattagcatagccattgtgggaaacagtatggaggttctgcaaaaattttaaaaatagaaataccacatgatccagcaatcccactaatgggtatatatccaaaggatatgaaatcagtacgttgagatatttgcactcccatattcattgcatcattattctttttttttttttttcctttagagatagagtctatgttgcccagggcaactcctggcctcaagcgatcctgctgtctcagcttcccaattatctgggattataagcacgagacactgcacctggctgcagcattattctcaatagccaagatatagaatccacctaagtgtccatcaatggatgaatggataaagaaaatgtggtatatataaaaaatggaatactattcagccttaaaaaacaaaatcctgtcatttgtgacaacatggatgaacctggaagacattatgttaagtgaaataagccaggcacagaaagacaaatacaatctcacttatatgtggagtatagaaaaagccagactcataaatagagagtaaactggtggttatcagaggctgggaggtcggggaattggggagatgttagtcaaagaacacaagatttcagttaggaagaataagttcaagagatctattgtaccttatggtgactaaacttaataacaacatattgtgtatttcaaaatagtatgagaatagctttaagcattctcatcacatacacacaaaatatgtatgtgaggtaatgtacatattattaaattgtttggtttatccattccacaatgtgtgtgtatgtatgtgcatatatatataaacatgatgtacaccacaaatgtataaaattagtcaatcgaaaaattaattttagaaagacagagtggcattggcaaagaatagacaaattgatccacttgagcagaatagagagccaagaaatagtcccacataaatacaaggagcaaagacaatacaataaagatagtcttttcagcaaatgctgctggaacaactggacagccatgtacaagaaaaatgaaaagagctctcttaaaaggttactgtgaaagccacctgtgacagtaacagaaagtgcccagcagggtctctgacacttagtaatgtaatctctctcactgtaatgtaatggctaaacttcaacatccctcagcccccatctccataagactttcccatagaggcaacaatgattcctgtcagtcacccagtcctgccaatccactgggtaggatacaatattgaggggcccatcagcacactggccttagggggctctgcagccccttgaccttgtggatgatgctggccttaatctcctcttgtccgtggctaaagacaggccccttctgcggagaccaggccagaatgctcatctgattaagactctatattaagagtcaggaataacaaaaacaacaataaataaataaacacagtaacataatctatgtgtcttagtccgtttcctgccgctataacagaatactacagactgggtaatttattttgttgttttttcagacagggtctctctctgtcgctcagactggagtgcagtggcatgatctcgactcactgcaacctccacctcccagactcaagtgatcctcccacctcagcctcctaaataactgggaccacagacccgcacgaccacaccagctaatttttgtgtttttttgtagagatgggttttgccatgttgcccaggctggtctcaaactcctgggctcaagccttccacccaccttggcctcccaaagtgctgggattacaggcttgagccaccacacccagcacagactgggtaatttataaagacaataaatgtttttcccacagagctggaggctgagaagtccaagagcatgacactggcatcttatgagggcctggctgcagtatcatcccatagtgagaggtggaagggcaaagaggctgaactgatttctatcatgccatacaatggcattaatctattcaatctaatcaaccctgaaaggtcccacatcggctgggcacggtggctcatgcctgtaatcccagcactttgggaggccaaggcaggtggatcacctgaggtcaggagttcaagaccagcctgaccaatatgatgaaaccccgtctctactaaaaatacaaaaattagctgggcgtggtggcatgtgcctgtaattccaactactcaggaggctgagacaggagaatcacttgaacatgggaggcggaggttgcagtgagctgagattgtgccattgcactccagcctgggcaacaagagcgaaactccatctcaaaaaaagaaaaaaaaaaagtcttgcatcttaataccattaggatagcaattaaatgtcaacatgagttttggtggggacattccactttagcactaggtattctggtttatgtatttttttagcttaattccttcatttctacaattatgagatccacgattatccactatatttggttttctttctttttggttttgttttttgttttttgagacaagagtctcgctctgtcgccaggctggagtgcagtggcatgatctcagctcactgtaacctctggctcccgggttcaagtgattctcctgcctcagcctcccgagtggctgggactacaggcgtgcaccaccatgcccggctaatttttgtatttttagtagagacggggtttcaccatgttggccaggatggtctcgatctcttgacctcatgatccgcccgcctcggcctcccaaagtgctgagattacaggtgtgagccactgcgcctggcctcatccactatatttgaaccgacccaaaggccagtgctttcttaattaagttcccacaggtgaacaaagccaaaattcagattctattttatttatggtttagaattacctactgtgaaaaaaaaaaaaaactagctactataaattattgggggttagtccatttagtccattttggagttcataacctaaagcagaaactcacatggttgaaatgtcactttcccaaaggattgttattagtgtatcatttagattgtcttgcaaaagtctcatttgttgttttttctaaatggctgctaatcttttaaattaacagatagagggccaggcacggtggttcacacctgtaatcccagcactctgggaggctgaggcagtcggatcacttgaggccaggtgttcaagaccagcctggccaacatggtgaaaccctgtctgtactaaaaatacaaaaattagctcggcatagtggcacacgtctgtaatcccagcttcttgggaggcagaggcataagaattgcttgaacccggcaagcggaggttccagcaagcagagattgtgccattgcactccagcctgggtgacagagcattgctctgtccacctcccaaaaatgtagttaattttttttcttttctttttttttttttttttttttttttttttttttttttgagagacggagtcttgctctgtcgcccaggctggagtgcagtggcacaatctcagctcactgcaacctccgcctcccaggttcaagcaattctcctgcctcagcctcacaagtagctgggattacaggtggctaccaccacgcttagctaattttttgtatttttagtagagacggggtttcatcatgttcgccaggctagtcttgaactcctgaccttaagcgatccccctgcctcggcctcccaaagtgccgggattacaagcatgagccactgcgcccggccaactttcaatgttaattagttgtggtttgtttaaccatatactgcatagtttcgcttatctataataacagtagtttggggctcttatattctaataattaagactttagctgtgtacacattgcaattaaagtatgagtcatgcataaccttatcaccaagatacaagagggaaagcccttctccccttaaacttttacaaaggttctgggttctttttccacttaagtgggaaaaagtcagctaatgaggaacgtaaagtctttggcctcatctaaaggtgctttggcccgcaagtgtgagaagcactgaccgctgggaagtcctcactgcctggttcctggactcttacaccatggcagaggccatcttccctcccaatgcagagtgatatccagatagcgagctggctagcagctgtccactctccagcaatcctgccttctggggcatggttttctaaggaccttcctgttcctagatgatcaaaattgggaccagccactcccttctgagccactcctgcctctgggcctgtggctatgtcacagtccagtcacaacaggacatcccttcagaacaccctgcaggaagctgacatctctatgcagactcacacatgcacggtgtgtgcacaggcctttggttctacttcaggaggtgttgggggaggctcactagtccaacagaacttgaggccagttgtaccagtgtcatatcccaggagccaaggttacaagggatacaaagtgcccagacctaccagagaaggcaaacccctacagcatgcagggctagacaggggcaagaaacaaggtcattctgggccagcaagaagagggaaagggaaatgacaggcatacctcggagatactgaagatttgtttccagaccatagcaacaaagtgagtcacacaaactttttagtttcctattgtgcataaaagttatgtttgtactatattgtagtctgttaagtgtacagtagcattgtgtacaaaaaactgtgtatatacttaatggagtctcgctctgtcacccaggctggagtgcagtgccacgattttggctcactgcaacctccgcctcctgagttcaagccattctcctgctcagcctcccaagtagctgggactacaggtgcccatcaccatgcccagctaatttttgtatttttagtagagatgaggtttcaccatgttggccaggctaatcttgaactcctgacctcaagtgatccacccacctcggcctcccaaagtgctgggattacaggcgtgagccactgtatctggccatatactttaattttaaaatacttaattgctaaacaaatgctaaccatcatatgaggcttcagctaatcctgatctttttgctgggggagggtcttgcctccatggatcaggggcatggctgctgaaggctgctttgacaacttcttaaaataagacaatgatgtttgccatttgccgcatggattattcctttcaatattgttgtgcctcagggaatagggaggcctggaaagcagagtcgggagaatggccagttggtgaagcagtcacaacacacacatttttccattaagtttgctgtcttatatgagcatcgctcatggtgtcccaaaacaatcacaatagttaacttcagtaactgattacaggtcactgtaacaagtataataatgaaaacgcttgaaacattttgagaattccacagcgtgacatggagacatgatgtctgcctgctgttgggaaaatagcaccaatagacctgtttgatgtgcttgacacagggttgccacaagcctccaatctctaaataaaaaacagcatctgcaaagagcaataaagggaagcacaataaaaggtacatctgcaaaggggaatcagcacttaagcaaggtcaggatgagctttcaagtcaggtggacctagacatgaaccctccaggccctaccaacaaccagctatggaccttcgagcacatccagcctagagctgcccccaacagacacttccccagtgaatgctgaatgaaaccatctgagccagtttcctcaggtgcaaaccagtgaggtaattcctaccttgcagagtgaagtgagaaaagacagtgttaagaaatgccgggtgcggtggctcacgcctgtaatcccagcactttgggaggccaagacgggcggatcatgaggtcaggagatcgagaccaccctggctaacacggtgaaaccccgtctccactaaaaatacaaaaaattagccgggcgtagtggcgagcacctgtagtcccagctcctcgggagggtgaggcaggagaatggcgtgaacccgggaggcagagcttgcagtgagcccagattgcgccactgcactccagcctgggcaacagagcgagactccgtctcaaaaaaaaaaaaaaaaaaaaaaagacacaagacctgtggtagcctttcctttctgtctggcagcagccactgggtaaaccaagatggtgcatacaagtacatccagaagctatggaagaagcagtctgatgtcatgagctttcttctgagggtccgctgctggcagtaccaccagctctctgctctccacagggatccccgccccacccagcccaataaagcacgctactgggctacagccaagcaaggttatgttacatataagcgccacggtggctgaaaatctagttcctaagaaggcaacttaacagcaagcctgtctatcatggtgttaaccagctagtttgcttaaagccttcagtctgttacagaagagcaagctggatgccactgtggggctctgagtcctgaattctcactgggctggttaaagattccacatacaaagtttttgaggctatcctagttgatccattccataacactatcagaaggaaacctgacacccagtggtccacaacaagcatagggagatgcgtaggctatctgcaggccaagagagccacggccttggaaagggctgtaagttctaccacactattggtggttctcgccatgcagcttggagaaggtgcaatactctccagctccacagctaccgctaatgtttgtaaaattcatacctaataaacactagatcaaaaaaaaaaaatcacagacctgtggtaggctgggcaccagtgctctaaagcaagttctgcctaaactggcagggacatttttcacatcaggaacaggagttgttcctggactctgtctggggccaggctgggagagacgtggggcagagtggggcaggggcaggggcagggctgggggctggggcctgggcagggccaggcactcaagtgaggccaagtcctggagcgaaccagttcctggtggccgttggacagctcacacagctccctgccaggtcacccgccatggtcctccctctgccctggctctctcggtaccatttccttcgcctccttctgccctcctggtccttggcaccccagggctcccatgggtgctgctcccaaaaccccaaagcaagcatggaagagcagaccagctccagaggaaatgggaagatgacgtcccctcccagggtaagtggcaccacaggtaggaacagagggtgtgagaatttacactggggtgtgggaaaaaaaaaccctcaatcccaccctgcaccaccccacaccatgcctacccctgcagctcttttcttagttcagctaccaactcctctccccacctcccccagcccagacctcagggttcccttccctcaccccacccccacccacaacagcacagtccacaaagtccttgaacaggatctattccccctcacctaacagttaattatttcttagcggggaggagcagctgatcctctttccagtgaccccatatccttgttcaaggaagccagttacagcccctgggccagggaactctatttgctccccctactaccacccagaggcctatgcccaagacaggaagctacctggccttctcagtacaggtgtccttaaacgaccggttcaaaaacgaatagggaaggtggaatttctcacttccagccacagcctgcaacaaagcttcccagggcctcagccccctgccctggctgatgctccctcccttaattccctgaccagggccctgggacccaccgcacagctgagctggcccgagctgaagagttgttggagcagcagctggagctgtaccaggccctccttgaagggcaggagggagcctgggaggcccaagccctggtgctcaagatccagaagctgaaggaacagatgaggaggcaccaagagagccttggaggaggcgcctaagtttcccccagtgcccacagcaccctccggcgctgaaaatacacgcaccacccaccaggagccttgggatcataaacaccccagcgtcttcccaggccagagaaagtggaagagaccacaaagcgcaggcaattggcaggcagtgggggagccagggctctgcagtcttagtcccattcccctttgatctcacagcaggcagggcacccaggccttataggaattcaccctggaccatgccctaaaataacctcaccccaaatacaataaagggacgaagcacttatagataccacagacacatgtgtttcatttttagttttgttaaaaaaaaattctgacaaatcagaaatgggggttcaggagtggtggtgatgcaaaagatggaagccatggggtgggggctgtcaggggtgggggcagtagtgtctccttcacccccaccctggtgtcctctcctgaaggacagacggtcacattccaaaatgggcgagtcttctaccgtgtctgttcaactgagaagaaaacgtagcatggtcagaataaggcatgaaaaggggaaagtgaggcaggaacacacggcacacatgcagacactggtgtactgcctgggttcagaggacggacgtgggggtgagggaagggatgtaatatgatgagagaagacaagacaccccacataaaggtcagaaaaacatcccaacacagcatcaaagaccagggggcatgaaccagtcaagtgtccattatgcatcagatgcccatgacctatgtgatgggatttcggacaaacacactaaggaacagggaggacctaaagggtttcatgagatcagtactcactgtaggaggagatgtctatctcatcaggcagctcactaatattgacctcaaagcgatcctgcacatcattgaggatcttggcatcattctcatcggacacaaatgtgatagccaagcccttggtgccaaaccggcctgctctggccacctggagggagacagagggtagcactggaagaccgaagaggaaagagacccagaggcaggaatgaagatgtacaaacagaaaacaagggaatgggagagtgggattttttcagcctgtgaggtttacccgatgcaggtaggtgtcagaatcctcaggcatgtcataattaaaagcaatgttcacccgctcgatgtccatgcctcggccaaataggttggtagccacaagaattcgtcgttgaaaatctttaaactgctgataccgagaaagcctttgtgagaaaggaaatttaaaacatgttgagattcccttctctcaactgtctttttctcccaaggacacaaaatatctttcccatcttcagctcacctctcctcctggggcatcccacggtggatggcaatggctgggaagttctgctccactagtagctgggccaaggcaatgcaccgctgcacagacttcacaaagatcaccacctgttgtggggtggggtggggggtcgcaaattgggggaataggggtccatggtgtgtgagagacattacgtgggagaggggagtttctagtaattacgttctcaggaattcctcttcatttctcttattcccccactatatatttagagcagaaaaggaaatataactttacttcagcactgatttttccctaaggaagctggcctctgaggtagcacagagttcagaaatcaaaattgccagacatgctaggagatgaggatgagatcacctcatgaaaaagtgataaaaaactagaattaagatctggaggggtaactgatattcctgctcaccaaaacattaaacctaagggagctatcctaattctagaaagcagttttaaatgcaaatagaccactcacaagtatattaattaaacacttttttgagatggggtctcactctgtcccccagactggagtgcagtggtgcaatcgcaagtcactgcagcctccaccctcctgggtttaagagatccttccacctcagcatcccaagcagctgggaccacaggtgcacaccaccacgcccagctactttttttattttttatttttactatttgtagagacgggcgtctccctatgttacccaggctggtcttgaagtcctgggctcaagcaatgctcctgcctcagcctcccaaagtactgggattatgggcatgagccactgccctgcacccagtcagaaatgcttctcttgaataagcagttattagaggaattaaacattcaagaaccctaacatgcccccaaacatcgtttcaagacttttaacaacttcctaaaatccttcaaggacttttggagacaagatctcactctgttgcccaagctggagcacagtagtgcaatcatagttcactgcagcctcaatttcctgggctcaagctatcctctcacctcagccaccagagtatctgggactacaggcatacaccaccacacctggctaatttttttcttctttggtagtgatgaagtttcgccatgttgccccgactggtctcaaactcctggactcaagtgatccacctccctcagcctccccaagtgctgggattacacacataagccaccgtgcctggccaaggatcttaatttttgaagtttattttccttgaggttattgaggacatacccgtgccagccatagaatagaaaagcagctcccaccttactcatgctcagcccctaagatatttataccctcattattctctcccacatcacacatgtgatttcctcaataaaagtgtacttaatatccaggtttctgctacagctggagtgctccaatgctcatccccctactggacgtctaactgacctggttgaactcaaggacatccagaaggtcaaagagcttccggttcttctcgttgtccttcagtttcacgtagtactgctgcaacccatgcagcgtcaacttcgtctcatcatccacgaagatctccattggctgggggggaggaagggggtggggaacgggaggagggcagagtgggggggttaaacctgggggggtggaggaagttgatctccaatacaccccatggggggatggggaggaaagagaagattgaaaaccccaccccactcccaaaaatacccacattttactgtggtctctctcacattacatctaatttccttcctatcagatgagttttaagactgcccaactaaaaactatcatgggaaagaaactgcaaatgaagtcaaggagcagtgaaaccacccaatggcacagatgccattacctcaaatagaggtgggagaggaaagaaaatgggagatgattctcaaagggagagcaaggaccaaacatctgggaaatgatgggaggcagtgactcaaggtcagaataactccatcagaggtgcttctaagaacatggggtggggggaggacaactgctccatttgattctcctacttcaactaagagaatctcgtgtgcattagcaaagtggatgtcttttaagatcagaatgctgcaatggacagtcaaaatgccacttaaggagaaacaaaaattactcaagatgagttacttgccgtcagaccacaacaggatagttttagatgagactggtctcttgactaagaattaaaccatctacaggtttacaggaaaggtatcagtaagtggtgttaaaataccaaattcagagcagcagatacacttttaagggacaggatctcaccatgttgcccaggctggagtgcagtggctattcactggcacaatcatagcacactatagcctcaaattcctgggctcaagtgatcctcctgcttcagtctcctgaatagctgggactacaggcacacaccattatacctcactgcattcatctttaaaattaaaaaaccccctgaaggggaggaaagtaacaaagacagaaattaccacaactccaaagcccaactttcctaacactttttatactatcctgggggaagatagttaatatgaagacccagaggacaaaataggaaaggatgcgtgtgtcatgggaaaaaaaccagaagcccaatcccagaaggcaggttttgttttttgttttgttttgatacagggtctctctctatcacccaggctggagtacagtggcacaattacagcttactgccacctccacgtcccgggctcaagcaaaccctcctgcctcagcttcccaagtagctgggactacaggcatgcgccaccacgcccggtttttctggtagagacaaagtctcactacactgccccagctagtctcaaattcctgggctcaagcaatcctcccaccttggcctcccaaagtgctgggattagaggtgagccaccaggcccagccaaggcaggctttctaaagagaagttccatggcctccttcaaatctcattctagccccaaatacagctaaagagtgatcatcccacgggaaggaacactgcagggaggggaagaacacactccactgcttatgcaattggccccacctagccccaaaccctaacaaccacccgattacatccactttacctttcctatgtccctctcctctgagtattaaaaaaaacaaaaaaatttttttaagaaaaaaaatctaccaccccattcaggacacccctccccaacacatattgggggaaacggggcacggcacgcgttgggttcaggaaaaaaaccgggaacggaaaaagaggctggtttggtcctcagcttcctggtcaggtttccccgcggcctccgctgccgccatccaccgctgggtgccgtctgcattccctcgccgcgccacggtgcttctctgttgccggctcacatcaaccgaggttccagatgggtgcaaggagatgtgggtgggaaggagtagggtatcggggattgaggtgccaaaggcccccacccctggaggtggggaaggggaggattcatttgtgctgatgctcttcttttggacatgccctgccatctgtctgtccctctcttgctctcctgccaccgggaagtaggagttttggtgagcagaaggctccagctgtacgctcgatgccaccttgagggtgcgtggctgtagggtgcatgtaagagacgatggatgggtgggtggtagggcagaaaaatcctgccctcccccaaagggagaagaggttcaaaaatgttgtgatttatgaaaaagtcgaacactacccgctctcacattaacccgaccaagtcttccggagtttccctggcacccgcgcaggccctaacactagctgtctctgcttctgtatgtctcttcaaggagtcattactcccagttgggcacaagccgccttcttggcacttgaatgacaagggagtctgaggaagagggcgaggaaggggaggaggcagcgggcggggagtggagggagagaaggtagaagggtatttacatcttgcatgaacttgcggcagactggacggatctctttgctcaaggtagcactgaacatcatgacctgcttctcgtggggggtcatgcgaaaaatttcctggacatcccgacgcatgtctacaagaacaaggaaaaaaattgtaggagaaaataagcaggtatgataaacaaagattagaggtagacttcccagtgaggtgaagattgctggaaatagtaacaacacaatggaaagagcaatggacttggaatcaagaagtgggatcagattccagctgtttgttttaaccaagcaagaaataaggtaaaaccccaaagttcccaactatgaaatggggataaagcccagtgcagaggctctcaaggccttcaaaacatgctttatgggaccttctcccaaccctttcctgcccaagccccagccagccttcagcagactacaaatatcaagcacatattatattccagatatcagagtccatctatgactctctggattacttttctatcaagtcaggcaaatatgacatccctacctggagcccacctttatagctcaccatatagaattgccaaagatcatttgtaatgacttatggggcctatgtccaaccccactctcattcaccaagattcaattcttacagaaaaatcttccattaaccccacctggcacactagaataccacatcacacaaactgctacaaacactctctacattaatcccagacctgagtctagacacttattcagctataaattctgactgtaaatgctgtgctggagatgccagaagggtactgtcttctctttcagtttagaatctccgctatgactcccagtatatgaatctataatgaaaacggtggtggtggtgatgacttatgcctaaaattatcaaagtcccctattctcaaaggttaaaaacaaaaatcatagaaagatgatagatgacaccctttactgtgcttaaaagcataataaagaccaaccagggaacccagagccatcagtcatgggtgatagataagagtcgtccttgcactgaggtgctcctgtttcaaataaacatcatttggctccaaagaacaactccccagcattagccaagccccagcactgccactcaccgagctgttcaagcatcttatcacattcatccaaaataaagtgtttaatgtgtttgaggttgaggctcttatttcgagccagggctaggatacggcctggagtccccacgacgatatgcgggcagttcttcttcagcacctcttcatccttcttgatagacagaccaccaaaaaaaacagcaacctgccgagccagaagcaaagagtctcaaaacagaggaaggaaagagtccaatccccccagggttcccactctgtttgagctaaaccaatttttagcatgtttccaaactaaaactaactttagagggcacctaatttaaaaattttatgtcccccccaccaaacactgagggtgattgcctaaagttacatggctagtcggagcagtcaggacaataattcagttctactgacttaatctaaccaacttccttcatttatgaggccaggcttcatttaaaaaataaaggagccaggtgtggtggcacacgcctataattccagctactcaggaggctgaggcacgagaacctgggaggcagaggttgtggtgagccaagatcccaccgttgtactccagcctgggcaacaagagtgatactccatctcaaaaagaaataaaataaataaaaataaaataaagccaggcccagtggctcacgcctgtaatcccagcagtttgggaggtcaaggaaagtggatcacttgaagccaggagttcaagaccagcctggccaacacggtgaaaccccatctctactaaaatacaaaatttacaaatttactactaaaaaacaaaaaatacaaaatttagccgggaggctgaggcaggagaatcgcttgaacccgggaggtggagattgcagtgaggcgagattgagccactgtactccagcctggatgacagagcgagactccatctcaaaaaataaaaaataaataaataaaggacagcaagaaatcaccagattagtgtaaagtaccacaaaaaacacatggaacattaaggtttcctaaataaacccagaatctcaaactcttttcacacaaaccccatgaaattactgcttcgggctaaatattatcatttcatgttaaaaccattaggtgaatagttgtttggggatctgggccttggtacagtatcaaataacaccagaaactactttctggtttcaagggggaaaagaacaactgtggaatcagactgtcacgacgctaatcctatggtaaatctaaaatcattaatgaggccaggtgcagtggctcactcctgtaatcccagcactttgggaggccgaggtgggtggatcacttgaggtcaggagttcgagaccagcctggccaacatggcgaaaccctgtcactactaaaaaaaaacaaaaattagccaggcatgatggcacactgtagtcccagctactcggggggttgaggcgggagaatcgcttgaacgtgggaggcgcaggttgcagtgagctgagatcgcgccactacactcacagcctgagggacacagcgagactccatctcaaaacaaataaataaaaataaaataaaataactaacataagtcgaccagatttgtggcataacaggagatacagtatcacctatgaaggattcttgccaaaaatgcttaacttcaatcagattttttctttttttttgagatgggagtctcactctgccacccaggctggagtgtaatggcacaatcccagctcactacaacctctgcttcctgggttcaagcgattcccctgcctcagcctcccaagcaggtgggactataggtgtgtgccaccatgcacggctaatttttgcatttttagtagagagagggtttcatcctgttggccacattggtcttaaactcctgacctcaaataatccacacgccttggcctcccaaactgctgagattacaggtgtaagccattgtgcacttggccagaatcctcaatattcacacaccactggagctgttttaaagtttccggctttctctgccacataccccaaaattattaaactgatatgattcaaagtcagtataaagtagtaagaaaagggtggtcttgtgttaagcatcatccatagcccaattacgaatcctcctgttacataggaactcaacactctgttacaccacagcaaactaaagcttctccaaaattaaagagactattggcctacaagtttcttatccctccaacttgccacaccctcactctcaggtctctttaccttggcttaccttgacattgggcatgtatttagagaagcgctcatattccttgctgatctgaaaagccaactcccgagtgtgacacatcaccagtacagacaccttaggcaggaagtagacggagacatatggtaaatgtagctcttcattatcccctctagggaagtgactgtcacaaaaacacacctgggccgataataaatgacttcaattatgtgatctaaatcatgaaccccacgcttgcgacagaacatcccccacagctgtcaggttgtcaagggtaacagaggtcatgtgctcatggctctgcaagcatcatgtagctaggacaaaaacacccttcccttatagtcctaaccaaaatcccctccccagcactctccccaaatatacctgcccagtaactggctccagctgttgcagtgtggccaagacaaacactgctgtctttcccatgcccgacttggcctggcacaggacatccattcccagaatggcctgagggatgcactcatgctggactaaaagttggggggggaggaagataaattagacttcagtctccagataactctacctttttcaccatgccaagcccatttcttaccactcaattctcaaagtctagtatttacctggttcttgccaacttccagacccattttacctctctctgctcaattacattcacctcaaaatcagactctcctaattcctcctagctttagcctcctccagatctaggccttcccagtcctagtaacaaaccccttgcatctaccaaccgctcaccttcaatgatcctagctctgtccttatttttcttaatctgtaacaattcatgacatttgaatacctgccacagaccacttctcctgcttaggttgctatacttcgggtcacgtaactactacaaccctggacaaaatgaaggacttggtacctgacccagaagccagtcatctctaaaccagtcatagaggtttccagagaccacagttggcctggcccaacagagggagactacaggtccaagcaggacctttctggaaatttaaaattagaagtcaagtgacaaaattaaaaataagcagacaagaaaagccagtcacaagaatgaatggcagacctggaagtcacttttggatcattagcactttggtgctatcacgaaagaaagaataagcctgtataagcctcctctatccaaaattgtttttgatacttatcccctgattttttcttcctcactgtcgccccggctggtgcacagtggtgcaatcacggctcactgaagcctcaaccttcacctgcttaatttctgaacgttttgtagagacaggagtctcgctgtgttgcccaggcttctcttgcacttttgagctcaagtggccaccctcctgcctcggcctcccaaagtgctgggattacaggcgtgagccactgcacctggccctgatctagccttaagtataaacccttaccaccacctgagcaacgacaaacacatctttgtattgtacccttaaagagcccaatgagcactacatgcccaagagaaaatttaccttctgacggatgctcaaagccacagtcgacaatggcccggagcaactctggcttgagcaggaagtcacgaaagccagagctgtggatggagacataggagcccttgacatccttcttggcaggggcctcagccccatctcccccagctgctgtctccacctcatcatcttcatagtccaagagctcattgtccacatcgttctctgccataactgggccggcaggggaagaagggaagggggatctggatgggttctcgcaaaataggtgaaaacaaggggtgaagagtaggggattgaggaacagcaaaggaaaacaaagatactatttctaacagaagagctggaggggggaaaaaaaaaagcaagacttaatcacgagcacagccttcaccacctcttttccatccccagttcccactttccctaaaccaggaaacttttacctggaaagaaaaacagatacaaaacataaaaacgaaaagcaaatataacagaacagaaaaagcagtaccagggaaagtggttaggacagaggttcccaacaagattagcaatcacagtagcggaaaccagaaaagttggaaggggaagaccaacttataaattcttgatctgaaagtaacagtgaggaaatagaatagataataaaaggtaaaatacgactaataacttagtaaagtggaaaatggagatgacaagtagagtcctgaaaagtcctcaaaggaagactccgctttccctattataatcccaccgttatggatgcctaactcagcagccatcagtcaagggtgatagatgagggtcatcactgcgcaaagcgctcacctttcgaaaagaaaacatcatatggccgccgtccacctcccatagctctcagcctcccacttctcagtatcctcccttccgctgtttaagcaagccttgtgtaattagcatgggggggaggggcggtgcaagacaaatggctcggccacaaaaaaacaaaattcatgtctccaccctacaataagaaagctaataggtgacagagaaaggcaatccccgcccaggctttaacaggatctttaccaagtggtctcacatcactgttacgctacgaaggtgagactccttttggagaaacatacaatgacaccaatcgtatcgtaaacacttggaaggcactccaaattaagttgggcaagtcaaggtgagaaaaatccaactgggcccagaaaccagctcctcctcccagtcccaccgagggccgagaaagagctcaagaaaggacaaggaaggtgagaagagccccgccctccgcaaataccaagaccaagggacgccgagcgccgcctctcattgatgctgaggcctccaatatgagaagaacccattggaagaagggagcaaaacgaacacaatggcgccgaggacaccatcttggattgggtccccccttagcttcccttccttcccccaggagctctttgctctcgaaagggatgcaagctaaggaaatagcgaaccaactaggccccagcgaccagaccatcgcctgtgaaaagggtatcaggaacccatgtgacgggatgggtgcggagaagcgcagatggaaacggattgtagcgaaggccaaagcttacctaaacagggagagcgcgtatggcggcagcaacagcgacgaaggagggaaatctgccttcacttccggttgcaggcttccctctactccagcctcccgccttcttggctgcaagagcgcaggcgcaagggaccggaaacagggccttccgcggttatacagatccgtgcgctccaggcttgcctttggaaaatgcctgtctgaaatttgttttaaaaccgtttctaacttcactgctaccgccagtaacaaaagatataaaggaaactaacgtctcccccccactgttatctttattctcttatcctactcctctccatgcccctcatctcttcgtttaggtttttgccacgcaggtcttctctgtaggcacccctccatggatgcgcgaggaacgagtgtggcgaaggctgcgagttcccacggggtccttggcccggtagtgaaggtgacctgaggactgctgggcacgcactaggaaccggcaggccctagctgaggggagggaggagggaagtctcagggaactggattgctcgggggtgtttcccgactctttcccagtcgtggggctggtgggcggtattttcccaaaaggatgctgtccgaggtagctgatgccctagggccagtgagtcaggaaggtgttctgaatccgagcgggaagacggggtctggattcggccccaagtgttaatagtagggcttgagggttatactacattccattaatactgtttttgtttttgttttgagacagagtctcgccctgtcgcccaggcgggagtgcaatgtcctgatctcggctcactgcaaccgctgcttcccgggttcaagcgattctcctgcctcagcctcccgagtagctaggattacaggcgcccgccaccacgcccagcaaatttttgtttttttagtagagacggggcttcacccatgtatgacctcaggtgatccacccacttcggcctcccagagtgctgggattacaggcgtgagccaccgcgcccggcccattaatactgttaattcgagcagaatgttcttggccccgccccaacagccccattgttcaacctggatttttttcctgaatgaaacatttgctatccccgtctttgagatggggagctacaaaagtaagacctgatgtcctgctgtgtaataaaacaacaaacgtttggccctctccctgttaacatacttaatcatttaatactaaggagtaggtaccgttattctcatcttattgacagaagcgaagcaaagcaacatatctcaagcagtacggctggtgaggttacagccaggatgcaaacatctctcattctctattgtattctgcctccctgctcaaagaatctggttagtaaatacactgcaggttaccttattggttcaaattcttggtgaagtaagcttgtcttcagtgacaaatgaagtaactaattcaagaatggtgtcatagaaggtattttcccaagtatcatttaatttattcaaaagtatttatcaactgcctcccttgtgccacatgttgtcctaggatctggggacacaacggtgaacagccctgttctcacagtgtttacattacaggaaagaaaacacataaacacaaatataatgtcaagtatcgataagtggtcagggtgcagtggctcaggcctgtaacccaacccttgaggaagccgagcccgaaggattgcttgagcccaggagtttcagaccagcctgggcaagtgagaccccatctctacaaaaaattttaaaattagcaaggcatagtggcactcgcccgtaatcccagctactcaggaggctgaagtgggaggatcatttgagtccagggggtcaaggctgccgtgagctggaactccagcctgggcaacacagcaggaccttgtctcaaaaaaccagtagcagtaagtgctatgaagaaaatgcaaggtaaaggggcaaagagcacttgctcctacactccagcttttctctacagttgcgatctatagtcctcagattcccaaatgaggaaccatgtttctcactttagagaaataataaagtactacttgttcttgtttctccaagaagtttcaaaggatagccatttgggctgtttagggaatatgtaaacaaaaaacaagaaagtgactgaaggccaggcacagtggctcacacctctaatctcagcactttgggaggccaaggcaggtggatcacttgaggtcaggagtttgagaccagcctgaccaacatggcgaaaccccatctctactaaaaatacaaaaaatagccaggcgtggtggcacacacccataattccagcaacttgggaggctgaggcaggagaatcgcttgaacctgggaggcagaggttgcaatgagctgagatcacgccattgtattccagcctgggcaacaagagcaaaactccatctcaaaaaaaaaaaaaacaaagtgactgaaaatgagaaatgatgaggcaaaaggaggctgcttcaactcaccaatttatttgccaataattattttattgatactttttttattgttacaatgggaaagtaaggtgtcaaggatatagaaaggaagggcatgcatatgagggaacacagtatcattttagatcttagaaagcaatgagcatctgataagtctttggggaaataggaaaggaggaaaatctaataaagacaaagatcagcaaaagaaaaacaaagagaggctacaaaatgcagttatctacctggaattataagagaggggctaaatgtagtcatctcctctttttggagatcagaaggtctctgggaaaagagaagaaccaatttttcagaaaataactagggtcacagaatgaacaagtggaattagagagccagtgatggacgtgaggaaacagctgtgtaggttttgaccagtgagcaggtggtggtaatagtatcacagggttgctacttactgaatcactgctacaacatgcaaggaactgtgctagactttacagaatgattcctaatcattgaagcaaccctcacaaggtaggcattattatcatcccagtttcacagaggaggacatcgaggctaccaagttaagtagcttgtcctggtttcacagccagcaagtgacagggtcaagagagggacccacatcggccagacactgaagtcaggatgttttccacattcctacttccccatattacaaatttcacagagggtttaggtgagaatgacttggaagtttacaaagtcccagtgagggttaaagaacaacaaggagattcagatgtgagcaggatatttataagtgtcacaggaaaattattggatcctgcctcccaggatttctaggggatggaaagaagacagggattatggtgggaggtgattttgattggaggatttctttgagggagggaactggcagaaggagtcaggccctacggtggccctaggcagaaatccggtagttggggtggacctggggcctgacgtcgcagaccatgccaagaagctgggccaggacacgctctcggtttctctgctgggagctctgcatgccctgcacctggcgccttgtagcctgctccacctcagcagacaggttcccctgggagcccatggcctggggggtagggagaggggtggaagagagaaagggaaaagcagaaacagacaagggtccaggcatatgaggggaaagatcctgaaacaaagcctagaagaaaggccctctcagaaaccacccccatcccacagaaatatcccaacaccaaagagatcaacacagtcccctttccccttagacctaacatgcaacttcatcctaaaacagaccgtaatatccccaccacctcaccatccatgaccataaaactctaccctccaccacaaatgttaatcatactccacatagatgttatactttacacagactgtggcattccgcccacaagctctatgtggccttcaaaactcccagactctcctacatatcatcacaaagtttcaccaatgttgtggtccctgccagggtcccctcagcctcagccctctgccaccatattttcttgttgagtcacccttacacacctcactagatgcacccaccaacttgcagtggggtctcaacccgactctgcctcaactcaccgcctgctgcttgctctggaattcgtgctctcgctctctgcggtattgctccacctccatctgtgcctcctcctttgcctgcttcagtcgccgggccttccctggaggcagaagaaaggacagtgagtggggatggacccacacacacacaatgtaatagcaggagtcagtcccttccagaaagttatacagccttctctcagccaaccaggtgccagattctaatatccatccatttcttccctcctaaccagcctccagaccctagctgtctgtcttcccgccagccttgggttttcccaaaatgtttgctgtcccccacccccaattttctttccaaactcctaagggaggaaagaggagactcactctttctggcatctgccaccttctcagctgcccgcttctcagcttgcagaagctgctggataccttgggactgactggccatttctgttgttatggccgatgctgttttgaatgctgtcaaagtaccagatggctcccaccccccaccgcttacttctcctcctccagctcgttgctgcagtcctccactacccctgggtcttagtgctcccctgctcactcagcctcctgcaccgagtgtctctcccaatctcatcctcctattgatgactggtcctcctctccagcacttcttgctcaggcagtacccaaaggggccgcctgggagcagcagagaccaggcccaaagctgcgggcttacaacaggttagccatcccagtcggaaaggtctagggatgaggcaggggcggagacgggggagtactgaggtgagagaaggagaacttgattggtggtaacagaggaagcataaagggttgtgaatgcggtgaaaaggtaaggatgtcatcatgcaacctgtgttgggaaaagagcattctgggcttaattctaaactaactctctacctttctctctctctccaccatcccgccccctcccctgcctcccgttgttaacatctccatctttttctacatatttctcaagtccaaatttttgcatctcacttgccccatcctacgatagtcttcttccgtcttttgtctgtattttttctttttttttgatctgtccctgttgttgtcccactgtggtttttgtttttgttttccatgtttaatgtgatttttatcctgtctttatctcctctattttctctgtcttctcatcttttcgtccatcactgaaccatctcctctctctgccaagttagaggaggcgggaaaaaacctccaaataactctcttttctccctcccctcccctcgcctccttttcctcgcctccagtccagtcttctggtttcagacggcccctttaatttaagttccctagtttcccctgggagatctggccaagaactacccggtcggggcggaacgacatccggtaacgcccctcacagttcacttccgtcctccacctgcgtctctgcttgcgccatttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccgggtacatgatattcaatttctagatcattattggagattatctgtgactttttaaaactcagatttctgctgataaaaattttccccatccggccctgttgggtttttttaaagttctttgttaaaaattaaaaatttacctgggctcctgagccttaaaccaattatttacccttttctcgaattttacattaaaaaaattaaacctctgatcctatcacccccctcaaaaaaaattttttttcaaatctatcatctgataaaggatcagggttaggttaggcctcatctcttgctgaagatattaaaaaaagacggaaccaaagggagaaacaacaggggatgtcagagatggagggagaaggaccagccaaggctgaagtcctgactgctgccttttttccttccccagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatggtgagtctgctcagtggggaacaaggtcataagcagctgaccagacctgaaatgaaagccaaccaatagttgagaaataagctggttatttggtcatcaggacctagggaaggagttaaccaagttggcatgtggctgtcatttgtccctttacattactgagctaccattgtctgaagaacccaacattccccaaagatcaactggtcttcaaatttcacatctgtttagattagtagctactttgtttcttgacagattgtttgctcgtagccaaaaagtagcatagaaggtaggctctggagttagattgcctggattcaaaccccagctccaaatcccagctccacacttcatagctacgtattcttggacaggttacttgaggcttagtttgcccatgtgtaaaaattaaaataataacaacctttgctatgtgccagacatttcttataaagtaacacatttaatcctcacaacaatcttaggaggtgagtactgatattatcccccatttcccagctgaggaaacagggcatagagaagtcatttgccagagttacagttattcactggtagagcagagattataacccagatggactagatagagtgtccatgcttttaacagctacattgtcctgtgttatacattatagcattgtacattgattgtgcccatgttcagagtacccatgttgtgccatatatgttttgagaatcaactgacatagtacataattagagtacctggcacacacgataagcacttggtatatgctggcgattgttgttcctgtttctctgttttttgtttttgtttttgttttttatgaagtttcactcttcttgcccaggctggaatgcaatggtgcgatcctggctcactgcaacctctacctcccaggttcaagtgattctcatgcgtcagcctcccaagtagctaggattacaggcgcatgccaccacgcccagctaatttttatatttttagaagagatgggttttcgccatgttggacaagctgatctcgaatgcctgacctcaggtgatccaccaacctcagcctctcaaagtgctgggattacaggtgtgagccaccacacctggccttgttcctgtttttgttatcaacaggtccatactcccttaaccacaattctaaactcaaaaacactctgagaaccaacatttttcatcaggctgccaccaaaattcatttggtgacagaaacctaatctgaactaaagtaagactattatttattttcatcctactgatgtcaatattcatacatttccctgcagaaacactcatgtgtttggttcttgggctgcctaggccctcctgggctacctaatatagagtgagtgtacttttaggtcagccctatcaagtcccaaaaacatttgaattctgcaaaacctttggcactgaaggattcaaatggggaacctggtgatattataatagtggtggaggccaggtgcggtgggtcatgcctgtaatcccagcactttgggaggccaaggcagtcagatcacgaggtcaggagttcgagaccagcctgaccaacatagtgaaacccccatctgtactaaaaatacaaaaattagccaggcatggtggcacacacctgtagtctcagctacttgggaggctgaggcaggagaatcacttgaacccggaagacagaggttgtggtgagccgagattgcactactgcattccaacctgggcaacacagcaagactccgtctcaaaaaaaaaaaaaagagtggtggaagcagctctttataggtagagccctgcttactagaataaaagctgaaaccttctttccccatctagagatttccttctggagtaagaacattacaggaaaacctctagatccagatgaacaaccctaacatcccccagctcaagtatagacagaaggcccctcccccaaaactcccccaaatggtcaaaaaaccccctatttaaaaatttcctttaacgtacctgagataggctagcatattcagatttgtttcttgttgtttttacttaaaacagagtaggtttactgagtgcaggcatctaacttgacagctcatattgtaagaggcaggaccctggaaggcaaaagagcggattaccccgaagcagacctgcatccagaccccagctctgccatcaacagggacatgcagcttacctctgtgagcccaatttgcctcgcaaaaatgggagttttgttttttgttttgttttgtttttttgagatggagtttccctgttgttgcccaggctagagtgcaatggcgcgatttcagcccacctcaacctctgcctcctgggttcaagagattctcctgcctcagcctcccaagtagctgggattacaggcatgcaccatcacgcccggctaattttgtatttttggtagagacggtttctccgtgttggtcaggctggtctcaaactcccgacctcaggtgacctgccagcctagcctcccaaagtgctgggattacaggcgtgagccaccgcgctcagccaaaatgcccctgatagtgtggtagggatttcctttattgtttgtttgcttgtttgttttgagacagggtctcattctgtctcccagcctggagtgcagtggtgcaatcatggctcactgcagcctctacctcgtgggctcaagcagtcctcccacctcagcctccctagtagctgggactacaagcacacaccaccatgcccagctaattgtttgtatttttggtagagactgttttgctatgttatccaggctgttctgcatctcctgagttcaaacagtctgcccacctcggcttcccaaagtgccgggactagaggcgtgagccaccacacccaactccattgtattgaattttaagaagctggtgagactgatattatcccatttacagatgaggaaagcagggcccaaaaggttcgggaacttgtctgaaatctcacagctctcaggtcattgtcttccaaagggggacccaagctcagtgccttcactcccagaccctggtgtcctctctggccttatttactcctggtcctctgccagccctgccaccagatggccttctaactccttggttgaaaggcccatctcattcagcttccagcttcctttttcttttccttttgagacggagtcttgctttgtcgcccaggctggagtgcagtggcatgatctcggctcactataacttctgcttcctgggttcaagcgattctcctgcttcagcctcccaagtagctgagattacaggcacacaccaccatgcccagctaatttttttatttttatttattaatttttaaatttttatttgtttatttatttttgagacggagtctccctctgttccccaggctggagtgcagtggcagtatcttgactcactgccacctccgcctcctgggttcaagtgattctccttcctcagcctcctgagtagccgggactacaggagcctgccaccatgcccgactaacttttgtatttttaatagagatggggtttcaccatgttggccagactgctctcgaactcctgaccttagatgatccacctgcctcggcctcccaaagtgctgggattacaggcatgagccaccatgcccgacctaatttttgtgtttttagtagagatggggtttcaacatgttggccaggctggtctcaaactcctgacctcaagtgatccacccacctcagcctcccaaaatgttgggattataggcatgagccaccgtgcccatcccacagaatgtcttttggttttgtttttgttttctgttttgttttgttttgttttgtttgaaaaggagtctcattctgtcgcccaggctggagtgcagtggcacaatctcggctcactgcaacctccacctcccaggttcaagagattctcctgcctcagcctcccaagtagctgggactataggcgtagggactgtaggcgtatgccaccacgcctggctaattttttgtatttttagtagacacggggtttcaccatgttagccaggatggtctcgatctcttgaccttgtgatctgctcacctcagcctcccaaagtgttgggattacaggcgtgagccacagcgcctggccaaaatgtttttatgtttatttttcttagtatgaaactccagcgtattaaagagcattgagaacggttgatctggtaaatcgctataaaggcggcatttctttttttttttttttttttttttttttggcgaagtgggggatggagtctcattctgtcgcccaagctggagtgcagtagtgtgatctcggctcactgcaagctccgcttcccaggttcaagccattctcctgcctcagcctcccaagtagctgggattacaggcgcccgccaccacgcccagctaattttttgtatttttagtagagacagggtttcactgtgttggccaggctggtctcgaactcctgacctcatgatccgcccgcctcggcctcccaaaatgctgggattagaggcgtgagccaccgcgccaggcctaaagggggcatttctaatactggagaaaggtgaacttttttttttttttttttccgagacagagtctcgctgtgtcacccaggctggagtgcaatggcgcaatctcagcttgctacaacctccgcctcccgggttcaagcaattctcctgcctcagcctcctgagtagctgggcacctgccatcatgcccagctaatttttgtatttttgtagagatgggggtttcaccgtgttggccaggctggtcttaaactcctgtcctgacctgaggtgatccacccacctcagcttcccaaagtgctgggattacaggcatgagccactgtgcctgaccaggtgaactattttataaataatattggaacatttggctcatctagggaaaaacaagagtcccacctcacacctaatcaaaaagtaaattccagcagattaaatacctgaatatgacaggaaggtacacaccaaattcatgggacagatggcctggggaggaatgaaacttggaaggcggtatcacggtaaactacctttatctgtgatgattttatttccttaaaataaattatactacaaacatgacagtacattaacaaaccctgtggtaggaatggggttgtgtattgtattatactttgtatttttgagagttttttaatttcttttttgttgttgttgagacagagtctcactctgtcacccaggctggagtccagtcgcgcaatcttggctcactgcaacctctgcctcccgggttcaagcagttctctgcctcagcctcccaagtagctgggattacaggcatccgccaccacgtcaggctaatttttgtatttttagtggagacggggtttcaccatcttggccagactggtcttgaactcctgacctcatgatccacccaccttgggctcccagagtgctgggattacaggcatgagccaccgcgcctggccgagttttttaatttctaaaaataaaaatgagtatacatctaaagtagtagaagaaaatgcagagaatgttttataatcttaaaatagagccttcctaagagtgaagtgaaataaaaagtcagaaaataatatattgatatagatttaactacatgaaaattttaggccgggtgcgatagctcacacctgtaatcccacactttgggatgccaaggtaggcagatcacttgagccaggagttcaagaccagcctgaacaacacagtgagacctggtctgtacaaaaaatacaaaattagccaggcgtggtggtacgtggctgtcgtcctgtagtcccagttactcaggaggctgaggtgggaggatcgcttgagcccaggtggggcagagtttgcagtgagcaagatcatgccaccgcactgcagcctgggcaacagggtgagaccttgtctcaaaaagaaaaaaaaagcttttttaaagatagatagaagaaaatgtttgcaatatgtataacacatacagtatatagaaccctcatatcaatatatataatttccaaagaaaaagtggataaagaatatgagcaattcattcacaaaaaatacaaatagccaaaagacatgaaaaagaaaaaaacattgttaataaaataattttttaatctatccaactggcaaaattaaaagggttgatgatattcaattttggtaaaggaagacataggcacacttgtatattggcacaaacttattgagagcagtttgaccaaattgcgcatgtcctttgactcagaaattccacttatgaaaatctacccccacagaaagactgtaagatactcatgaggctgaacattttttgaaacaaagtctatcgatattggggtaaggagatttgttttgtacacacagtggaacactaattataaagtcgtcaaaaagtatgaggtagactgtatatattcctgtggaaaaatataaatgagatgttaaatgaaagaagcaagttgccaagcaatatttgtagtatggttacatatctccaaataaatgtgtcatatgtatgcttttaggtacaccaaggtgggactggaagggatcacagtacactgttaatagttatcaaatttgttcgtccttctttaaaaagaaaatttcaacttaattatatccctttcacattaaaatgtcaaataaaattgggggaaaagccacctacagccccaccacccataggctagaatttttacatattttttgccagtctattttttttctttttttttttttttttttgagatgggagtctccctctgttgcccaggctggagtgcactggcatgatctcagctcactgcaacctctgccttccaggttcaagtgattctcctgactcagcctcccaagtagctgggattacaggcacatgctaccacgcctggctaatttttgtatttttagtagagacaggatttcaccatgttggccaggctggtctcgaactcctgacctcaggtgatccacccgcctcagcctcccaaagtgctgggattacaggccatgagccaccacgcccggcctctttttttccaaccataggatttggtctcttgttttagacagttattatctgatcctctctctctctctcttttttttttttttttttttttttgagatagagtctcaccctgtcacccaggctggaatgcagaggcgcgatctcggctcactgcaacctccgcctcccaggttcaagcagttctctgcctcaacctcccaagtagctgggattacaggcgtcagccaccacgcctggctaattttatatataatataaaatataattatatatatattttgtttgtttgttttagtaaagacgggttttcaccatcttggccaggctggtattgaactcctgaccttgtgatccattgtcccccccccccagcctcccaaagtgctgggattacaggcgtgagccaccgtgcctggccacatctgatcctctctacagttttgtagccagcttttttcaaacacatgcctcagttgtagtggctgtttaatattatgtttttatagttggaggccctactccttaaaacctatgaatgtaaacctcccatgcaagcctgagcactcaccatgctcaccacctgagctcaggtggggaacaagcgaatgagagacaggaccaggtactttctgggtgggacaagttgagagggtctgtgacaggtcacagcagcactagggagaagtgcccccccccaccaaccctgatgtgatttgggtagggatggtgggccttcgccagccacacctgggccattctgtcttcttgccttcctggccttgccttcccctattccagctttctgccaggtaaacagtactttccagcactaccaaataaagatttaaggactgctagcccatttcctcttaccccggggaaagaaagtaggtccacaggaaggaaggctgcctccctccccttcttctatcccccaagtgaaagaggtggttggtggccacagcaggtgggcctggccaggatgcctgggttggcagtgaaggaagtagcatggcactcagctaaccttgggccagatgcagcaaggttgggactgaagaaaaggggagttcaggaacgtcggttcctctcctgttttctctcagcccatgggtgagaccctctgtcacactccactccctttcccctgccctaggtcagcagtcatttggaaagagcttgctctgccgccggccatagttgttgccggttcacctccccacccctctcccatcatcccctggtaaggctggctgagagaaattcccctgaaaacatttattttactcagtttattgataagtgataataaaagataagtattacatatttgtgtatttattaatggcccagagtagagcattcagatattttcccagtctgatatatggtttcaggtgagaaaataagggatttatatagtgacaatatttttaagtgaaaagtggaatacatagtcaaagaatttgggcactgccttggtggctggaggcaggtcagaaaatgtcagttggcatggtagaacttctaggacgctgaaatagtttgtggagacacaagtaagaatttttttttttttttttttgagacggagtcttgctctgtcacctaggctggagtgcagtggcacgatctcggcttactacaagctccacctcccgggttcacatcattctcctgcctcagcctgccgagtagctgggactgcaggcgcccgccaccaggcctggctaattttttgtattttttagtagagatgggatttcaccatgttagccaggatggtcttgatctcctgacctcgtgatccgcccgcctcggactcccaaagtgctgggattacaggcgtgagccaccgcgcctggccgagaatattttaaactaccacacttaccatgcatgtggtaaactatcagtctgtatttatcagtgatggttatttcctaatacccaggaggcatccatgtgagccacccttccattgctttaagaccaagggagcgagtgaccagcaggattcaagatggcagctctgccgaggagtgggagtcccagctaacttctgctccctgctctcccaccaacagcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgagaagtccactgctatccacagctgcccttccccactggctgctttccatctgcatgaatgcgtcacactaggctcctctgccccctcctctgtgcttccctgcttcttggggcccatcaccttctcacagcctctctccaactacccccatcccaccctcccaaacaggtgatgcctcccatgaaacccaggaacctgagtccttctcagcctggtcagatcgcctggcccgggaacatgcccagaagtgccagcagcagcagcgagaagcagagggatcccgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctcactcccagtgtctcctctgtctttttccattgctgtggttttcatcacccatgacatctcctttcccgccccgcctgctgaaacccacagctcccacacacctgcaacacacacgcacacgctaacacgggctctgagctggaggcaagaagcctctgcatgccccctcagttcagccctaagaaggcccagtttgccatccagtctcactccactccctacactggggtcttgtccaccctgcaatctgtggctggagaaatagatgcgaacagaggcaaaaaggggaacaaaaccagtttccctcccctccctggctccccaagctgaaccacatcctcctccccacttaacacccccttcccccaacacagggctttccctttgctgagtcactgaatgagcgagttgggggtagccggcgctggggggccatgaggaggctgggggaggatggggaatacaagcagaatggctggaggaagagccctgtgggggagtggaatttcagttgctaaaattaggagcaggggaaggaggtggaaagagcaaaattatgtaacatgggttgtctgttcttgggcaactggagctccacacccaaagccagccaggctgctggctccatccatctctgccctctagcttgtcagttgtatctctcttcctccagggccccaatcctcatctccgccattcagctgctgccccatcctaaacctgagttcatctctgggcagcccaggcatggccttccctataaacatttccttttccaagaaccagtagttgaagtcctgagaggtggagggagagtctgggattcccacggaggagagaggggggctccctggaaactaagataggtagaccccactaccatcgcccaggacacaactgggaacttggcaaaaagaaaggacagggctgcaaggagagtacagacatgtgctggtgagtgcactgtctgcatagttacaccagagcatcttatcaatcagaaacttatctttcaggttttgagcccagttctctacaggagaatcccaggagtggaagtggaaggcagtagaagacagggagggcacgcctctgggaacacgggaacatgggtgggcatgagatccttgaataagacagcctgaagttcggaagagaccaaggcctctgaaggaccaggcagatgttcagggtgcaggagggggaagggctggtgagaaagatcctgtgagaggaagctgctgtgattcagagaagagacttcaagctgtgtgtgaccctggcgtccggttcctctcacaggctggagcttttcggaagtggcatgcaaagagtccaggtttggccttggggggagttggggttaggatccctaagctggaggttgagaagtaaattacagaaaactctggtgaccaaatttgctcctccacccaggagatttctcactggtttttaagcacatcatttccccttctgcaagagttacataaaaccaaagcaaaataagccctgaaacctgggcccaccggaccacagtcttttcaacgtcccttcctggtgtctggcccccagccctggtgggggttcccctgagataagggctgttcactttctctgaccacatggtttccgcttctgtgtctcttgtttcctaggctgataaaaatactgagccctagaggccctggcttcctctgaccccttggggcaggcagcaggcatcctgtccagcatggtgggggcagggacaggggccagggattcccaaggggtgactcagtgcctgccatgaaacagtgggtaggtggaagtgtatctctgctctctagagctggcaccaggagttgagtctcagtggaggatgcattgggattcaattggaggaacaggcctggaaaagaataatgagattgaagagggtcagtttgaggactcaggttggggcaggtttggattaagttaggaaaaggatctgggagggactctgttcagtgtaggtcaactgagcattatgtagcccaaagataaatttaaaccctgcttcaagcttacaatctagtggggaggcagacccatacctagttaactgattcaaggcatgatgagtaaactttaagatgattacagaaagaggggagattaagtccatttgaaagcatccagggagcctctgaggagacagcatttgaacttgctctaatgaatgggttcactaggtggaggtggatggaaaggttccataggcgaataacacgtcttgagcgagcctgacaagtcagaaaatgcagtatgttctgggaaaggagcgtcctgagggagaagaagcacaggtgtgagggaacatgtgatgaagaaaggaccacagaaagtcaaggtcagagattggactgcatcctgtgggcagtggtccaggtgacgatgaaaaagagggagaacaggtgagtgctgcagtacagacaaggagtaagaaaacggccatcatcttgtgaattaatacctactgtgtgttaaccagcccttttcctaacaccacaaatcctctcaacgtctgtccaaaaggtgggtggtggtggccaggcacctcactcctgtaatcacagcactttgggaggccaaggtgggagcactttgggaggatcacttgaggccaggagttcgagaccagcctggccaacatggtgaaaccccgtctctactaaaaatataaaaactagctgggtgtggtcttgggcacctgtaatcccagctactcaggtgtctgaggcacaagaatcacttgaacccgggaggcagaggttgcagtgagctgagatcatgcctctgctctccagtctgggtgacagagcaagactctgtatccaaaaaaaaaaaaaattattaagcacctattaggagcagggcactgcttgacaataggtataaataataaagtcactgccttcatagaacttgcagtctaatgagacagtatacaaataataactatacattatagttataatgtataggtatgcctgcttagggtaataaagtgctcaatgaaggtttgaggtaccagcatgactctcaggtggagatttccagaaagcaggtctggagctcaagagaagttgggtctggaggaacagatttgggcatcattcccttcccagtagaggttgagcctttgagtggacaggatcttcaagggagggggcggagtgaccagaagagccctgagcatgatcaaaggaagagaaccaataaaggagaggttggggagcagtcagagaagcagggcacggggggcgggggatgccaagcagagacagggcagccatgtttgaggcttcaaagaggtctagtaaatgagggttgaaaagattgttgggttcaggaactagacgattacaaattttgagaaaaccgtttccatttaatagaggggcagaaatcactttacataggttgaggaatgagtgggaggtgaggaaaaggaggtggtgggcatgaggtcagaatggtgaacacagaataactgagaatcatctcttagttctacccacagattttacagttgagggaaattttaccagttcctgaaaaagtggttcgttaagggggctagtcttttgagacatcacacgaaaacggaaggtgagatagactggacatttgagggagaaatattccaaggaaggatcttttttgttgtttattttcaagaaataaaattgaaggtaaaatgaagatgcttaaagagacaaagataggccaggtgcagtggctcacacctgtaatcccagcactgtgggaggccaaggtgggcagatcacttgaggccaggggttcaagactagtatggccaacatggcaaaaccgcatctctacgaaagatacaaaaattagccaggcgtggtggcacatgcctgtggtcccagctattcactgaggtgggagaatcgcttgaactcaggaggcagagggtgcagtgagccgagatcacaccactgcactccagcctgggtgacagagcgagactcagtctcaaaaaaaaaaaaaaaaaaagcccaggtgcggtggctcacccttgtaatcccagcgctttgggaggctgaggtgggcagactatagatatcaggagttcaaaaccaacctagccaacatagtgaaatgctgtctttactaaaaatacaaaaattagctgggcgtggtggcacacgcctgtaaccccagctactcaggaggctgaggcaggagaatcacttgaacccgagaggtagaggttgcagtgagccgagatcgcgccactgcactccagcctgggcaacagagcaagcctatcccaaaaacaaacaagaaagggagagatagtgaaaacataagcaagaagtggggagagaatatagtaaagatagaggaagtgggatagagtacagataaaaggatcagtcttggaaacaagaaaaagtactgtgagtcagtatgtaaggaaagattaaatataacaaaattaaggaaaaagagggaagtgagatccacacttgatggccttaagctcaatgaaatattaatagatgagagtgaagaacatcagaggcacggagatttagaacatcacgcacagtagtataatggggagtcaacaaagaatgagtaaaagttgtgtccaagaacactgatgactctctgagattagctggccaggattagttataggcctcttatggtgactcagctgtctactgcagcgcttggcagcctaagacaaagccccaagaatgagaccacttagtttacccaagtcaatttttgagacagagtttcactcttgttgcccaggctggagtgcaatggctcaatcttggttccctgcaacctctgcctcccgggttcaagcgattctcctccctcagcctccagagtagctgggattacagttgcccaccatcacgcccagctaatttttgtatttttagtagagatggggcttcaccacattggccgggctggtctcgaactcctgacctcaggtgatccgcccaccttggcctcccaaagtgctgggattacaggtgtgagctacggtgcccggcggtaagagattctaaaatgcagacaaagtggagttgaaattgttgaccatgcagtacatgttaaatcaacaagcaaaaccaggaaagcagaagcagccggaagtcttggtaagaataaagaactgattcaaggggaggcagagagtgggagatgtgaaaagtgagtggttgtgatgagaagggtaattcagagatcaagatcttgaaggcataattcttccaagtgatgctggggtttgaggtacaaccttactcctgggtggctaaaatggaggagggaagaagaggctgtaaaaccagtagacttgagaaacttggagaattgagaggccagactgtaagactcatctgatctgtgtggcttctttttttatttttatttttttcctctgagacgaagtctcgctctgtcacccaggctggagtgcagtggtgtgatctgggctcactgcaagatccgcctcccgggttaatgccattctctcgcctcagccttccgagtagctggggctacaggcacccaccaccacgcccagctaattttgtttttgtatttttagtagagacggggtttcaccttgttagccaggatggtctcgatctcctgacctcgtgatccacccgcctcagcctcccaaagtgctgggattacaagtgtgagccactgcgcccagccgatctttgtggcttttaaagtcactaaagatggtggtaggaggccgggtgcggtgggtcatgcctgtaatcccagcactttgggaggctgaggcgggtggattgcttgagctcaggagttcaagaccagcctaggcaacatagcaaaaccctatctctggaaaaaaaaaaaaaatacaaaacttagccgggcacggtggtatgcgcctgtagtcctagctactcaggaggctgacgtgggaggatcacttgagcccaggaggtcgaggctgcagtgagccaagatcacgccactgcactccagcctgggtgacagagcaataccttgtctcaaaaaacaaacaaacaaggatgatggtagggataagatgtggagaaagactgagctagttatacaagttgttaagagcataataaatattttgatggataagattgtgctgtgaagacaggaaaagcatggcaaatgcaaaaggcacgtgctttgggagatgaggaggagtttatcagtggtctgggggagagaaaataacgacccctctcttctgccttcattcccctagtgatggaggtcgaagaaagagcaaccttcaccacagagaggagtagcatcattaggggaaagccaggtttcaaaatgcccagaggaaaatgctttcaaacatagaagacaggatttgaaaatgtgaagagttccaccaaatattgtgaaatggattggtagaagggtccttgtggggtagggaattgaatccagggaggttaaatcccagtgggaattcagaagactaagtctggagagtttagcttctaggagcaggaggttgttgcctctggaattcagaatggaagatgcactgcatccattgtgaggggaaacaagtgcctcaaaggggtcttatagggatgcacaagataagttccatggctttaaacaccatcctcatgctgaccatgcccaggtttctttctctagcttggaccttgcccctgaaatccagatgtgtatctgcccagtggcatctctacttgcatgtctaatagacttagacttaccacacccaaaatagaattttttagtttttccatccatcagaatcctgcttctctcccagtatctacatctcccacccatcaatccatcatctagtcctgttgtttctacccctggaatgtataatatatcccaaacttgtctacttctctccatctccatggctgccactattttctcttcaccatcaatgccactgccacctgtctcctaccagccagcctaaacacaggagccacagtgatcttttaaaaacaagtccaggctgggcgcgttggctatgcctataatcccagcactttgggaggccgaggtgggtggatcacgaggtcaggagttcaagaccagcctgcccaacatgatgaaaccctatctctactaaaaataccaaaattagccaggcacggtggcgcatgcctgtaatcccagctactcggggggccgaggcaagagaatcacttgaacctgggaggtggaagttgcagtgagccaagatcatgccgtagcactccaacctgggcaacagagcgagacgccatctcaaaaaaaaaaaaaagtccaggcaaggctcagtggctcatgcctgtaatcccaacactttgcgaggctaaggtgcaaggattgcctgaggccaagagttgaaggctgcagtgagctatgatggtgccattgcactccaacctgggcagaaaagtgagactccatctcttagaaaaaaaaaaccaggccgggtgcagtggcacatgtctgtaattccagcacttcgggaggctgaggcaggcggatcacttgaagtcaggagttcaagaccagcctggccaacatggtgtactttctatactaaaagtacaaaaattagccaggcatggtgacatgcacctataatcccagctacttgggagactgacataggtggattgcttaaacctgggaggcagaggttgcagtgagccgagattgtgccactgcactccagcctgggtgacagagcgattctgtcttaaaagaaaaaaaaaaaaaaaaaaggctgggtgcggtgtctcacgcctgtaatcccagcactttgggaggccgacgcaagtggatcacctgaggtcaggagttcgagaccagcctggccaagatggtgtactttctctactaaaagtacaaaaattagccaggcatggtggcatgcacctataatcccagctactcaggaggctaagacaggagaatcgtttgaacccgggcagcagaggttgcagtgagctgagattacgccattgcactccagcctgggcaacagagtgagactccgtctccaaaaaaaagaaagaaaaaaaatccagggccagtgtggtgactcatgcctgtaatcccaaaactttgggaggctggcccagcatggtggctcacacctgtaatcccaaaactttgggaggctgaggcaggcggatcacctgaggtcaggagtttgagatcagcctgactaacatggtgaaaccccatctctactaaatacaaaaaattagccgggaatggtggcatgcacctgtaatcccagctacttgggaggctgaagcaggagaatcgcttgaacccaggaggcagaggttgcagtgagatgagatcagtcattgcactccagcctgggcaacgagcgaaaccgcctctcaaacaaacaaaaaaaaactttgggaggccaagatgggcagatcacttgaaaccaggagttcgagaccagcctgagcagcatagaccctgtctcaacaaaaattttaaaatattttttaaaattagccaggcacagtggcacacacctgtagtcctagatacttgggaagctgaggtggaaggatgacttgagcccatggttttgaggttgcagtgggctatgatggtgccactgcactccagcctaggccacagagcaagacaccatgtcaaaagaaaaaaaaatccaatcacctctgctcacctccctctttctctctctctctctctctccctccccctctctcccctgcaacacacacacacacacacacacacacacacacgcacgcatgcacgcaccacacactctgacgacctttaaaggcttcctgtggctggatgaaatctagaggctttacccttcttgcatggccctgcatgacctggcccctgccctcctctctgacctcatctcccacccgcctcccagtctctctctctgctccagccacactggccttctgtttgtcgtcaacacccccagcttggttccgccttccagcctttgcagtagctgctccctttacctgaaatgctttgctcccaaacttttacctggtcactattttttgtcatttgggtctcagctccagtgccacccaaacactcaaagaggattttgctgactactgtatttaaaagtagctccctgccactcttacaacatcagcctgtcttattttctcatagtaccaatttcttcttcagtttctttcttttccgtctggcctcactggaatacaagctccacaggtgctggtaccttctctgatccctttgcctccatgtccctcctgccttaggacaatgcccagcatgtgttaggcacgcagatactcactaaatggaggaatggatgaataattcataaagcaggataaagttcaactttaggcttgtggctcagattggacttacatttagagtcagatttaagtttagtgttaggagtggtggtaaactggtttcaagattagccctagaaacagggttgggttggggtagaggagaagttttatttagggggttattaattgggatgtgtttagatttaaggttagggttacagttggggttgagtttgagttgtgatttgggttgaggttaaatttgggttagggttgatgttggtattaaatcccaattcaggttttgaggctaagttcaagtttgaagctaatgtcatttcagtctcatttggaggcttcagagatttcactagtttctccacaaagaccactataaagactgtatttccctgagtctggggcacaagactccagtcatcagctctcccacccagggaaagtcccaaaccaactgctggcctgcccaagaaagaaaccaaattcatacaacctccgaaactgagattgaaaccaagattggcccatctcaaggagcatccttcgcatatctcacatgcacgtgacactgagcctcagcccagtcttacccttccttcctctgtgtctctcatgtctccccatcacccttcttgccttcccttttttgtctttcaatgtcccattcttcctctttaatttaaatttctctctgtgtctcactgttaattgcaatacctttttttgtttgcttgttttgttttgttttgttttttggtttgtttgtttgaaatggagtctcactttgttgcccaggctggagggcagtggcacgatctcggctcactgcaacctccgcctcctgggttcaagcagttctcctgcctcagcttccctagtagctaggattacaggcgcgtgccaccatgctcggctaattttttgtatttttagcagtgatggagtttcaccgtattagccaggattgtctctatctcctgaccttgtgatctgctcgcctcagcctcccaaagtgctgggatgacaggcatgtgccactgctcctggccttgtaataacattttatattttaatatagctcagctggggtcccagtccatcagctcataccattagagaagcagaaagagacaacaggaagcaaaaaggaccctgagagaaagggcaacacagagaaaaagaaaggagcaggggctaaaagggaaacccacactgacacaagagataataaggttaaaagaatgagaagaaggttgggcgcagtggctcacgcccataatcccagcactttgggaggccaaggctggtgggtcacctgtggtcaggaattcaagaccaacctggccaacatggtgagaccccgtctctactaaaaatacaaaaaaaaatttggcgggcttggtggcgtgtgcctgtaatcccagctactcgggaggctgaggcaggagaatagcttgaacctgggaggcagaggttgcagtgagccaagatcgtgccactgcactccagcctgtgcgacagtgagaaactgtctcaaaaaaaaaaaaaaaggaaaagaaattttctgacctatctcatctgatagtaggttataagaccctcattccagaagaggttctgccctatacctgggaggaaggaatgctgtacagagagaccaagaagaatatggccaggccttgctgggatccccccagtcccagtctgtgaccattagatgatactccttttgttcaattacatttctgcacagctgttcattcttcatcaaatctaagcataaaaatagttttcccctgggtccttgggtcttcatttctgaaggctcccatgtcacctaaaactttgattaaataaatgtattatgcttttctcttgttaatctgtcttttattataggagtattggccataacccttatgatgggtcaggaagggatcacccctttctgcccctacagaaataatagctaagactagtaaagcataaaaggcaaaggggcaggtcctcaagtagagaagaacaggagaaatagctcatacacacccagaatgttacttacatgtccctccatgttacaccaagacccctcagggaccttgtgcctggggagagaagtggtctgccccatgcaacagtgggctttaccccgggtcaccaccagccccagctccaacccctctaacactctccaagtaaaatcacatcagtagcagtaataatatttgaggtgacaagttggtattatctcaaacttaggaaaagtgaataaagtcatctttagaaactgctttttttaaaccttgtaacttgcaagctaagtgaaaatgggctcatgtatgagaatgttcgtgttagacattttttgtgttagacaaaaactagaaacaaaccaaatccccatcaacagaatatattagaatatattgatacaatagaatattacatcataattttttttaaaaacattactgatacatacaaccacgtatatgaatctcacaaacataatgctgactgaaagaagtcaaacagaaatgagtacattctgtgtgatttcatttatatgatgccccaaaccaggaggaaataatctatggtgataaaagtgagagagtggttggttatctttggagggtatcagcagggagggggcatgagggaacctgctggggacctgaaaatacgtggagctgggtggtggctacatacagatggaaaaattcatcagctgtacacttaagaggtgtccacctcatacctaagttacatatcaataaaaaggaaaaaaattttggaaactttttttttttttttttgagacagagtcttgctctgtcccccaggctggaatacagtggtgcgatcttgactcactgcagcctccgcctcccaggttcaaataattctccagcctcagcctcccgagtagctgggactgcagatgcgcaccagcacgcctggctaatttttgtatttattatagagatggggtttcaccatgttggccagctggtctcaaactcctgacctcaagtaatccgcccacctcagactcccaaagtgccaggattacaggtgtgagccactgcaccaggcctggaacaattttaaaataatgtattggctctgcaaatgcagcttcagaacaagtcccttagctgtccccaccccaccctaagtcaccacccttaagcctcacccatgtggaattctgaaacttcctttgtagaaaactttggaaggtgtctgccacattgatcctggaatgtgtgtttatttggggttatataaatctgttctgtggaagccacctgaagtcaggaagagatggagggcatccttcaggagtgagatgagacctcatcatacttgactgtccagcatcatctctgagtaaggggaccaaaaaatttatcttccaaactaggacactttcaagagtggaagggggatccattaatattttcacctggacaagaggcaaacaccagaatgtccccgatgaaggggatatataatggaccttcttgatgtgaaacctgccagatgggctggaaagtccgtatactgggacaagtatgatttgagttgtttgggacaaggacaggggtacaagagaaggaaatgggcaaagagagaagcctgtactcagccaagggtgcagagatgttatatatgattgctcttcagggaaccgggcctccagctcacaccccagctgctcaaccacctcctctctgaattgactgtcccttctttggaactctaggcctgaccccactccctggccctcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccgcacagcaggtgaggctctcctgccccatctccttgggctgcccgtgcttcgtgctttggactaccgcccagcagtgtcctgccctctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatgattcctctctgttcccttcctgtctctctctgtctccctctgctcaccttggggtttctctgactgcatcttgtccccttctctgtcgatctctctctcgggggtcggggggtgctctctcccagggcgggaggtctgtcttccgccgcgtgccccgccccgctcactgtctctctctctctctctctttctctgcaggttctccccatgacaccacctgaacgtctcttcctcccaagggtgtgtggcaccaccctacacctcctccttctggggctgctgctggttctgctgcctggggcccaggtgaggcagcaggagaatgggggctgctggggtggctcagccaaaccttgagccctagagcccccctcaactctgttctcccctaggggctccctggtgttggcctcacaccttcagctgcccagactgcccgtcagcaccccaagatgcatcttgcccacagcaccctcaaacctgctgctcacctcattggtaaacatccacctgacctcccagacatgtccccaccagctctcctcctacccctgcctcaggaacccaagcatccacccctctcccccaacttcccccacgctaaaaaaaacagagggagcccactcctatgcctccccctgccatcccccaggaactcagttgttcagtgcccacttcctcagggattgagacctctgatccagacccctgatctcccacccccatcccctatggctcttcctaggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaatgctgtctgcttgtgtgtgtgtgtctgggagtgagaacttcccagtctatctaaggaatggagggagggacagagggctcaaagggagcaagagctgtggggagaacaaaaggataagggctcagagagcttcagggatatgtgatggactcaccaggtgaggccgccagactgctgcaggggaagcaaaggagaagctgagaagatgaaggaaaagtcagggtctggaggggcgggggtcagggagctcctgggagatatggccacatgtagcggctctgaggaatgggttacaggagacctctggggagatgtgaccacagcaatgggtaggagaatgtccagggctatggaagtcgagtatggggacccccccttaacgaagacagggccatgtagagggccccagggagtgaaagagcctccaggacctccaggtatggaatacaggggacgtttaagaagatatggccacacactggggccctgagaagtgagagcttcatgaaaaaaatcagggaccccagagttccttggaagccaagactgaaaccagcattatgagtctccgggtcagaatgaaagaagaaggcctgccccagtggggtctgtgaattcccgggggtgatttcactccccggggctgtcccaggcttgtccctgctacccccacccagcctttcctgaggcctcaagcctgccaccaagcccccagctccttctccccgcagggacccaaacacaggcctcaggactcaacacagcttttccctccaaccccgttttctctccctcaaggactcagctttctgaagcccctcccagttctagttctatctttttcctgcatcctgtctggaagttagaaggaaacagaccacagacctggtccccaaaagaaatggaggcaataggttttgaggggcatggggacggggttcagcctccagggtcctacacacaaatcagtcagtggcccagaagacccccctcggaatcggagcagggaggatggggagtgtgaggggtatccttgatgcttgtgtgtccccaactttccaaatccccgcccccgcgatggagaagaaaccgagacagaaggtgcagggcccactaccgcttcctccagatgagctcatgggtttctccaccaaggaagttttccgctggttgaatgattctttccccgccctcctctcgccccagggacatataaaggcagttgttggcacacccagccagcagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagaggtgagtgcctggccagccttcatccactctcccacccaaggggaaatggagacgcaagagagggagagagatgggatgggtgaaagatgtgcgctgatagggagggatggagagaaaaaaacgtggagaaagacggggatgcagaaagagatgtggcaagagatggggaagagagagagagaaagatggagagacaggatgtctggcacatggaaggtgctcactaagtgtgtatggagtgaatgaatgaatgaatgaatgaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagatagggtgtctggcacacagaagacactcagggaaagagctgttgaatgcctggaaggtgaatacacagatgaatggagagagaaaaccagacacctcagggctaagagcgcaggccagacaggcagccagctgttcctcctttaagggtgactccctcgatgttaaccattctccttctccccaacagttccccagggacctctctctaatcagccctctggcccaggcagtcagtaagtgtctccaaacctctttcctaattctgggtttgggtttgggggtagggttagtaccggtatggaagcagtgggggaaatttaaagttttggtcttgggggaggatggatggaggtgaaagtaggggggtattttctaggaagtttaagggtctcagctttttcttttctctctcctcttcaggatcatcttctcgaaccccgagtgacaagcctgtagcccatgttgtaggtaagagctctgaggatgtgtcttggaacttggagggctaggatttggggattgaagcccggctgatggtaggcagaacttggagacaatgtgagaaggactcgctgagctcaagggaagggtggaggaacagcacaggccttagtgggatactcagaacgtcatggccaggtgggatgtgggatgacagacagagaggacaggaaccggatgtggggtgggcagagctcgagggccaggatgtggagagtgaaccgacatggccacactgactctcctctccctctctccctccctccagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaacatggtctccttcttggaattaattctgcatctgcctcttcttgtgggtgggaagaagctccctaagtcctctctccacaggctttaagatccctcggacccagtcccatccttagactcctagggccctggagaccctacataaacaaagcccaacagaatattccccatcccccaggaaacaagagcctgaacctaattacctctccctcagggcatgggaatttccaactctgggaattccaatccttgctgggaaaatcctgcagctcaggtgagatttccggctgttgcagctggccagcagtccggagagagctggagaggagccgcattctcaggtacctgaatcacacagccaagggacttccagagattcgggtgtctaggcttcaaatcaccctgtcctaactctgcaacctgaaccagccacttaacctatctatccaatggggataggaatgtccaccacacatagggcatgtgagagaaggcctgacctccatcagaggacctcactcagcccttggcacagtgggcacttagtgaattctggcttccttcaaccagtttccagctgttctatccccttccattctctcagtgggtgaaatcgaagagactgaggacaataaagaacaaggaaccgaactgccggacgtggtggcatgcacctgtaatcctaccactttgcaaggccaaggtgagaggatcgcttgaacccaggagttccagagcaacctgggcaacatagtgagatcctgtctctattttttaaaaaagaatgaaacataggaataagatgtgggtgaaggactcacatgccggcttggtcccactggtctttgtggtgaaggaggggagaggtgagaggtgggtaatccggaaagagaaaagcaccccctccctggatgaaggctcttctggagagagtcaaagacaaataagggtggggcgcagtggctcatgcctgttatcccaacactttgggaggctgaggtgggaggaccacttgagcccactagttcaagaccagcctgtgcaacatagcaagaccttgtttctagaaaaaaaattaaagattagtcaggtgtagtggtgcatgcctgtaatcctagctcctcaggaggctgaggcaggaggatcactcaagcccaggagtttgaggttacagtaagctatgatcatgccactgtacccccgtctgggtgacagaacgagaccctgtctcaaaaaaataataattccaaaaacaaatatggagacggaaattgagcccccctagactgggagcccccactgagttcggaaattaggctttacctccagccctggggtgccaggcaggagaaaaccatgtggtaggctgagggggtagggtgacccattggggtgacctagatagggccttgggtcaccctctgcctcctccagcctgtggctgaaagtcagccatgaagtaatgggggacactgttactcatcccagaagcacccacacttactcacttttgggaagggggacctaaagtgtgaaaaaaaggtgaggattttccgtctcaccctaaatgggacaccctaagtggggcatcggtttttcctcctccccagaacttcctggtgttttcaggcaccacaggctccttcctgccatccccatctctctctaatattctccccttctttctccttcagcctcctcccttcagaccccatgagccttgaattaagctccttggaggagaagagttgactgtcgggtaggagacagagaggccttcaggcagctctagggggagaagtgcggggcccctccaggcttcattcctctgtcatgataggggcttactctgctgctgggcctttctgagtggtgcttgctgggctctgtaatgacccctctcactgttggggggtacccaagagaaaagagtatggtgcagagtctggttgggaccatgtggccctgaaaatcaggatgcctagagaagcttcggagtttgagaagtcccccttcctcccaccctccaactgggctaatggtggggcctggccattcagaggcagggagggggtgggacaggcagaccatcatccctaggagcaaaggccatacactgtgttgtgatgaattgtttcaagcaaccagaagagtactgagaatatttaacccgcacccgtgcacccaccctgaattaagacgtgtgtcgcaactcagcatctttatcggcagcactgaagctttccattctttattttcatcaggttcaaaatcaatttccaaacagtctcctacatttttcccactgccatggggtcctgggcgtccgggcccccaatattcacgcactcgcaccacgcactcatattccctcaccccaccatcacggccccaaagaaggtcttccctctcgcgaagtccaccatatcggggtgactgatgttgacgtacaccctctcgcccctccggagctgcaccaggccgccgaaccccacgctcgtgtaccagagaggcccgtacccttgtctcctggccgggtccagcactggagtcaccgtctcggcgccctcgagcagcagctcgggagtgcccggcccgtaggcgccccccgcccggtacagagagctgcgcagcgtgaccgagcggccctgggggtccccgccgccagggggcgcccggccccggtagccgacgagacagtagaggtaatagaggccgtcctgcgggagcgccagcccctcggcgtccgagaactgcgtcccgctcgtcagaaacgcctgttccttcgtcgtctcccagcctagcccctgccccttcagcggagcgcctgcggagacacgggccgacgcgctcttgggaatgcgatcctaaaggcttgggacttctggggaagtggcggcttttagcccctgcgggagccgagccgggccgggggaggagggatggtgctgtttctgggatgagtgcgagttgggggccgagggaacacggatgtggggtgcagaacgctgtagtggggacctccaggccggcttttgcttgcaccggagggaagaagaaactacactgcggggacgagcgtaagagtgggcacgagcgacaaaaggtcgtgaagcgggtgggaaaccgagcactggaatcatggagccgaaggactctgggcgagcagaactggaaccttcggattatttacactcttattcaggtcttggaggtccttacctatgaggtgggcagctgggagcccggggctgagatctgtttctggctcctcctctggcagcttctgaaaccctggaaggggcaaagagtccacgattgggggcagggcagccacccatgcaggctacccttgagagaacagggcgcagggatggggagcctggattcctagaggaagaggtatctggggacgcagcagggagctgggagcccctgagggtctgaagcggggaaggagagacagtctgctcttacccagtccttgctgggcctgtgccccggggtcggccgtctccgttacctggttgggtggggtcacagtgcccagagttcagattcagctcatgtcacccctacccctctgaaagtggacccaagctgcaggcctggggtttctcctaccagcaccatccccaacacacacctccttagaagggagaacaagcaaggcataggtacttgggcggagaaacagatgtacctcgggaagaggagaggagacacaaggggcttatgtcgggacacaagcacaacatcacaggaacatggaaagagagtcagcaaagagacaagacatccccaccagggacagccgagccagctgagccagagggggcaaaagaccacaggcacaaccagagggagccaagcatccgcaagatacaactctccaccagggcctgttgcagccactcaccagtcctccctgatcctggggcactaaggccagcacagccaggacagtgataggcaccgccagcaacaaggtcaccagagaagtggctcctgccacagctagcaggagggaacccctcccctggagcctcccacccctgccctccagccccagtgcccccattgagactgaaccagagccagagcagggggctttcatacctcagggacgggcccaccccctccctgtagacctgcacacctggctgggactttccgcacacccctgctcccctcacccagcttcctgtttacccagagctggggtggggcagctggatgcctgggttctctgaactggggaagaagttgaggttagggagacaggctctcagggtggaaccaaaggggtctttagacatcttctggctcagcagagagagaaactgaggcccagggagggaaggtagcttgcaggaagccagtcagcagagctgaaatgagaacacagatctccaggtttccaatgtggtttgcattcttctataccctcaaggtaggtgctggaggaagagctgatcccgtctctgaggtcaagggccggactaggacaaggactggaatcttgagggatggatgtctgggttccctgagaagaactgattcccatactgggctgacctcctcccgttcccttgctcatctccagccccctgtgctgagtgagaaagggagaggtaagccttagcctcaccactgactactgactcactaaggagggatggaaatggagctttacctcccttgctacaaaaagtaaagacagatggacgaggcatactcccaccctcagagagcttccaagtctacaatgagccctatccattagtaggtgcttactaaatgtttatacataaatgaataaaaggacaaataaatgcaggaataaccaaaacaaagcagcaaggaccacatgaatggtagatgtaggcagcatgagtggttaagagtcaagggagtagccggggtagtggcttacacctgtaatcccaacactttgggaggctgaggcaggtggatcacttgaggtcaggagttcgagaccagcctggccaacatggtgaaaccctgtctctactaaagatacaaaaagttagccgggcgtggtggcacgcgcctgtaattccagctacacaggaggctgaggcaggagaatcacttaaacctgggaggcagaggttgcagtgagccaagattgcaccattgcactccagcctgggcaacaggctgagactctctctctcaaaaaaaaaaaaaaaaaaaaaaaaagagtcaagggaagaaagaccaggtccaaggaagctggaagtggctccaatcatctccccttcttggtaacatctctatgtgtttccgtaatactaataataatatagctgacccacaaaatgcacttaacatgtttatgccactgatttacacactttaataatttttttttttgagacagggtctcgctatgtcacccagactggaatgcaatggcaggatcatggctcactgcagccttgacctcccaggatctatggattcacctacctcagcctcctgaatagctgggactataggcacatgccaccatgcccagctaatttttgcattttttgtagagatggatttttgccacattgcccaggctgggctcaaactcctggactcacgtgatctgcccgtgttggcctcctaaagtgctgggattacaagcatgagccatcatgcccagccaataattataatcctgacaaaaaccctaagaggaaactgaggtacagagaggttaagaaacttatggagctcacagagtcagtggcagaaccagaatttgaacccaggcatctggctccagagccttgataacaagacagtttaaaaactgaatactggggctgggcgcagtggctcttgcctataataccagcactttgggaggccaaggaaggtggatcatctgaggtaaggagctcgagagcagcctgatcaacatggtgaaaccccatctctactaaaaatataaaaattagcggggcgtggtggtaggcacctttaattccagctacttgggaggctgaggcaggagaatcacttgaacccaggaggcggaagttgcagtgagccgaaatcatgccattgcactccagcctgggtgacaagaacaagactctgtcttaaaaacaaaaacaaacaaacaaaacagtattaggccaggcgagatggctcacacctataatcccagcactttaggagaccaaggcaggtggatcacttgaggtcaagagtttgagaccagcctggccaacatggtgaaaccccttctccattaaaaatacaaaaattagctggatatggtggcacaaacctgtagtcccagctacttgggaggctgagacaggagaatcgcttgtacccagaaggcagaggttgcagtgagccaagatcacaccactggactccagcctgggcaacagagcaagactccgtctcaaaaaaaaaaaagagtactgacttgagatttgtatgtaaaatttgccttcctcaggccagaaaagaaatggggaaataaatactgaactccagtcaatgttaagcttctgaagggtttagatgtaaaatgtactgatatttgtaattttaaaagatatttaaaagtgagatggattgataaatatgtgataaagcaaataaaaaatgttaatagagccaggtgcagtggcccactcctgtaattccagcactttggaaggctaaggtggaaagattgcttgagaccaggagttcaaaatcagcctgggcaacatagtaagaccccatttctacaaagcctcatgtggtagctggtgtctgtagtcctagctactcagaaggctaaggtgggaggacctctgagcccaggaattcaaggctgcagtgagctatgatttcaccactgcacttcaggctgagtgacagagtgagaccccatctcaaaaacaaaacaaaacaaaaaatgttaatagtagcatctaggtggtaagaatatgttcactgtacaattattctcatttcaccctatgtttgcactttttaataataaaatgtaaaaaaaacaaaacaaacaaacaaaaaaccctgaatattattcagcatggggaacatggaggatggggagaagggtgggggaggaagtagaaggttcttgaatttggaaggggaaacgcaaattaatatggacccacccaggcaccacatctcctcctcaccccttgccttacaggcgctccccagtcttcaccctcctcaaggagtgggtgtgcaatcctccagcacccatctccttctccatcacagtgccactaagaagccttcacccaggtctctccagagagcctcaggccgctgcctttacttagttctgtgttcaatgccagaatgctgcctcctacaggaagtccacctgtattgcccacacctcctttcctgtcaccaacttgtcaccaactttctgtccttgatctatccacagggctcatgtagatctagtatggctgcctttaactctcatgtttgttaatcagacagccaagcagcctgctgcatagagctgcagaacaccaagtgggtcaccagaacaccaaatatgccagagctcccagtctgaactggagcagggtacatgtgtccacagacatatgccaagatcaagaggtctcaacagatgcagtgtaagaggtaatagagaagagttaatcaaggaagacacctgaaggtggtgggtgtttgctgactagtggcaggatcagtgaaatgactggagctgaggcagattatggccctagctacaggcccagaagtttgaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctgggtaagctgggaatgggcagggaccttggtggaaggatggtcacaccccagagtggggtgaagctaagatgaggggagggagagtatgggtttgagtttccctgggccgtcgaggaatcctctgagtctctgctccccaaagaaattaaagacaattcatttctgtgcccacggcccttatggcctccacctgcacttctgctccccaccccccagaattcctcttaaacccagaagggtcccagtttccagaccctagtcagtatatctggctctggggtgaagagaacggccccctcttcaccctcaaacaggaaccagtggttggaggggaggaagtgcctgaggggaagttatggggccccagatactcctccatgccccacttcagccctagcagcatctgcctgtgggaagcagctctccacaccagccaagggggcccccacactcccgcgctgctctgcggctcagggagcagcccacctgctgggtgtgctgatatcaccctcccttcttccccccagtgcccacacccacccaggcccaggctccttcccctccatcatccccttaccagcacctagaaccatccagggctgaaaagtcccctccaaaccacgtggtcagcccagggcagaggaaagggctgggctctggagttgggcagagctggccttaaaccccagctccacctttctgggatgggtgacctagtaaagtccaggcttgaatctcgggtctttacttgggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatggtaagtaaagtgtctcttgcatctgcatagagagagtcctgggagcttaggaagtgatggggaacagtgatgtatgcagctcatgactaggtggacaggcctctggggacagctggtacaggagggaaagggacctcacgggaggcccagaaacctggtaagaggtgaggtattaaggtctgggatggagaagctctgagggtatatttttctgcctctaaaactgttggagagggaatctgagaaagctgcaaccaaccaggaggctggggtacgctggagaaggaatgggcttcctaaccttgagccctcttccctgaagatatatgtatctacgggggcctggggctgggcgggctcctgcttctggcagtggtccttctgtccgcctgcctgtgttggctgcatcgaagaggtgagcgctgcactccctccctccccctgcagcagtgccccctgtgcccccacccccacacgctttcccactgctttcccagaacactgcctggccctggagccactgggaagccaacaggggagtccacgcctgctggtggggggagcccgggagggcccgggagaagcacaaagggtgggctgtgttgagcttcttcttttcttccagtaaagaggctggagaggagctgggtgagtctggggacagggaagggggagggcaagagagatcctgagtgggtgagtggggagaagcatggctgagcgctgagaggagggttggggacgggagacaaggagagagaaagtaggagcatgagagaggcagagaaaatcgaggcaaaagagaaagagaaaatgagacagaaaccaagagaaaaagtgagacagaggataggagagacagggagaaaatgagagtgagagagacacaaagagaagagcaatgaaagagagagagagagagaggctccagaaccaggcacagtggctcacgtctgtcattccagctatcgcaaggctgaggcaggaagatagcttgagctcaggggttgaagacaatcctggacaacatagtgggactctgtctccaaagaaaaaagagagagagagagagagagagagagagggagagagagagagagagagggagagaagtaagaaaggctggaggtgggagcagaactcacagggaaggatctgacggcatcgcctcccatcagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccacccactctggggtcaaatagtaatttattgggtgaatgacagtgttcagggacccaagctcccctaacagccagaagagggtatgtgtgggcctggcaggaaagggcagttgccaaggaggagtcatatctgatccttcccatttctcaggacaatcaggctcagcctcctgggactgggggaagcagatgtgctgagctcccacatggtggtgggaggggcgctgggaccacagccggcagctgccttcttggacctttccaggtcagacctggtggaagggaaagttcagagttgggggaatccggagagagtagatttggcatctggagaatggagaagaaaacacttgagactcatgaggagttagtggtggggcagatttattggggtcttttgaagaggactagggacatctgggctctggaatcactcctcggggcccatctgaggagtggcagtgtgttcccatgtgacagtggcctggtcagagagaggacaggagctgctcagtgttgcagtcccgaggctctcctcttcctggtctctgtcctccctcctcccactctcttactgcccctcccatcccgtccactattgcccctggctccattactcacatttgccctggtaatagacggtgctgcccacggccacagagagaaagctgacagcatagaatccagcccgaaggaggaggactgtaccagcccctagctgaggatgttctgcatggggcaatggagacgggggttggggaagaagtgcacacaggctcagggagggaaggggcctcagaggagcatccctgcctcccaaggacattgcctcttggggcctccagccaggaggagacaccacctcccagcatctcacctttctccaccaccagccgagtcccattccctgtcccgacaccaaggcccagcacctccactctgcacacgtagatgctggcgtcatggcctcgcacgtcccggatgtgcagctcagcctggtggtcatggaggaaacgggaagaagcaagtggggccaggcggcccctgaactctggggttccattcctcacctccttccctggaaccacctcatctcggaaccacgtgacggagccaatggccagtctcccttggctggcattgaaggagcagggcaggaaggcagaggatccttccagggtacgaatctcagggggctgggacacccagagagcacaggatcctgggggcagaaggaagacccagagaaacacctccccagttattccaaagagaaaagacaacagagcttggagtagaacatcccagctttctccaggcatagggtgcatgggaatagatactttgggtgcctcattaaacccttccctcttaaccaatctgatttcttaacattgcttattaaatcatttttcggctgggtgcagtggctcacgcctgtaatcccagcactttgggaggccgaggtgggcggatcaccaggtcaggagatcgagaccatcctggccaacatggtgaaaccccgtctctactaaaaaaatacaaaaattagccgggcatggtggtgtgcacctgtaatcccagctactcgggaggctgaggcaggagaatcgcttgaacccgggaggcagaggttgcagtgagccaagattgcgccattgcactccagcctgggcgacaaagcaagactccatctcaaaaaataaaaaataaaaatcatttttcaaattcttcctataccaactctcactctcaccctctgccatcattctccagccagttcagtagtaacttgtctagctgaaatgtaaaccatcatggtgaaattaagctcattaatgaatgcagctgcctagttaactaatatcactcattatattatccaggtattattttagtacaaatggcattgtacagtaagccatccttcctctttttcttttttctttttttgagatggggtcttgctctgttgcccaggctggaatgcagtggtgcaatcttggctcactgcaaactccgtcccctgggttcaagcgatcctggtgcctcagcctcccaagtagctgggactacaggcacccaccaccacgactggctaatttttgtattttcagtcgagacagggtttcaccatctggtctcaaactcctgacctcaagtgatccacccacctcggaccaggctggtctcaaactcctgatctcaagtgatccacctgcctcggcctcccaaagtgcacccagccactcttggttttcgttaaagaaagtaactaattaaatctccaggtgaagacgtggccttaattggttgagattcctatttaacccgtccatgttgatgaattaaaccaaatattaaaatccctgattaaattatctacttagggaaatttacaagtcattctatttcagtggttctcaaacttgagtgtgtatggaaattacctggagcatctgctagaacagattcctgggcctaccccccgagtttttgactcagtaggtctggagtggggcctaagaatttgttctaggttcccagaaatccacattttgagaactcctgcatttagttaataatatgcctgatagttaaggtctctcagttcattaaaaacagtttcggccgggtgcagtggctcacgcctataatcccaacactttggaaggccaaggcgagtggatcacctgaggtcaggagtttgagaccagcctggccaacatggtgaaacctcgtctctactaaaaatacacaagttagccagcagtaatggcatgcacctgtaatcctagctacttgggaggctgagacaggagaatcatttttacccaggaggtggaggctgcagtgagctgagataccgccactgtactctagactggacaacagaatgaaactgtctcaaaaaaaaagtttcaccaccaggcgggcgcagtggctcatgcctataattccagtaatttgggagaccgaggcaggcagatcacttgagatcaggagtttgagaccaacctggccaacatagcaaaaccccatctctactaaaaatacaaaaatggctgggcgcagtggctcaggcctgtaatccccgcactttaggaggccgaggcaggcagatcacctgaggtcaggagttcaagaccagcccggccaacatggtaaaaccctgtctctactaaaaatacaaaaattagttgggtgtggtggtgcgcgcttgtaatcccagctacctaggaggctgaggcaggagaattgcttgaatctaggaggcagaggttgcagtgagccaagatcatgccactgcactccagcctaggtgacagagcaagactccgtctcaaaaaaaaaaaaaattagccaggtgtggtcgtgcgtgcgtgtagtcccagctactcaggaggctgaggcaggagaatcacctgaacatgggaggcagaggttgcagtgagccaaaatcgcaccacggcactccagccaggcgacagagcgagactcagtctcaaaaaaaaaaaaaaaaaagtttcaccaagaaatttatcatagatttacttggatctctcaaactaaaaagcctcacagtgggtgacacagagagactgtgaattgggggagtccactgagtgtcacctttggagcagtcccactcctccctcagagccgtgtgtttcagcccccaccaagcccgttccctatagcatctagtccagcctcctggatctccctcctcccacccacactccttggggtcctgagcgcacgccctgtcacctggatggaccatgatcaagatgagcaacagcatccaggccatgtcggaagatgtcccagttggcgaaggggatctgagcagtgaggtctgggtggaggaggaaggactcactacttgtagccaggcctttggtcaccagatggggatggggagcttcctatgacacacgggactcacacatcacttgccaaggaccacaactgccagggacctcgagcatcaaatgcttgcctccctgaggagagaggacagatgctgctggaggagatgtcagggtctctaggaggccaaggggccagcttgtggcaggctagctaagcgtgtgagggggagggtggggcttagatggctgctaacccaagggtgagtgggcggttgggcgggtgagaccaggatgtgggttcccccaccttccgaggttcaaggagaccagcttttacccagaacaagcctccaggagccctccttggcccagaagctaacctacttaccctccctgctgctcaccagtacccagacccatcccacccattcccttcctggaatctggcctcactgcaccccagggctactccaagatttctatgagggattaggagaagcaagctgattggtgaagctatatttaatttgcatagcaatcaccttgtgtgtgtgtgtgtgtgtgtgtgtgtgtgtgtgtgtgtgtgtgtgtgtgtgtttggttgggtttttttgttttttgttttttttttgagctggagtctcactctgttgcccaggctggaatgcagtggcacaatctcggctcactgcaacctctgcctcctgggttcaagcaattctcttgcctcagcctcccaagtagctgggattacaggcgcacatcaccaagcccagctaaattttgtattttttgtagagacagggttttaccatgttggccaggctggtctccaactcctgatctcaagtgatccaccagcctcgccctcccaaagtgctgggattcctgttttggttttttgagacagggtctggctctgtctcacccaggctggagttcagtggcgccatcacggctcactgcagcctcaacctccagggctcagttgatcctcccacttcagtctcctgagtagctgggactgcaggcgcacaccaccacaccaggctaatttttgtattttttgtagagatggggtctccctgtgttgcccaggccggtatccaactcctgggctcaaacaatccatccacttaggcctcccaaagtgcatgagtcaccatgcctggcgaaatgtatttcttaaataatgagacttgaaagtctaaattactccttaaaccatggactacaggatggatgttatgttagcaggcaggaaaacaacattcagctgggcgtggtggctcatgcctgtaatcccagcactttgggaggctgaggtgggaggatcacctgaggtcaggagtccgagaccagtctgatcaacatagagaaaccccgtctctactaaaaatacaaaattagccgggtgtggtggggcgcacctgtaatcccagctactcgggaggctgaggcaggagaatcacttgaacccaggaggcggaagttgcagtgagctgatatcgcaccattgcactccagcctgggcaacaagagcgaaactccgtctcaaaaaaaaaaaaaaagaaaaagaaaacaacattcgtctctttggacatctccatcagagctcttggataactatgtacattgtcaatgagcagtaatcattttaaagaaatcttgtttttcggagcagtagacctcaacagtaggcttaaaatattcagtaaaccagcggggcatagtggcttacacttgtaatcccagcactttgggaggccaaggtgagaggacggcttgaggccaggggtttgagaccagcctgggcaacatggcaagaccctgtctctacaaaaaaatttaaacttagctggacatagtggcacacacctatagtaccagctactcaggaagttgaggaaggaggattccttgagcccaggagtttcaaggatgcagtgagctatgattttgccactgcatttcagcctgagcaatggagggagaccttgtctctaaataaaatacaatttaaattgggaatagtagtaaatggagtttaaaaaaaaataattttggctaggtatggtgggtcacacctgtaatcccagtactttgggaagcccaggagggcagatcacttgagttaaagagttggaggccaggccaggcatggtggctcatgcctgtaatcccagcactttgggaggctgaggcgggcggatcacgagttcaggagatcgagaccatcctggctaacacggtgaaaccccatctctactaaaaatacaaaaaattagctgggtgtggtggcatctgcctgtagtcccagctactcaggaggctgaggcaggagaatcacttgaaccttggaggcagaggttgcagttagccgagattgcgccactgcactccagcctgggtgacagagcaagactttgtctcaaaaaaaaaaaaaaaaaaaaaagagttggagatcagcct

SEQ ID NO: 323 - DNA, 32230 bp, Homo sapiens
acagcttgaaggagacacagcccaagggctcaccattgacagcgatgttgaaggacacggtggggttgaccatggctgatagtatggggctcctgatggtggcgtctgcaaagccaagacagacactttctatctcatttcatgaggccaggattccatgagggaatactttctaactaattccatgaggccagcattagccaaataccaaaatcagatgaagacttcacaaaaaaagaaaaccacagaccaatatctctcatgaacataggtgcaaaaatcctcagcaaaatgctagcaaatcaaatccacaatgtatgagaagaacaatacaccatgcctaagtaagatttatcccaggtatgcaaagttacttcaacattggaaaatcagttaatgtaatccattaaatcaactggctaaagaagaaaatcacatgatcatatcaatagaggcagaaaaagcaattgacaacatccaacacccattcatgatgattaaaaaaaaaaatctcttagcaagctaggaatagagaagaccttactcaacttgataaacaacatccacaaaacatccacagctaacatcacacttaatggtgagaaactaaaagcttgcctgctaagatcagaacaaggcaggaatgaccctctcaacacagcttttcaacgttgtactggaagtcctagctaaagtagtaagacaagaaaaggaactaaaaggtatacaaatttggaacaagaaataaaactgtctttgtttacagatgatatgattgtctatgtagaaaatcaaaaagaatccacacataaaaaactcctggaactaacaagcaattatagcaaggttgcaggatataaagttaatatgtaaaagccaatcacttttctatgtatcagcaatgagcacgtagaattcgccatttaatttttttttttcaagacggagtcttgttctgtcgcccaggctagagtgcagtggcgcgatctcaactcactgcaacctcctcctcccaggttcaagcaattctcctgcctcagcctcctgagtagctgggattacaggtgtgccccaccatgcccagctaatttttgtatttttagtagagacggggttttaccatgttggccaggctgatctcgaacttctgacctcatgttctgcctgcctcagcctcccaaagtgctgggattacaggcgtgagccaccgtgcctggtccagaatttgccatttaaaacacaataccacttacattagcacccccaaaaatgaaacacttaggtacaaatctaagaaaatatgtacaagatctatatgaacaaaactacaaaactgacaaaagaaatcaaagaactaaacaaatggagagatattccatgttcatagtcaggaaggctcaatactgttaatatatctgttctttccaacttgatctgtggaatgaatgcaatctcaataaaaaacctcagtaagttattttgtggatattaacaaactgattcaaactttatatggtgaggcaaaagacctagccagcacaatataggagaaaaataaagtcaaagaccaccactacctgacttagactttctataaagccatagtaatcaagacagagtggtgattagcatagccattgtgggaaacagtatggaggttctgcaaaaattttaaaaatagaaataccacatgatccagcaatcccactaatgggtatatatccaaaggatatgaaatcagtacgttgagatatttgcactcccatattcattgcatcattattctttttttttttttttcctttagagatagagtctatgttgcccagggcaactcctggcctcaagcgatcctgctgtctcagcttcccaattatctgggattataagcacgagacactgcacctggctgcagcattattctcaatagccaagatatagaatccacctaagtgtccatcaatggatgaatggataaagaaaatgtggtatatataaaaaatggaatactattcagccttaaaaaacaaaatcctgtcatttgtgacaacatggatgaacctggaagacattatgttaagtgaaataagccaggcacagaaagacaaatacaatctcacttatatgtggagtatagaaaaagccagactcataaatagagagtaaactggtggttatcagaggctgggaggtcggggaattggggagatgttagtcaaagaacacaagatttcagttaggaagaataagttcaagagatctattgtaccttatggtgactaaacttaataacaacatattgtgtatttcaaaatagtatgagaatagctttaagcattctcatcacatacacacaaaatatgtatgtgaggtaatgtacatattattaaattgtttggtttatccattccacaatgtgtgtgtatgtatgtgcatatatatataaacatgatgtacaccacaaatgtataaaattagtcaatcgaaaaattaattttagaaagacagagtggcattggcaaagaatagacaaattgatccacttgagcagaatagagagccaagaaatagtcccacataaatacaaggagcaaagacaatacaataaagatagtcttttcagcaaatgctgctggaacaactggacagccatgtacaagaaaaatgaaaagagctctcttaaaaggttactgtgaaagccacctgtgacagtaacagaaagtgcccagcagggtctctgacacttagtaatgtaatctctctcactgtaatgtaatggctaaacttcaacatccctcagcccccatctccataagactttcccatagaggcaacaatgattcctgtcagtcacccagtcctgccaatccactgggtaggatacaatattgaggggcccatcagcacactggccttagggggctctgcagccccttgaccttgtggatgatgctggccttaatctcctcttgtccgtggctaaagacaggccccttctgcggagaccaggccagaatgctcatctgattaagactctatattaagagtcaggaataacaaaaacaacaataaataaataaacacagtaacataatctatgtgtcttagtccgtttcctgccgctataacagaatactacagactgggtaatttattttgttgttttttcagacagggtctctctctgtcgctcagactggagtgcagtggcatgatctcgactcactgcaacctccacctcccagactcaagtgatcctcccacctcagcctcctaaataactgggaccacagacccgcacgaccacaccagctaatttttgtgtttttttgtagagatgggttttgccatgttgcccaggctggtctcaaactcctgggctcaagccttccacccaccttggcctcccaaagtgctgggattacaggcttgagccaccacacccagcacagactgggtaatttataaagacaataaatgtttttcccacagagctggaggctgagaagtccaagagcatgacactggcatcttatgagggcctggctgcagtatcatcccatagtgagaggtggaagggcaaagaggctgaactgatttctatcatgccatacaatggcattaatctattcaatctaatcaaccctgaaaggtcccacatcggctgggcacggtggctcatgcctgtaatcccagcactttgggaggccaaggcaggtggatcacctgaggtcaggagttcaagaccagcctgaccaatatgatgaaaccccgtctctactaaaaatacaaaaattagctgggcgtggtggcatgtgcctgtaattccaactactcaggaggctgagacaggagaatcacttgaacatgggaggcggaggttgcagtgagctgagattgtgccattgcactccagcctgggcaacaagagcgaaactccatctcaaaaaaagaaaaaaaaaaagtcttgcatcttaataccattaggatagcaattaaatgtcaacatgagttttggtggggacattccactttagcactaggtattctggtttatgtatttttttagcttaattccttcatttctacaattatgagatccacgattatccactatatttggttttctttctttttggttttgttttttgttttttgagacaagagtctcgctctgtcgccaggctggagtgcagtggcatgatctcagctcactgtaacctctggctcccgggttcaagtgattctcctgcctcagcctcccgagtggctgggactacaggcgtgcaccaccatgcccggctaatttttgtatttttagtagagacggggtttcaccatgttggccaggatggtctcgatctcttgacctcatgatccgcccgcctcggcctcccaaagtgctgagattacaggtgtgagccactgcgcctggcctcatccactatatttgaaccgacccaaaggccagtgctttcttaattaagttcccacaggtgaacaaagccaaaattcagattctattttatttatggtttagaattacctactgtgaaaaaaaaaaaaaactagctactataaattattgggggttagtccatttagtccattttggagttcataacctaaagcagaaactcacatggttgaaatgtcactttcccaaaggattgttattagtgtatcatttagattgtcttgcaaaagtctcatttgttgttttttctaaatggctgctaatcttttaaattaacagatagagggccaggcacggtggttcacacctgtaatcccagcactctgggaggctgaggcagtcggatcacttgaggccaggtgttcaagaccagcctggccaacatggtgaaaccctgtctgtactaaaaatacaaaaattagctcggcatagtggcacacgtctgtaatcccagcttcttgggaggcagaggcataagaattgcttgaacccggcaagcggaggttccagcaagcagagattgtgccattgcactccagcctgggtgacagagcattgctctgtccacctcccaaaaatgtagttaattttttttcttttctttttttttttttttttttttttttttttttttttttgagagacggagtcttgctctgtcgcccaggctggagtgcagtggcacaatctcagctcactgcaacctccgcctcccaggttcaagcaattctcctgcctcagcctcacaagtagctgggattacaggtggctaccaccacgcttagctaattttttgtatttttagtagagacggggtttcatcatgttcgccaggctagtcttgaactcctgaccttaagcgatccccctgcctcggcctcccaaagtgccgggattacaagcatgagccactgcgcccggccaactttcaatgttaattagttgtggtttgtttaaccatatactgcatagtttcgcttatctataataacagtagtttggggctcttatattctaataattaagactttagctgtgtacacattgcaattaaagtatgagtcatgcataaccttatcaccaagatacaagagggaaagcccttctccccttaaacttttacaaaggttctgggttctttttccacttaagtgggaaaaagtcagctaatgaggaacgtaaagtctttggcctcatctaaaggtgctttggcccgcaagtgtgagaagcactgaccgctgggaagtcctcactgcctggttcctggactcttacaccatggcagaggccatcttccctcccaatgcagagtgatatccagatagcgagctggctagcagctgtccactctccagcaatcctgccttctggggcatggttttctaaggaccttcctgttcctagatgatcaaaattgggaccagccactcccttctgagccactcctgcctctgggcctgtggctatgtcacagtccagtcacaacaggacatcccttcagaacaccctgcaggaagctgacatctctatgcagactcacacatgcacggtgtgtgcacaggcctttggttctacttcaggaggtgttgggggaggctcactagtccaacagaacttgaggccagttgtaccagtgtcatatcccaggagccaaggttacaagggatacaaagtgcccagacctaccagagaaggcaaacccctacagcatgcagggctagacaggggcaagaaacaaggtcattctgggccagcaagaagagggaaagggaaatgacaggcatacctcggagatactgaagatttgtttccagaccatagcaacaaagtgagtcacacaaactttttagtttcctattgtgcataaaagttatgtttgtactatattgtagtctgttaagtgtacagtagcattgtgtacaaaaaactgtgtatatacttaatggagtctcgctctgtcacccaggctggagtgcagtgccacgattttggctcactgcaacctccgcctcctgagttcaagccattctcctgctcagcctcccaagtagctgggactacaggtgcccatcaccatgcccagctaatttttgtatttttagtagagatgaggtttcaccatgttggccaggctaatcttgaactcctgacctcaagtgatccacccacctcggcctcccaaagtgctgggattacaggcgtgagccactgtatctggccatatactttaattttaaaatacttaattgctaaacaaatgctaaccatcatatgaggcttcagctaatcctgatctttttgctgggggagggtcttgcctccatggatcaggggcatggctgctgaaggctgctttgacaacttcttaaaataagacaatgatgtttgccatttgccgcatggattattcctttcaatattgttgtgcctcagggaatagggaggcctggaaagcagagtcgggagaatggccagttggtgaagcagtcacaacacacacatttttccattaagtttgctgtcttatatgagcatcgctcatggtgtcccaaaacaatcacaatagttaacttcagtaactgattacaggtcactgtaacaagtataataatgaaaacgcttgaaacattttgagaattccacagcgtgacatggagacatgatgtctgcctgctgttgggaaaatagcaccaatagacctgtttgatgtgcttgacacagggttgccacaagcctccaatctctaaataaaaaacagcatctgcaaagagcaataaagggaagcacaataaaaggtacatctgcaaaggggaatcagcacttaagcaaggtcaggatgagctttcaagtcaggtggacctagacatgaaccctccaggccctaccaacaaccagctatggaccttcgagcacatccagcctagagctgcccccaacagacacttccccagtgaatgctgaatgaaaccatctgagccagtttcctcaggtgcaaaccagtgaggtaattcctaccttgcagagtgaagtgagaaaagacagtgttaagaaatgccgggtgcggtggctcacgcctgtaatcccagcactttgggaggccaagacgggcggatcatgaggtcaggagatcgagaccaccctggctaacacggtgaaaccccgtctccactaaaaatacaaaaaattagccgggcgtagtggcgagcacctgtagtcccagctcctcgggagggtgaggcaggagaatggcgtgaacccgggaggcagagcttgcagtgagcccagattgcgccactgcactccagcctgggcaacagagcgagactccgtctcaaaaaaaaaaaaaaaaaaaaaaagacacaagacctgtggtagcctttcctttctgtctggcagcagccactgggtaaaccaagatggtgcatacaagtacatccagaagctatggaagaagcagtctgatgtcatgagctttcttctgagggtccgctgctggcagtaccaccagctctctgctctccacagggatccccgccccacccagcccaataaagcacgctactgggctacagccaagcaaggttatgttacatataagcgccacggtggctgaaaatctagttcctaagaaggcaacttaacagcaagcctgtctatcatggtgttaaccagctagtttgcttaaagccttcagtctgttacagaagagcaagctggatgccactgtggggctctgagtcctgaattctcactgggctggttaaagattccacatacaaagtttttgaggctatcctagttgatccattccataacactatcagaaggaaacctgacacccagtggtccacaacaagcatagggagatgcgtaggctatctgcaggccaagagagccacggccttggaaagggctgtaagttctaccacactattggtggttctcgccatgcagcttggagaaggtgcaatactctccagctccacagctaccgctaatgtttgtaaaattcatacctaataaacactagatcaaaaaaaaaaaatcacagacctgtggtaggctgggcaccagtgctctaaagcaagttctgcctaaactggcagggacatttttcacatcaggaacaggagttgttcctggactctgtctggggccaggctgggagagacgtggggcagagtggggcaggggcaggggcagggctgggggctggggcctgggcagggccaggcactcaagtgaggccaagtcctggagcgaaccagttcctggtggccgttggacagctcacacagctccctgccaggtcacccgccatggtcctccctctgccctggctctctcggtaccatttccttcgcctccttctgccctcctggtccttggcaccccagggctcccatgggtgctgctcccaaaaccccaaagcaagcatggaagagcagaccagctccagaggaaatgggaagatgacgtcccctcccagggtaagtggcaccacaggtaggaacagagggtgtgagaatttacactggggtgtgggaaaaaaaaaccctcaatcccaccctgcaccaccccacaccatgcctacccctgcagctcttttcttagttcagctaccaactcctctccccacctcccccagcccagacctcagggttcccttccctcaccccacccccacccacaacagcacagtccacaaagtccttgaacaggatctattccccctcacctaacagttaattatttcttagcggggaggagcagctgatcctctttccagtgaccccatatccttgttcaaggaagccagttacagcccctgggccagggaactctatttgctccccctactaccacccagaggcctatgcccaagacaggaagctacctggccttctcagtacaggtgtccttaaacgaccggttcaaaaacgaatagggaaggtggaatttctcacttccagccacagcctgcaacaaagcttcccagggcctcagccccctgccctggctgatgctccctcccttaattccctgaccagggccctgggacccaccgcacagctgagctggcccgagctgaagagttgttggagcagcagctggagctgtaccaggccctccttgaagggcaggagggagcctgggaggcccaagccctggtgctcaagatccagaagctgaaggaacagatgaggaggcaccaagagagccttggaggaggcgcctaagtttcccccagtgcccacagcaccctccggcgctgaaaatacacgcaccacccaccaggagccttgggatcataaacaccccagcgtcttcccaggccagagaaagtggaagagaccacaaagcgcaggcaattggcaggcagtgggggagccagggctctgcagtcttagtcccattcccctttgatctcacagcaggcagggcacccaggccttataggaattcaccctggaccatgccctaaaataacctcaccccaaatacaataaagggacgaagcacttatagataccacagacacatgtgtttcatttttagttttgttaaaaaaaaattctgacaaatcagaaatgggggttcaggagtggtggtgatgcaaaagatggaagccatggggtgggggctgtcaggggtgggggcagtagtgtctccttcacccccaccctggtgtcctctcctgaaggacagacggtcacattccaaaatgggcgagtcttctaccgtgtctgttcaactgagaagaaaacgtagcatggtcagaataaggcatgaaaaggggaaagtgaggcaggaacacacggcacacatgcagacactggtgtactgcctgggttcagaggacggacgtgggggtgagggaagggatgtaatatgatgagagaagacaagacaccccacataaaggtcagaaaaacatcccaacacagcatcaaagaccagggggcatgaaccagtcaagtgtccattatgcatcagatgcccatgacctatgtgatgggatttcggacaaacacactaaggaacagggaggacctaaagggtttcatgagatcagtactcactgtaggaggagatgtctatctcatcaggcagctcactaatattgacctcaaagcgatcctgcacatcattgaggatcttggcatcattctcatcggacacaaatgtgatagccaagcccttggtgccaaaccggcctgctctggccacctggagggagacagagggtagcactggaagaccgaagaggaaagagacccagaggcaggaatgaagatgtacaaacagaaaacaagggaatgggagagtgggattttttcagcctgtgaggtttacccgatgcaggtaggtgtcagaatcctcaggcatgtcataattaaaagcaatgttcacccgctcgatgtccatgcctcggccaaataggttggtagccacaagaattcgtcgttgaaaatctttaaactgctgataccgagaaagcctttgtgagaaaggaaatttaaaacatgttgagattcccttctctcaactgtctttttctcccaaggacacaaaatatctttcccatcttcagctcacctctcctcctggggcatcccacggtggatggcaatggctgggaagttctgctccactagtagctgggccaaggcaatgcaccgctgcacagacttcacaaagatcaccacctgttgtggggtggggtggggggtcgcaaattgggggaataggggtccatggtgtgtgagagacattacgtgggagaggggagtttctagtaattacgttctcaggaattcctcttcatttctcttattcccccactatatatttagagcagaaaaggaaatataactttacttcagcactgatttttccctaaggaagctggcctctgaggtagcacagagttcagaaatcaaaattgccagacatgctaggagatgaggatgagatcacctcatgaaaaagtgataaaaaactagaattaagatctggaggggtaactgatattcctgctcaccaaaacattaaacctaagggagctatcctaattctagaaagcagttttaaatgcaaatagaccactcacaagtatattaattaaacacttttttgagatggggtctcactctgtcccccagactggagtgcagtggtgcaatcgcaagtcactgcagcctccaccctcctgggtttaagagatccttccacctcagcatcccaagcagctgggaccacaggtgcacaccaccacgcccagctactttttttattttttatttttactatttgtagagacgggcgtctccctatgttacccaggctggtcttgaagtcctgggctcaagcaatgctcctgcctcagcctcccaaagtactgggattatgggcatgagccactgccctgcacccagtcagaaatgcttctcttgaataagcagttattagaggaattaaacattcaagaaccctaacatgcccccaaacatcgtttcaagacttttaacaacttcctaaaatccttcaaggacttttggagacaagatctcactctgttgcccaagctggagcacagtagtgcaatcatagttcactgcagcctcaatttcctgggctcaagctatcctctcacctcagccaccagagtatctgggactacaggcatacaccaccacacctggctaatttttttcttctttggtagtgatgaagtttcgccatgttgccccgactggtctcaaactcctggactcaagtgatccacctccctcagcctccccaagtgctgggattacacacataagccaccgtgcctggccaaggatcttaatttttgaagtttattttccttgaggttattgaggacatacccgtgccagccatagaatagaaaagcagctcccaccttactcatgctcagcccctaagatatttataccctcattattctctcccacatcacacatgtgatttcctcaataaaagtgtacttaatatccaggtttctgctacagctggagtgctccaatgctcatccccctactggacgtctaactgacctggttgaactcaaggacatccagaaggtcaaagagcttccggttcttctcgttgtccttcagtttcacgtagtactgctgcaacccatgcagcgtcaacttcgtctcatcatccacgaagatctccattggctgggggggaggaagggggtggggaacgggaggagggcagagtgggggggttaaacctgggggggtggaggaagttgatctccaatacaccccatggggggatggggaggaaagagaagattgaaaaccccaccccactcccaaaaatacccacattttactgtggtctctctcacattacatctaatttccttcctatcagatgagttttaagactgcccaactaaaaactatcatgggaaagaaactgcaaatgaagtcaaggagcagtgaaaccacccaatggcacagatgccattacctcaaatagaggtgggagaggaaagaaaatgggagatgattctcaaagggagagcaaggaccaaacatctgggaaatgatgggaggcagtgactcaaggtcagaataactccatcagaggtgcttctaagaacatggggtggggggaggacaactgctccatttgattctcctacttcaactaagagaatctcgtgtgcattagcaaagtggatgtcttttaagatcagaatgctgcaatggacagtcaaaatgccacttaaggagaaacaaaaattactcaagatgagttacttgccgtcagaccacaacaggatagttttagatgagactggtctcttgactaagaattaaaccatctacaggtttacaggaaaggtatcagtaagtggtgttaaaataccaaattcagagcagcagatacacttttaagggacaggatctcaccatgttgcccaggctggagtgcagtggctattcactggcacaatcatagcacactatagcctcaaattcctgggctcaagtgatcctcctgcttcagtctcctgaatagctgggactacaggcacacaccattatacctcactgcattcatctttaaaattaaaaaaccccctgaaggggaggaaagtaacaaagacagaaattaccacaactccaaagcccaactttcctaacactttttatactatcctgggggaagatagttaatatgaagacccagaggacaaaataggaaaggatgcgtgtgtcatgggaaaaaaaccagaagcccaatcccagaaggcaggttttgttttttgttttgttttgatacagggtctctctctatcacccaggctggagtacagtggcacaattacagcttactgccacctccacgtcccgggctcaagcaaaccctcctgcctcagcttcccaagtagctgggactacaggcatgcgccaccacgcccggtttttctggtagagacaaagtctcactacactgccccagctagtctcaaattcctgggctcaagcaatcctcccaccttggcctcccaaagtgctgggattagaggtgagccaccaggcccagccaaggcaggctttctaaagagaagttccatggcctccttcaaatctcattctagccccaaatacagctaaagagtgatcatcccacgggaaggaacactgcagggaggggaagaacacactccactgcttatgcaattggccccacctagccccaaaccctaacaaccacccgattacatccactttacctttcctatgtccctctcctctgagtattaaaaaaaacaaaaaaatttttttaagaaaaaaaatctaccaccccattcaggacacccctccccaacacatattgggggaaacggggcacggcacgcgttgggttcaggaaaaaaaccgggaacggaaaaagaggctggtttggtcctcagcttcctggtcaggtttccccgcggcctccgctgccgccatccaccgctgggtgccgtctgcattccctcgccgcgccacggtgcttctctgttgccggctcacatcaaccgaggttccagatgggtgcaaggagatgtgggtgggaaggagtagggtatcggggattgaggtgccaaaggcccccacccctggaggtggggaaggggaggattcatttgtgctgatgctcttcttttggacatgccctgccatctgtctgtccctctcttgctctcctgccaccgggaagtaggagttttggtgagcagaaggctccagctgtacgctcgatgccaccttgagggtgcgtggctgtagggtgcatgtaagagacgatggatgggtgggtggtagggcagaaaaatcctgccctcccccaaagggagaagaggttcaaaaatgttgtgatttatgaaaaagtcgaacactacccgctctcacattaacccgaccaagtcttccggagtttccctggcacccgcgcaggccctaacactagctgtctctgcttctgtatgtctcttcaaggagtcattactcccagttgggcacaagccgccttcttggcacttgaatgacaagggagtctgaggaagagggcgaggaaggggaggaggcagcgggcggggagtggagggagagaaggtagaagggtatttacatcttgcatgaacttgcggcagactggacggatctctttgctcaaggtagcactgaacatcatgacctgcttctcgtggggggtcatgcgaaaaatttcctggacatcccgacgcatgtctacaagaacaaggaaaaaaattgtaggagaaaataagcaggtatgataaacaaagattagaggtagacttcccagtgaggtgaagattgctggaaatagtaacaacacaatggaaagagcaatggacttggaatcaagaagtgggatcagattccagctgtttgttttaaccaagcaagaaataaggtaaaaccccaaagttcccaactatgaaatggggataaagcccagtgcagaggctctcaaggccttcaaaacatgctttatgggaccttctcccaaccctttcctgcccaagccccagccagccttcagcagactacaaatatcaagcacatattatattccagatatcagagtccatctatgactctctggattacttttctatcaagtcaggcaaatatgacatccctacctggagcccacctttatagctcaccatatagaattgccaaagatcatttgtaatgacttatggggcctatgtccaaccccactctcattcaccaagattcaattcttacagaaaaatcttccattaaccccacctggcacactagaataccacatcacacaaactgctacaaacactctctacattaatcccagacctgagtctagacacttattcagctataaattctgactgtaaatgctgtgctggagatgccagaagggtactgtcttctctttcagtttagaatctccgctatgactcccagtatatgaatctataatgaaaacggtggtggtggtgatgacttatgcctaaaattatcaaagtcccctattctcaaaggttaaaaacaaaaatcatagaaagatgatagatgacaccctttactgtgcttaaaagcataataaagaccaaccagggaacccagagccatcagtcatgggtgatagataagagtcgtccttgcactgaggtgctcctgtttcaaataaacatcatttggctccaaagaacaactccccagcattagccaagccccagcactgccactcaccgagctgttcaagcatcttatcacattcatccaaaataaagtgtttaatgtgtttgaggttgaggctcttatttcgagccagggctaggatacggcctggagtccccacgacgatatgcgggcagttcttcttcagcacctcttcatccttcttgatagacagaccaccaaaaaaaacagcaacctgccgagccagaagcaaagagtctcaaaacagaggaaggaaagagtccaatccccccagggttcccactctgtttgagctaaaccaatttttagcatgtttccaaactaaaactaactttagagggcacctaatttaaaaattttatgtcccccccaccaaacactgagggtgattgcctaaagttacatggctagtcggagcagtcaggacaataattcagttctactgacttaatctaaccaacttccttcatttatgaggccaggcttcatttaaaaaataaaggagccaggtgtggtggcacacgcctataattccagctactcaggaggctgaggcacgagaacctgggaggcagaggttgtggtgagccaagatcccaccgttgtactccagcctgggcaacaagagtgatactccatctcaaaaagaaataaaataaataaaaataaaataaagccaggcccagtggctcacgcctgtaatcccagcagtttgggaggtcaaggaaagtggatcacttgaagccaggagttcaagaccagcctggccaacacggtgaaaccccatctctactaaaatacaaaatttacaaatttactactaaaaaacaaaaaatacaaaatttagccgggaggctgaggcaggagaatcgcttgaacccgggaggtggagattgcagtgaggcgagattgagccactgtactccagcctggatgacagagcgagactccatctcaaaaaataaaaaataaataaataaaggacagcaagaaatcaccagattagtgtaaagtaccacaaaaaacacatggaacattaaggtttcctaaataaacccagaatctcaaactcttttcacacaaaccccatgaaattactgcttcgggctaaatattatcatttcatgttaaaaccattaggtgaatagttgtttggggatctgggccttggtacagtatcaaataacaccagaaactactttctggtttcaagggggaaaagaacaactgtggaatcagactgtcacgacgctaatcctatggtaaatctaaaatcattaatgaggccaggtgcagtggctcactcctgtaatcccagcactttgggaggccgaggtgggtggatcacttgaggtcaggagttcgagaccagcctggccaacatggcgaaaccctgtcactactaaaaaaaaacaaaaattagccaggcatgatggcacactgtagtcccagctactcggggggttgaggcgggagaatcgcttgaacgtgggaggcgcaggttgcagtgagctgagatcgcgccactacactcacagcctgagggacacagcgagactccatctcaaaacaaataaataaaaataaaataaaataactaacataagtcgaccagatttgtggcataacaggagatacagtatcacctatgaaggattcttgccaaaaatgcttaacttcaatcagattttttctttttttttgagatgggagtctcactctgccacccaggctggagtgtaatggcacaatcccagctcactacaacctctgcttcctgggttcaagcgattcccctgcctcagcctcccaagcaggtgggactataggtgtgtgccaccatgcacggctaatttttgcatttttagtagagagagggtttcatcctgttggccacattggtcttaaactcctgacctcaaataatccacacgccttggcctcccaaactgctgagattacaggtgtaagccattgtgcacttggccagaatcctcaatattcacacaccactggagctgttttaaagtttccggctttctctgccacataccccaaaattattaaactgatatgattcaaagtcagtataaagtagtaagaaaagggtggtcttgtgttaagcatcatccatagcccaattacgaatcctcctgttacataggaactcaacactctgttacaccacagcaaactaaagcttctccaaaattaaagagactattggcctacaagtttcttatccctccaacttgccacaccctcactctcaggtctctttaccttggcttaccttgacattgggcatgtatttagagaagcgctcatattccttgctgatctgaaaagccaactcccgagtgtgacacatcaccagtacagacaccttaggcaggaagtagacggagacatatggtaaatgtagctcttcattatcccctctagggaagtgactgtcacaaaaacacacctgggccgataataaatgacttcaattatgtgatctaaatcatgaaccccacgcttgcgacagaacatcccccacagctgtcaggttgtcaagggtaacagaggtcatgtgctcatggctctgcaagcatcatgtagctaggacaaaaacacccttcccttatagtcctaaccaaaatcccctccccagcactctccccaaatatacctgcccagtaactggctccagctgttgcagtgtggccaagacaaacactgctgtctttcccatgcccgacttggcctggcacaggacatccattcccagaatggcctgagggatgcactcatgctggactaaaagttggggggggaggaagataaattagacttcagtctccagataactctacctttttcaccatgccaagcccatttcttaccactcaattctcaaagtctagtatttacctggttcttgccaacttccagacccattttacctctctctgctcaattacattcacctcaaaatcagactctcctaattcctcctagctttagcctcctccagatctaggccttcccagtcctagtaacaaaccccttgcatctaccaaccgctcaccttcaatgatcctagctctgtccttatttttcttaatctgtaacaattcatgacatttgaatacctgccacagaccacttctcctgcttaggttgctatacttcgggtcacgtaactactacaaccctggacaaaatgaaggacttggtacctgacccagaagccagtcatctctaaaccagtcatagaggtttccagagaccacagttggcctggcccaacagagggagactacaggtccaagcaggacctttctggaaatttaaaattagaagtcaagtgacaaaattaaaaataagcagacaagaaaagccagtcacaagaatgaatggcagacctggaagtcacttttggatcattagcactttggtgctatcacgaaagaaagaataagcctgtataagcctcctctatccaaaattgtttttgatacttatcccctgattttttcttcctcactgtcgccccggctggtgcacagtggtgcaatcacggctcactgaagcctcaaccttcacctgcttaatttctgaacgttttgtagagacaggagtctcgctgtgttgcccaggcttctcttgcacttttgagctcaagtggccaccctcctgcctcggcctcccaaagtgctgggattacaggcgtgagccactgcacctggccctgatctagccttaagtataaacccttaccaccacctgagcaacgacaaacacatctttgtattgtacccttaaagagcccaatgagcactacatgcccaagagaaaatttaccttctgacggatgctcaaagccacagtcgacaatggcccggagcaactctggcttgagcaggaagtcacgaaagccagagctgtggatggagacataggagcccttgacatccttcttggcaggggcctcagccccatctcccccagctgctgtctccacctcatcatcttcatagtccaagagctcattgtccacatcgttctctgccataactgggccggcaggggaagaagggaagggggatctggatgggttctcgcaaaataggtgaaaacaaggggtgaagagtaggggattgaggaacagcaaaggaaaacaaagatactatttctaacagaagagctggaggggggaaaaaaaaaagcaagacttaatcacgagcacagccttcaccacctcttttccatccccagttcccactttccctaaaccaggaaacttttacctggaaagaaaaacagatacaaaacataaaaacgaaaagcaaatataacagaacagaaaaagcagtaccagggaaagtggttaggacagaggttcccaacaagattagcaatcacagtagcggaaaccagaaaagttggaaggggaagaccaacttataaattcttgatctgaaagtaacagtgaggaaatagaatagataataaaaggtaaaatacgactaataacttagtaaagtggaaaatggagatgacaagtagagtcctgaaaagtcctcaaaggaagactccgctttccctattataatcccaccgttatggatgcctaactcagcagccatcagtcaagggtgatagatgagggtcatcactgcgcaaagcgctcacctttcgaaaagaaaacatcatatggccgccgtccacctcccatagctctcagcctcccacttctcagtatcctcccttccgctgtttaagcaagccttgtgtaattagcatgggggggaggggcggtgcaagacaaatggctcggccacaaaaaaacaaaattcatgtctccaccctacaataagaaagctaataggtgacagagaaaggcaatccccgcccaggctttaacaggatctttaccaagtggtctcacatcactgttacgctacgaaggtgagactccttttggagaaacatacaatgacaccaatcgtatcgtaaacacttggaaggcactccaaattaagttgggcaagtcaaggtgagaaaaatccaactgggcccagaaaccagctcctcctcccagtcccaccgagggccgagaaagagctcaagaaaggacaaggaaggtgagaagagccccgccctccgcaaataccaagaccaagggacgccgagcgccgcctctcattgatgctgaggcctccaatatgagaagaacccattggaagaagggagcaaaacgaacacaatggcgccgaggacaccatcttggattgggtccccccttagcttcccttccttcccccaggagctctttgctctcgaaagggatgcaagctaaggaaatagcgaaccaactaggccccagcgaccagaccatcgcctgtgaaaagggtatcaggaacccatgtgacgggatgggtgcggagaagcgcagatggaaacggattgtagcgaaggccaaagcttacctaaacagggagagcgcgtatggcggcagcaacagcgacgaaggagggaaatctgccttcacttccggttgcaggcttccctctactccagcctcccgccttcttggctgcaagagcgcaggcgcaagggaccggaaacagggccttccgcggttatacagatccgtgcgctccaggcttgcctttggaaaatgcctgtctgaaatttgttttaaaaccgtttctaacttcactgctaccgccagtaacaaaagatataaaggaaactaacgtctcccccccactgttatctttattctcttatcctactcctctccatgcccctcatctcttcgtttaggtttttgccacgcaggtcttctctgtaggcacccctccatggatgcgcgaggaacgagtgtggcgaaggctgcgagttcccacggggtccttggcccggtagtgaaggtgacctgaggactgctgggcacgcactaggaaccggcaggccctagctgaggggagggaggagggaagtctcagggaactggattgctcgggggtgtttcccgactctttcccagtcgtggggctggtgggcggtattttcccaaaaggatgctgtccgaggtagctgatgccctagggccagtgagtcaggaaggtgttctgaatccgagcgggaagacggggtctggattcggccccaagtgttaatagtagggcttgagggttatactacattccattaatactgtttttgtttttgttttgagacagagtctcgccctgtcgcccaggcgggagtgcaatgtcctgatctcggctcactgcaaccgctgcttcccgggttcaagcgattctcctgcctcagcctcccgagtagctaggattacaggcgcccgccaccacgcccagcaaatttttgtttttttagtagagacggggcttcacccatgtatgacctcaggtgatccacccacttcggcctcccagagtgctgggattacaggcgtgagccaccgcgcccggcccattaatactgttaattcgagcagaatgttcttggccccgccccaacagccccattgttcaacctggatttttttcctgaatgaaacatttgctatccccgtctttgagatggggagctacaaaagtaagacctgatgtcctgctgtgtaataaaacaacaaacgtttggccctctccctgttaacatacttaatcatttaatactaaggagtaggtaccgttattctcatcttattgacagaagcgaagcaaagcaacatatctcaagcagtacggctggtgaggttacagccaggatgcaaacatctctcattctctattgtattctgcctccctgctcaaagaatctggttagtaaatacactgcaggttaccttattggttcaaattcttggtgaagtaagcttgtcttcagtgacaaatgaagtaactaattcaagaatggtgtcatagaaggtattttcccaagtatcatttaatttattcaaaagtatttatcaactgcctcccttgtgccacatgttgtcctaggatctggggacacaacggtgaacagccctgttctcacagtgtttacattacaggaaagaaaacacataaacacaaatataatgtcaagtatcgataagtggtcagggtgcagtggctcaggcctgtaacccaacccttgaggaagccgagcccgaaggattgcttgagcccaggagtttcagaccagcctgggcaagtgagaccccatctctacaaaaaattttaaaattagcaaggcatagtggcactcgcccgtaatcccagctactcaggaggctgaagtgggaggatcatttgagtccagggggtcaaggctgccgtgagctggaactccagcctgggcaacacagcaggaccttgtctcaaaaaaccagtagcagtaagtgctatgaagaaaatgcaaggtaaaggggcaaagagcacttgctcctacactccagcttttctctacagttgcgatctatagtcctcagattcccaaatgaggaaccatgtttctcactttagagaaataataaagtactacttgttcttgtttctccaagaagtttcaaaggatagccatttgggctgtttagggaatatgtaaacaaaaaacaagaaagtgactgaaggccaggcacagtggctcacacctctaatctcagcactttgggaggccaaggcaggtggatcacttgaggtcaggagtttgagaccagcctgaccaacatggcgaaaccccatctctactaaaaatacaaaaaatagccaggcgtggtggcacacacccataattccagcaacttgggaggctgaggcaggagaatcgcttgaacctgggaggcagaggttgcaatgagctgagatcacgccattgtattccagcctgggcaacaagagcaaaactccatctcaaaaaaaaaaaaaacaaagtgactgaaaatgagaaatgatgaggcaaaaggaggctgcttcaactcaccaatttatttgccaataattattttattgatactttttttattgttacaatgggaaagtaaggtgtcaaggatatagaaaggaagggcatgcatatgagggaacacagtatcattttagatcttagaaagcaatgagcatctgataagtctttggggaaataggaaaggaggaaaatctaataaagacaaagatcagcaaaagaaaaacaaagagaggctacaaaatgcagttatctacctggaattataagagaggggctaaatgtagtcatctcctctttttggagatcagaaggtctctgggaaaagagaagaaccaatttttcagaaaataactagggtcacagaatgaacaagtggaattagagagccagtgatggacgtgaggaaacagctgtgtaggttttgaccagtgagcaggtggtggtaatagtatcacagggttgctacttactgaatcactgctacaacatgcaaggaactgtgctagactttacagaatgattcctaatcattgaagcaaccctcacaaggtaggcattattatcatcccagtttcacagaggaggacatcgaggctaccaagttaagtagcttgtcctggtttcacagccagcaagtgacagggtcaagagagggacccacatcggccagacactgaagtcaggatgttttccacattcctacttccccatattacaaatttcacagagggtttaggtgagaatgacttggaagtttacaaagtcccagtgagggttaaagaacaacaaggagattcagatgtgagcaggatatttataagtgtcacaggaaaattattggatcctgcctcccaggatttctaggggatggaaagaagacagggattatggtgggaggtgattttgattggaggatttctttgagggagggaactggcagaaggagtcaggccctacggtggccctaggcagaaatccggtagttggggtggacctggggcctgacgtcgcagaccatgccaagaagctgggccaggacacgctctcggtttctctgctgggagctctgcatgccctgcacctggcgccttgtagcctgctccacctcagcagacaggttcccctgggagcccatggcctggggggtagggagaggggtggaagagagaaagggaaaagcagaaacagacaagggtccaggcatatgaggggaaagatcctgaaacaaagcctagaagaaaggccctctcagaaaccacccccatcccacagaaatatcccaacaccaaagagatcaacacagtcccctttccccttagacctaacatgcaacttcatcctaaaacagaccgtaatatccccaccacctcaccatccatgaccataaaactctaccctccaccacaaatgttaatcatactccacatagatgttatactttacacagactgtggcattccgcccacaagctctatgtggccttcaaaactcccagactctcctacatatcatcacaaagtttcaccaatgttgtggtccctgccagggtcccctcagcctcagccctctgccaccatattttcttgttgagtcacccttacacacctcactagatgcacccaccaacttgcagtggggtctcaacccgactctgcctcaactcaccgcctgctgcttgctctggaattcgtgctctcgctctctgcggtattgctccacctccatctgtgcctcctcctttgcctgcttcagtcgccgggccttccctggaggcagaagaaaggacagtgagtggggatggacccacacacacacaatgtaatagcaggagtcagtcccttccagaaagttatacagccttctctcagccaaccaggtgccagattctaatatccatccatttcttccctcctaaccagcctccagaccctagctgtctgtcttcccgccagccttgggttttcccaaaatgtttgctgtcccccacccccaattttctttccaaactcctaagggaggaaagaggagactcactctttctggcatctgccaccttctcagctgcccgcttctcagcttgcagaagctgctggataccttgggactgactggccatttctgttgttatggccgatgctgttttgaatgctgtcaaagtaccagatggctcccaccccccaccgcttacttctcctcctccagctcgttgctgcagtcctccactacccctgggtcttagtgctcccctgctcactcagcctcctgcaccgagtgtctctcccaatctcatcctcctattgatgactggtcctcctctccagcacttcttgctcaggcagtacccaaaggggccgcctgggagcagcagagaccaggcccaaagctgcgggcttacaacaggttagccatcccagtcggaaaggtctagggatgaggcaggggcggagacgggggagtactgaggtgagagaaggagaacttgattggtggtaacagaggaagcataaagggttgtgaatgcggtgaaaaggtaaggatgtcatcatgcaacctgtgttgggaaaagagcattctgggcttaattctaaactaactctctacctttctctctctctccaccatcccgccccctcccctgcctcccgttgttaacatctccatctttttctacatatttctcaagtccaaatttttgcatctcacttgccccatcctacgatagtcttcttccgtcttttgtctgtattttttctttttttttgatctgtccctgttgttgtcccactgtggtttttgtttttgttttccatgtttaatgtgatttttatcctgtctttatctcctctattttctctgtcttctcatcttttcgtccatcactgaaccatctcctctctctgccaagttagaggaggcgggaaaaaacctccaaataactctcttttctccctcccctcccctcgcctccttttcctcgcctccagtccagtcttctggtttcagacggcccctttaatttaagttccctagtttcccctgggagatctggccaagaactacccggtcggggcggaacgacatccggtaacgcccctcacagttcacttccgtcctccacctgcgtctctgcttgcgccatttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccgggtacatgatattcaatttctagatcattattggagattatctgtgactttttaaaactcagatttctgctgataaaaattttccccatccggccctgttgggtttttttaaagttctttgttaaaaattaaaaatttacctgggctcctgagccttaaaccaattatttacccttttctcgaattttacattaaaaaaattaaacctctgatcctatcacccccctcaaaaaaaattttttttcaaatctatcatctgataaaggatcagggttaggttaggcctcatctcttgctgaagatattaaaaaaagacggaaccaaagggagaaacaacaggggatgtcagagatggagggagaaggaccagccaaggctgaagtcctgactgctgccttttttccttccccagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatggtgagtctgctcagtggggaacaaggtcataagcagctgaccagacctgaaatgaaagccaaccaatagttgagaaataagctggttatttggtcatcaggacctagggaaggagttaaccaagttggcatgtggctgtcatttgtccctttacattactgagctaccattgtctgaagaacccaacattccccaaagatcaactggtcttcaaatttcacatctgtttagattagtagctactttgtttcttgacagattgtttgctcgtagccaaaaagtagcatagaaggtaggctctggagttagattgcctggattcaaaccccagctccaaatcccagctccacacttcatagctacgtattcttggacaggttacttgaggcttagtttgcccatgtgtaaaaattaaaataataacaacctttgctatgtgccagacatttcttataaagtaacacatttaatcctcacaacaatcttaggaggtgagtactgatattatcccccatttcccagctgaggaaacagggcatagagaagtcatttgccagagttacagttattcactggtagagcagagattataacccagatggactagatagagtgtccatgcttttaacagctacattgtcctgtgttatacattatagcattgtacattgattgtgcccatgttcagagtacccatgttgtgccatatatgttttgagaatcaactgacatagtacataattagagtacctggcacacacgataagcacttggtatatgctggcgattgttgttcctgtttctctgttttttgtttttgtttttgttttttatgaagtttcactcttcttgcccaggctggaatgcaatggtgcgatcctggctcactgcaacctctacctcccaggttcaagtgattctcatgcgtcagcctcccaagtagctaggattacaggcgcatgccaccacgcccagctaatttttatatttttagaagagatgggttttcgccatgttggacaagctgatctcgaatgcctgacctcaggtgatccaccaacctcagcctctcaaagtgctgggattacaggtgtgagccaccacacctggccttgttcctgtttttgttatcaacaggtccatactcccttaaccacaattctaaactcaaaaacactctgagaaccaacatttttcatcaggctgccaccaaaattcatttggtgacagaaacctaatctgaactaaagtaagactattatttattttcatcctactgatgtcaatattcatacatttccctgcagaaacactcatgtgtttggttcttgggctgcctaggccctcctgggctacctaatatagagtgagtgtacttttaggtcagccctatcaagtcccaaaaacatttgaattctgcaaaacctttggcactgaaggattcaaatggggaacctggtgatattataatagtggtggaggccaggtgcggtgggtcatgcctgtaatcccagcactttgggaggccaaggcagtcagatcacgaggtcaggagttcgagaccagcctgaccaacatagtgaaacccccatctgtactaaaaatacaaaaattagccaggcatggtggcacacacctgtagtctcagctacttgggaggctgaggcaggagaatcacttgaacccggaagacagaggttgtggtgagccgagattgcactactgcattccaacctgggcaacacagcaagactccgtctcaaaaaaaaaaaaaagagtggtggaagcagctctttataggtagagccctgcttactagaataaaagctgaaaccttctttccccatctagagatttccttctggagtaagaacattacaggaaaacctctagatccagatgaacaaccctaacatcccccagctcaagtatagacagaaggcccctcccccaaaactcccccaaatggtcaaaaaaccccctatttaaaaatttcctttaacgtacctgagataggctagcatattcagatttgtttcttgttgtttttacttaaaacagagtaggtttactgagtgcaggcatctaacttgacagctcatattgtaagaggcaggaccctggaaggcaaaagagcggattaccccgaagcagacctgcatccagaccccagctctgccatcaacagggacatgcagcttacctctgtgagcccaatttgcctcgcaaaaatgggagttttgttttttgttttgttttgtttttttgagatggagtttccctgttgttgcccaggctagagtgcaatggcgcgatttcagcccacctcaacctctgcctcctgggttcaagagattctcctgcctcagcctcccaagtagctgggattacaggcatgcaccatcacgcccggctaattttgtatttttggtagagacggtttctccgtgttggtcaggctggtctcaaactcccgacctcaggtgacctgccagcctagcctcccaaagtgctgggattacaggcgtgagccaccgcgctcagccaaaatgcccctgatagtgtggtagggatttcctttattgtttgtttgcttgtttgttttgagacagggtctcattctgtctcccagcctggagtgcagtggtgcaatcatggctcactgcagcctctacctcgtgggctcaagcagtcctcccacctcagcctccctagtagctgggactacaagcacacaccaccatgcccagctaattgtttgtatttttggtagagactgttttgctatgttatccaggctgttctgcatctcctgagttcaaacagtctgcccacctcggcttcccaaagtgccgggactagaggcgtgagccaccacacccaactccattgtattgaattttaagaagctggtgagactgatattatcccatttacagatgaggaaagcagggcccaaaaggttcgggaacttgtctgaaatctcacagctctcaggtcattgtcttccaaagggggacccaagctcagtgccttcactcccagaccctggtgtcctctctggccttatttactcctggtcctctgccagccctgccaccagatggccttctaactccttggttgaaaggcccatctcattcagcttccagcttcctttttcttttccttttgagacggagtcttgctttgtcgcccaggctggagtgcagtggcatgatctcggctcactataacttctgcttcctgggttcaagcgattctcctgcttcagcctcccaagtagctgagattacaggcacacaccaccatgcccagctaatttttttatttttatttattaatttttaaatttttatttgtttatttatttttgagacggagtctccctctgttccccaggctggagtgcagtggcagtatcttgactcactgccacctccgcctcctgggttcaagtgattctccttcctcagcctcctgagtagccgggactacaggagcctgccaccatgcccgactaacttttgtatttttaatagagatggggtttcaccatgttggccagactgctctcgaactcctgaccttagatgatccacctgcctcggcctcccaaagtgctgggattacaggcatgagccaccatgcccgacctaatttttgtgtttttagtagagatggggtttcaacatgttggccaggctggtctcaaactcctgacctcaagtgatccacccacctcagcctcccaaaatgttgggattataggcatgagccaccgtgcccatcccacagaatgtcttttggttttgtttttgttttctgttttgttttgttttgttttgtttgaaaaggagtctcattctgtcgcccaggctggagtgcagtggcacaatctcggctcactgcaacctccacctcccaggttcaagagattctcctgcctcagcctcccaagtagctgggactataggcgtagggactgtaggcgtatgccaccacgcct

SEQ ID NO: 324 - DNA, 216035 bp, Homo sapiens
ctgcagtgtcattgtcaagatcataactaagtttattgtaagccattatcaagatgcattctcatgttgtgtacctggctccaaggaccacagttgattattatcttgggggacgtttattattccctctctgtctttgtaaataaaaatgacaagtcaaagtttggtagtagttgagaaaattgttgacgtgtaattacaggaatttgcttctttggttcagtttgttactttgaatctttacactgtctgcgtagctattgtggatttattattttctgtagctgcacagaaaataatgttttaatggtttttcataataaataatattattttccattttatgtggcatgaaaactctttcacattcatcactttgatctccctgactccactaccccgtatgaggctggtagaatatggtgggacaagtgtcacaacccattgaactgatgatcaaagatgcaaagaggccacatgttttgcccaaagtcgtgcacttagcaagccagaattcaaaccctgacctgatatcaagagtttactgcctgtcaagaggacttgcaatccttccactggacacatttcagatttagtttcccctttgaactgataacaactgtttcaaaagtaagaacctttttggattaagcttgaaaaaggagaattgagggagttggagaagatgttttcctgttttaacaacttaattaacaagtatggggtgaggtggggagcagcgggggcctgaagaggaagtcgttttgcagacacatcacttgtgcatgagatgtcaaatatctgtacacagggtctggtccggtgctatggtccagcatggtggccaccagccacatgtggctcttgagcacttgaaatgtggctcactcacactgagatatgctgccactgtcaattccacattgacttcaaagccttagtatgaaaaaaaaaaaatagcctattgtggtgttatgataggtactggttttcctccgtggttcctggcttgtgactcgcatagcctttgttaccatcttttattatgatgttgggtgtgttaagtctctgacctacttctgccccttttcacctgccccagggcaggactctactgcttttctgattgaggttcttttctttttttcaggcttaattcactttatttttcttgtataaaaaccctatgttgtagccacagctggagcctaggtccactgcacagagactccgtgcagctgattgaggtccttaagaccttcctatgagtggttcctaccctgtgccctggggaaaggaatgctgacatcatgaagcttccataaaaacccagcggacagggttcaaggagcctccagacagctgaacatgctgaggttcctggagggtggcaccgagggagggcgtagaagctccacaccctgtcccccattcctcatcccacgtgtctcttcatctgtatcctttgcaatatcttttaccataaaccggtaaacataagtaagtacttccctgagttctgtgagctgctccagcaaattcactgaagccaaagagggggctctggggaccccaacttgaagcttgttggtcagcagttccaaaggcctggacttctgactggtgtggtcggaggcagtcttggggactgagccctcaacctgtgggatctgacaaggtctccaggtagacagtgttggaactgaattagaggacagccagctagtgttccctgcttggtgtgtggggaaaaatacccatacattaggtcacagaagtcttctgtgttgatgattgttgtggtatgatggtagaggaaagacacagtttgagagttttccctacatgcctatctcaaaatttttgtattatatgttaacatgataaattgggttaaataaaatatatttaacaattaatttcatgggtttattgaaaaaatttttaaatgtggctactaacaaattaaaaattacatacgccggccaggtacagtggctcatgcctgtaatcctagcacttcgggaagctgaggcaggcagattgcgagttcaggggttcaagaccaccctgggtaacatggtgaaaccctgtctctactaaatgtacaaaaactaccctagcatggtggcatgcaccggtagtcctagctacttgggaggctgaggcaggagaattgcttgatcccaggaggcggaggttgcagtgagccgagatcgtgccactgcactccagcctgggtggcagagagagactccgtctgacaaaaaaaaaaaaaaaattacatatgtggctcacacctgtggctcacatttaatttctgttgggtagtgctgttcccgaggtttaccctttgtatatgacagtcactttgtaggtgagggtgaggccaggagtccagctgtggctcaaataggacagagacacttgcagtagagggtggaaagaaagaccgctggtccaccctgctttcccctgggaatgggattcttgttatgcaagaacattaaagaagaggcaagagctccatgtggcattttcagtggaagcatattcacttctgaaacctagtttctctcctaaactccacccaaggcaaaatggattattgcttcctggaaatcgaaccaggggactttaaagtgtttcatattaaaaacagaaaagcccaagaaggagaaaaataattacatttctaaaagctcttagaacaaatgcttgcttgtgagaaataacttttctataaatattttattcctcttttttcctctttttgttctccagctgagaggttccacatggatataggagatgatgttccccttgggagagaggatcaaagctcccctgagctgcttgctgctgagttttactcataataatctttgtggcttctaccccaacctgcctgcagggctctgagatggagtaagctcaaaactgtggaaaaacaaagaatacggagaaaaatccattgctccttagcatccaagctggtgttccaaacagaaagatccaaggcttggctgcagagagagagagagagagagagagaaatgtttatggtttacctgtgggaacccagcctgggtcttaataatttataaagcctggagcccacctcaccaccctctgcatgaagctcaacacatatttgtcaaatggctggatccattcatcaacccacaaaatgagcactgtgtgagctgaggtgcctacggtgttgaacctggaaacctgaggaaatgatgataccagcaagaggaaggggaagctgaggaaggacctagtcttgggagtaggttgtaaatttgatttggcccatgaatggccttagataatatgatagtcaagatccagtgtccgtggacagcaggtggctgaaaaaagaggacttaaggttgactttgatgatcagcagcatagagtcagttctcgcctagggaaacatgatcatatttggagttttaaagagatgttgctatgtgaaatatgtccaaatggaggaactaggatggtgtagggctgagattgtggctagaacatttggcttcatagagcaatgcctataaggatatattttgctgtcattgcatttgatcacctcacatgcaacaagagtagacttgtcctgtgtcactgctgatggataattctccatggatctctcatgtttctgtctatgttgtaagtaaggtgctgattgctctgttctggactcttttcaaaaacacgtatatagcgaacagccttggaacacagagataatatctctttccagaacaaaaggcagacatgcttactgcctaatacagaagattcaagctccctaaattcagacttctcctatattatgactcattgtgtctgtcatatccacattttcctgagagaattggggcttggggaccccacttaaatatgctgataactctggcaactgcaattactgagtaatctgaccccaggagtgttacgttttcaaccagcatccataaaattgtggccgaccgacttgataacttgcaagtagggaaaaactcaggcctttcagagtttttgacagtcaccctctgagattcttgttgtggggtccatggaggagctgtaggagactctgaaaggagtctgtaattaaagtcaagtcacctgctataggcagtgagagaaaagaacagggcctgattgctttggggctatggctttcattgtggatgtgggctgagatagctgtgattcaggatacagacagacagacagaaaaaactaatgacaagtatggtaaggtgggcaatgagctaccattttttaatgcaaaataacaaaaaggaatttttgcatatgtttgcaacaaaaagaatacaaacaggcacagatatttacagatgatatagagaaagaagaagacttggctctttcttttgcctttattcagcaaattatgaagtgcaaaaagataaaaagaagaaattatagtctgtgtttgatggagagctatttggagaacagcacagggctctatttttggccttgacctgttttgtaattttatcaaagacttagacaaaggtgtagaagactgtcttatcagatctgtagacgacacaaatttggagggctagataatgagacacaggtaagaattgagactcagaatgttcacatggcttggcatggagggcagagaccaagaaaatgaaattttacagaggtgtcaagacttgagtttgtgctaaaagaaatcaattgtgtaaattttcacaggcatcctagtggttcatgaaaaaaaaaaaagagctggggttaatgtcaatctcaatgtaacagacaacaatacagaacactgggtaaaacatgaatgtggctctgatccctgtcactaagatgtggcttccaggctaggaagggagtagccccaaagcacttgggacaggacagttgctgaccagggaatgatattcatttggtgtcatcttctaaagggatgtcgaaaaattaagtgcattcaaatgggggcaactaggataatgaaggcttgtaaatggctgggacattcagcgtgaaggagcaaaacccattgagacatattttactgtctttgcatttgctgttttgacagcttcaggtgtttgtgaacctcctgttgaagatgatggcatcacaaaatagaaagaggttgggttcctcagtcacttcctggataagaggttctcaggaagagtttcccaacctacattagattatggcatgagcgtacatctctttgtcgaggtacttatatttggaggtttatttgttattgcagcctaatttagcctaccttaactaatgtacctctcttagcctcattttctacatctggacaatggggataatcacatctacttcatgaaattcctgtgagattcaagtaagatgatgacacaataatcataatagaaggcttcctacttccttagacatccttctcttttaaaatttttatttatttatttatttttgtagagatatggtctaactatgtttcccagactggtctcaaactcctgagctcaattgatcctccctccttggccccccaaagtgctggggttacaggcatgagccaacacacccagccctctttttgtgctggttcctttgtgaaagttctgctgttggaagtgctctaggaccctaccctcacctactgtctccttccccaggaaatgtcacacaaatccatgtctatatactatccatatgctgatgactgattgaagttctgtatcgagattgagacccctactatctattcaagaggagacttagacatgagtctggcactcaggagagatacaggatggagttatcaactgacaagagttttctcttgattctcctccactagatctgatcctcactcacctcactttctcaatccttttctaattcaataaatgacaccactatccactcagttgtttgggcaaaaatcccagcagtcatgtttgaactcaccagggcagatggcccatgctttgctaaggaaggtcccttgagagtggtgttagtaaccagagagacatatgtagcaaagtagagaagctaatcaactttaaacattaaaaaatagcacccaaaattaaatagggggagaggggtaaaaaatgtaaatttggggagtaaaagaaacaatgtcaaatttctgttacaagaaaacttgtttctgtgttttccatgtagatggtgtttgagtgttaaatcattgagggacttagattcccattgtatacatttacagtttgtatacatttgcatacagttgaatagttttttgtgtatgtatctcttccaaaaagaattgctgaatggccaaattggcccagaaatggtcctgtctggcaaatcctccgttcttagtatgaggttgccagggacctgagatgccgtcctccacttggtggcagtgtgtggtgggacaccaaaaaagggtgactaaatccattgccttctccacattcttccagtaaatgtgggattgtagagggttttgagggtagagtcctggagcacttcaacagcagaactttcacaaaggaaccagcacaaaaacaaagagggctgagcgcagtggctcatgcctatgttgataggaatcacaaccagatttgttttatatcactttaaaaatgtatacaatggaagctaagtaccacaatggtttgataattgaaaactatctacataaaacatacagaaacaagttcttttttaacacttggaaatttggcactttctctcctcaaattcacattttcacccccattttttcccagatgagattccttaatgttaacatttaaaattgattagcttttcatacttttctacagccaagattaagcttatgcatttaaatgcattttagtgaccttaaggctttactttttgttcccagattgagtaattattacaactattatttttatccaattacttgtttccttggtgctgacagaaagattaatttaaataaaatactccgctgggtagtatctgcttttcagtttccaataaagtccagaggagtgcctggaggggccttccgggaaggggtcttctgatgaatcagccgatgtgccaccccaacttgacagaaggcccccttgtcagcagtttgaaagacatataccacgcttgcccatgtatgacggttcatttttaaaatttaaatgtcaatagttgctaaggatataatttccaatgcactctttaatagcataagaaagaaaattgttcccaaactgtctgtggcagaacttttttgtatgatgtcatttgtaaccccttccatgaagtaattatgattcctgataaaatgcttgggtaatttccggatagactttaatgggattaagaactgctgagaagtcagggtctccactcagctctctaaaccacgccaaccagtctcgagctgttcttctgttgtggtgccatttcttttttctgtttgtgtctcttccaaaaaagaatcactgaattggctggcttgctgggagcctcttctcttgaggccagtctgaaatagaattctgacacaggctaataacaagtttgtctgacaagttattttaagaattcacattttaaaaataaatttgttacatcattttcaaacgatatccattggaatcgaaataccatactggcatgatactcaataccctacatgaaaaatataggagttactttttgacacttggacattttacatttctttttcttctcctcaaattcataattctgcctctcattttatcctaatataatatttcttacaactaaatttacaacttacaatttcttaaaattgatttacctcaggatcatctatggcaaatctgtaaatttttgtggccataaggttttttgtgttcctgagttgagtatacaattactattacccaactcataaaaatgcacaaatatattacagttttgacaaataattattaagtataaaatttaaattttattggaaataaatctcttaaaagagatgggactagtttattccctctctcctccatccccagaaagacacataaccataaataaaaactacataatgctagagggaactagtgttcaccagtgagtctattcttgttttttatctttacggatataagctctgaggagggctgttcatgtaacaactacatgagattggaaagagttttgttatagcaacgttattcaactatttgaatttctggtatattcaaaagtcacattaaaaaatctatcggctgtcttcactagaaactctttcaactttgttgaaagcaaagaattggaaaaccagtttccaaaaagatttgctccccagtcattacagtccaatatagctccaggatttcaaatcatgcctttcagtaacccaagaattctaacactccagggccatgcccagtggtgtgtaggtaaatttactctctggggaaaaaagaaaaaggcaaagaaaagaaagccctgctttatagcttttgttcgtttacatggtataaaggcttccaccacagccaatttttttttctttttctttctttttttttttttttttttaatgttcatgttttgctctgtcacccaggctggagtacaatggtgtgatctcagctcactgcaacctccacctattgggttcaagcaattctcctgcctcagcctcccgagtagctgggattacaggtgcccgccaccacaccctgctagtttttgtatttttagtagagatggcgtttcaccacgttggccaggctggtctcaaactcttgacctcatgatccgctggcctcggcctcccaaagtgctgggattacaggcgtgagccaccgcacccggccaccaaggccaattacaagccactaacctgacctcactgacacacgcttgggatgacaggcacacagtcagctctccgggccagtatgagacactcagtaccgcagggcatcacagttagattcagacagagggaggagtgtgtccctcttctgagaagtgtgacagatgattgtgaaaggggagagtgaggagagttgtctgaactcaggggtgtgctcacggaaatcggtttatgaaggagtacccatgggtgttgagaacattgattcttctaaacatcccatgcctgggtactccttgggaaggctgtgccaccatggttccaagtgcagcaatttggaggctaccgattcaaaggatggagtatggaccttggagtcagccacaccagggctcaaatactgcctctgtaatttatgattattgagaacttgggcatatagtttcaacgtcttgagtctcagttatctcctacaaaatacaagaggccaatacctaccttgaaaggtttgagagcaaaaggtagtatgcatacagtgttgtatccagcaggtgctcaacagatgaatgctactatcagagtccttttaattgagtctaagtgatgtgacttgaagggttgaggattagggtatcaggacctgaacccagtgggaaacatcagatcccttgccatttagggttcacctgctccaaagcaagtagctgctttggttccatctaaaaatgttgacttcaaaacagaactttcagcttatttccctctttttcatacacatttcatcttataaaatgcagaggctgggatctctggtctatatggaagaacacactcaacagcaacagtagctctcccagggagtagaactcaagactggtctatcttgtacctaaccaggagggttattaccaagaaacaagagtctccttctaaggtggtttcacctgtaaggcaatcccttagcctggtccctgagggcttcattagagtagggtcctggtgattttactggcttgttaagaaggcttttcaaagtcttgtgtaatgatgatgaatggcagggcaaaatcatgttaacacattataaacaattccaggcacaaccagtatctcacactgtactttatttttcttcacaatattaactagacagacaaggaaagtttaatggcaatgtgactttttccaacaacacaaacaaagtgccattatagctaatggtggccaactggagacttactttaccttaaccatgtaaagtatccttaccgtattttttatgtgtacagtgttgcagaatatcagccacctcttaaaagtatcaatcttaaaaagagccatggaaggtaaaagtatgaaaatcttgataacaaaagctttcaatacaaaaacacttattgtacacttatttttatttaaaacaaaaataaccccagtaactcaaaacaaaagcaaaccttggttgaaaacttaagaaggtataataaacaaaaccaccaaaagaaagcttccccaaaagaaatgcaatccactgtcactcttgcaaattctaccttggagggaaaaacttaatgaaatgagctatctggagggcccacggcagattttccaaaaggtttaggtgcatggatttactcagtatctacactacagtcttatttattaatagtctcagaattttcttgattgagcgagcctttccatcctccaccagtgttcccatcttctgtgctcagcttggtatgcagaacaaccttgttgttgataggatgtttgcttgaagttatttttctggggcagtccagatgaaccggtacagtaccattcatgctccatctgattttctttgcatccagtgagatgcatatttcatgattgtccaaggtcatggttgtccaaagacatggaacagaatgattcactgggtaagactaaaggacttgtattatcactctccaattcagtttcacattgcttaattttataaaatttttttctgtattgtacataataaacatttagaaacagatgtccctaccaaccagaaggttgtcattaaatatcctgttagttaaaactgcacatttattgtttaaatacccattagacatatccagcttgaaatttataccattgcactgccaaacggagctgcactttgagccatgctgatgtctctggaatctaaaggtcgtaccacaaacttcaaaatgtttctcatttgtcacacaaggttcttcgcagaggcatcacatcgaccccaatacaggtccttcatacccttagttctggttattctgaaaacttccaactccctgatccaaacttgggaatgttttacatttaaaaattcttcctccctcccacccctccaacaaatgtcctttgtcccataataatttaaaaaaaaaatccctgaaagatccaaattgaataacaataaagatctgattggaaccttcataagcttgacaatgtagaattgtatttcttaaaaagtgtgtaaccacatttgtctgggctgcaaaagacaccacagaataagatcagaatagaatttcaactgactccctaatttccttagaatggcttgtatttcgagcctttcctgtttttctctgatagagtaggtgtacattactaactataagtgataagaaagtctaaaaacagccactgccttaaaagtacagttggaattaattagagtttaagttcacatttataaactatttgttttaggataagttcaattacaaatagagactatttgcaattctgttcactcaatagatcctggaggtgaaagctagacatgtgttgggattgccctgattatttacatttaatcttgattattataactcctctcgatttataatcacttcctaatttttcccactgggccagagctacatctttagatgataagcatttactaataaaacaaagatcacatataaatggaaggccacatctgaacacagagaggtaagtgagctgtggagagaatgttggcgtcttgtttgaactaaattgaggtgcttccttaattctgtgactttattccaaatcttaagcctgccagagttttctgcccctgccaaatcttcggagacgacccgatggccatagaccctgtcagctgtcattctggcctctcttgcggagtatttgtgcagcgagggactgggagggccgaggaggttctcagatgttcttctccttttggggctttttttagagcccttgtccccaatttggaaagtgcatatactctatttaactctgaccctggccagtgtaaagaggagtacatacagaggactgttttttcattcataaagagcagttaagatgcagatgtgaatccctcttcaatacaaaatagggatggttctctgttgcccaactgcaaaataattagatataatgaaaaaaaagaagaggagaaaaaaatgactagttgaggcttttatatacattcattgcttctaacatgtttttaacaataaggaaaatgcaacatcaactactcttagagcaagtgcagccacaatactgtacagttctggggccaagaggctgggcacatttactgttattaaaaccaggtaacaaaaccccacagcaaaaggcagccagccagcaattagcccccgtgacctcttaatatatatacatttttcaaatactctgtgaatcccgtttgaacaacaacaaaagacaaaacaggctttatattaaaaacgtccacgttcttcattgttacttctaaagcagcttggaggatcttaccacgtggagcatactgcaaactgactccattaaaatgattttggcaggatagcagcacaggattggatattccatattcatcactttgacaatgtaaacctttcataaaataatattttgcttaaaaattagaatcattcaaaggtctgatcattctgttccctgaggcccgccggggaggtctggcttcataccacaggtttcctgctttcttggtggagcgtaagcaccactgcatttcaggaagaccctgaaggacagccatgagaaagcccccgcggaaggagggcaggagggctctgggtgggtctgtgttgaaacaggccacgtaaagcaactctctaaaggtcaaaccaccatagatttgaatctgctggtcatttgccatctggatttttaactgaatgaatctcatgggtttaaccaaacatgcatgtaatcctgaataccatgaattaaatgcggaattgcccagggacgaggaaaccttcaagaaacaaggtcaaagggacaacagatataactgtcacaataaacaattctgttgacgtggaaatgcacatgacttggttgaaacaaagctcctcagtggccagtgacatccaggtttttcttaggtagctgagactcagggcttatctcaccttctcagaatgcttttgaagaatcaagagataaaaatctcaaacagaaaacgatcacctttgctcacaaatagtgtataggccataactaaatacaattaaaaacaaaaaaacgctgagatgcatgtatttttttaaagcagctttcgaaatatcaaccacagcattaaacattgaacagagtacattccaaagttaatacagataaatggtatataatgcaataatgccacagagttattccatcaatgtttcaaggctgattctaaactggaagaaaaaaaaatttcctagtttatttgctgaagatgtcacttcttttgttacttctttatagttccccaccattgattttttttttaatgccccaggatgtacagataacccccatattccacacctggaactttttttttgtcaggttttcaaataaaaccaaactacagtgacaagataatgttttacatgtaattccatagacaggggtcaattaatccatgacacctcacttcaatgcttcttttaggatttgtgaccctctccaaagtcatttaaagccttgctttaaactcacaggtgggccaaggccacacagccaacgtgccatgtgctacagccaaaatgggccgtggccattgcctctcctcacgttcccagccttcaccatgtccttctgataggaagggcccagggcctctgttccttccctctacagtgatacatgtcttaagaagggtcgtggctcccatgctccacgtgaaaacgggcctacctggagggccccagggtgacaggcccagccacacccctctactgctctttcttgacagtggaattctgagctccatcagcttccagacattcggagaccacactgccctgttgatcatccctggaggaggccagtgagggccccggctcagttccaggaccaggcctccaagctgggacacaggcaggttctgcggacttcggtctcctaaaagcaggcacttgtggcggcctgatgctctgggtaactctagccttcctgatgcggaagtcaccgaaatgttcacttcctcaagttccagaggattctgtttcttactcagacagagccagtattgggagttggggggtgcgtatccaaaatatatgaatatacacaatcagggcttaaggtactggatgatattgtataaattgctaaaatgcttttctcggcacaattggtagcttaaaaaaatactttcctatgatttaagggcatttttcccatcgctgtccttcggcgtggaaatctcagtgggtactaggtccatctgaagttcccaactcttttcctcccaccaggtatgcatcatgtgagtcatatgcaaagagtctcttcttcaggccagggaggcatggacttccccccacaggaaccctccctctgttaatatcacagcccccagggcaaagaaatgcaagtgaatgaacaccttctccccagcctccagcagccagaaagccagcttccccaatgatcaggtcctttttccatccgtctgctcttcagatggtgatccggccaacaacatggaaagcgaatctatgtttacaggcacagaacatccaggtggagccacacgaagcggtgcttggcaattagtggtcggatttccaaagacaggagttttgatgggactgtcttaaataaataaatctttttttcttaataatgtaaaaaataaatgatatttccctttggcagtaaatagctgattcgacgttttgcctgaagactgttaattgttgtgtgtgtgtgtgtctgtctgtgtgtgtgatgtttatatgtgtgttattttttcttaaacagcctgcagctttgtttcatggtacatcactgacaatgcatattatttctactgctttagtgaaccttttgcatatttgtttggggcaggcatgttgacttcacttgtggcccagataggcacccagggtgatgcaagctcccaccagggccaaactgagcagagtcttcagagacagccaggagaaatcaaacagaggccgcatgctggggccgtacagttccacaaaggcatcctgcagttgggggagaggagggaagaaaaagaaagagtattagagagagagcagagaatgccaccccacagagaaagaggcatcctgccagggcagcctgggcaccttcagaagggtgagaggggaaaaggcaaatgctctttggaggccatgattcagaaaccactgttttcattaattcaaggcatatttattgagaccctctttacgtgccagccatcttagagatacagcagtgcataaaatagactaaaagttcctacttcacgaagcttccattgagtggaacagtatagacagcaatcaatataaattatcacatggtgtaggagagagtgctaagggccgaggagaaaaacagcagaggcagttagaaaatattagaggttttgcaattttagctagcatgcccatccataaaagtaataaaatctagcaatgatgatgaccgtcacactcctcgattgagtgttgacatcttatcaaatgtctgacatgcattattttagtctttgtaccaaactttttctttctttttttttttttagagacaagagtcttgctctgttgcccaggctgcagtgcagtggtgcaatcatgacccactgcagcctcgaactgttggactcaagagtgatcctcctgcctccgcctcctgagtacctaggattaccatgcttggctaatttttaaattttttgtagagatagggtcttactatactttccaggctggtcttgaactcctgggctcaagtgagtctcctgcctcagcctcccaaagttctgggattaaaggcatgcgctttctcatccagctaattctttgtaccaatcttatgaagttattttatttgtttctgttctgaagatgaaaaagctgagaatcgcagggaataagagactttttaacaagtggcagagccaggctttgaacccagatagaaaccagcacccttctctctgctgatgccctggcgtggctaacggcagctctatgagagcatttggtcagtcaagggctcagtcagtggaggggccaagggcggccttgactggtgcagtgccaacctctaaggtcaaggttctcctggggaaagggagctgtcagggggtttctcttgggggtggctagactggacgaccacaactctgcatttactcaaattgtggatctcacaaggcaggagatcaggggtgtgtcactggatgtgcaggtccctgagagacaaaaagtgtctcccttccattcctatctctccatctcaagtcgggtctgtagtgtgttgtagcaaagtctaccctctggatgggcttggattgagcaaatcaccaattgctcatttcctagattttggggagattatgtttcacatttgggtccaatgagtatttggacaactttctgaatgaatatttgaatatataaatcagtaaatgaattctttttacttctgatttattcaggatgaagaagaaaacaagaatagtttcacattattcccaacaaccctgactcaaagcacacagttttattacaggaaacagtaacataccatgaccctggacatcgctgttgggaggggctccaacagtgcacagaggggttccctttctctggggcaagggctgtagcagtgggaccagggattctctttgtctccctcatgctgggcatggttgtggtgcactataggtgcgtagtaaatgtttgttcacttaagctttctgaatacaatcattggtctttggcttaatgctttacccaaatgcttatgaatctgtttgaaattactccttctatatgtaacagcctctgagaatcctgaggtagtcttgatgaggatttaaagcattgttagggtaactttccacattattaaatatagatttatacaattattttcatgatatataaaatgtgccatactttaaaaaattcatgtttatagtgtttaaaacttttgctattataaacaatatcatgatatatttttgtatataaattcttgtctatttgttcagttgcttttttgaaacaaactcctagaagtgacctcagttaaccagtcatcaatattgcttccagacatcatgaagggcttgccttgagccatcctcacattctcatggattgccctccaaccaatgccaccttttacaaaaggcaggcaagaatttagggcgagggtcacactgagagtgatcctgtcccccaggggacatttggcaatgtttggaagcatttttagtggtcatgatttggggtgagggtgctactggtatctagtgggcagaggccgcggatgctgttcaacatcccacaatgcacagggcagccccccaatgctaacagggccgaggctgagaaactctggtttataagatgctctgtaatcacagaccatagaagaacagatgacccatcctgtgtgtcaacagcattggtcaaatcagcacaatcagctagcccagaccagcgactgctaacccagtgggccttctgcatctttggaggtccttggttaacttttaccaggagagggcgcaagggctttcttcttctttttaaatatctattgttaaacatttctaaatttcagtgttagaaaagcgaggcaatagacgtacataaaatgtgtgtttagtgctcttagcacagagctaaggcacaatcatgattgtctgccaagatgcacacccctctccatataagcagggatcagtggggcaggaaggagtcaggacttctccacaagccagaactctgcctcttccagggagcaacccaagacatcacagacacggctgcaaatgtcaactagtcctcccatccatgcttctctctctgagggatgggtaggctgaaacccccaatagcccagccaaaagacaccccaaatttgtcagggcactggcaataggttgtctgcaatttggcttgacattgagaaggtcagtggccgggctctgaatccctttagtaatcaacagagttttgtgtggcaaaatctgaaccagactaagcccctgatcatttgtcctgtctggacctgaagccatcctgggaaaccggaggatgcagggacatactccagctggcattttctcccagttggtctggcacacagtgctggagagcagaagaaatgctgtcccaaatatccccacctcctcagagctggaataattccctctcaccaccctcacccccacacaaataacagtgcttctcatgaacctaacaggccatttctgatatgcattacgtagaacaatgtcatttctagagtgagatgagctaaactagcagctcttggcccaaagcctcagcatagagatgctgttgccatcccagggggctgagaagggcatgggacttggaggaggagtgtgggtgaaccctggctttgatattttattagtttataaccttcagcagataacccagccccgagcctcatttacttcatccatagccataaaattcattattgtgaagattaacgtaggtcactcaaagccatttgtaaattggatacagaaagtgagctcgtggcagaacaaacaccttgctcttgtctgtcctcttgcagacctgctccgcacctactcaacctgcccttcccccaagaagttctgctgagcctgccgttttgcagaagcaatttcctctcttagctttctgatctgaggatagtccgtaatttctataggaattatgaattaaaatgtatacatcccgtgttctggtcaaagatgggaagtgataatacaatgcctacctatctgtccttctttacacattattagagtgtagggctagagggcaagtcatttaaccccctggaggttggagctggcctctaaactttgcccttctacaattccaaagtgcaaaggagaccctgcggcttcgggactaaaatgacctgaaagcttctttcgtagaaagtcttcctgatttttcaaacatcctgattggggcgatttccgaagtctgtttgaacagtctgtcattatttgtttgagtttgaaagctgttttaaataaacacatgctcattttatgtattaaaagcaacaaagagggaaaaagaaaacctgggtcgtcatgtgattcggacaaaatcccagtctatatatttaggaagctctgtgtcccttgctcatgtcaggactggcaagggcttacccgacttcacggatcacaggttcacacggaaaggctggcaccggctcctcctatgaggaggagatgggcagggcctcagctctggtggctctgtccacagtggcttccccataaatttccaattcagaggccacagaggatctgagttccacccagggctggcccaaggggacaggatggctaaactcccagccgcagccttgctgcaggtttggaaccaggccaggtaggtgtggacgggaacagaccagggtcaagactcctaaactcagcaaaggtgtcctcacccctccgggccatggagcactcccacctgggaggcagccatcctccaacattttccttttccgttcagaaccttcaagaatttttttttttttttttttttgagatggagccactgtcactcaggctggagtgcagtggctcccaggttcaagcaattcttctgcctcagcctcccgtgtaactgggactacaggtaccctctactacgcccggctaatttttgtatttttagtagagaaagggtttcatgttggccaggctggattcaaactcctggcctcaagtgatcctcccaccttggcctcccaaagtgctgggattacaggcatgagccaccacccctggtccacttcgagaaatttcacgtaaacctaaaatgagaattttttttaaaaaaggtcagattgtcaagaatggaagagaaggttaattctaagtgctgaaaagaatggcatgcggttggggatatgggcgggggtcccaaaataacccttatgcccaggtaaaggtaaacatggagaccttttgaatttggtaatgcatatcaaaaggcttttaaaaagcttttgttagtaatttcacttccagttatttattttggaaaaataataaagtgcacagattatgtataatagcataaacctggaaacaaatgtctgaaaatagatgactgacagcgcgtccacatgatggagtgctgttcagcattaaaagtcataccctatagttattggcaagaaattgtgttcctaaggtcatattgagtaaagcaggacaaaacggtcagcaaaacacgattccacttctgtaaaaacctaacatatacatgtgcgcgtttacaaacagaaaaaaataatataaaggaaaacgcaaagatgttaacagtgattatcgttgaaggcagaagtaggcatgaggacatggcatttaagaggctattctgatttttttccttagctgtcttttctaattcaatacaaacatgtatattactatttatgaaatatatttcaatatatactacatagaataatgttacattctaagtgcttacttaatctgaaaaaaatccagactccataatttgacagacaaaaatgctgggagatgatgtctagtagtggggagacatgggctcccaggcagcagccatgacctagaaccatgcaacaggcccccggttaagtgagggcctccttagaccctggcccagaagaactctcatgagctctgcccctcagaccaatgcctgcaataagaggttcaggccccgagctcagtgtgtgttctcagctctctatatactggggaaatttaatatggcttggctggctataagcaaattcgaaattcagctacattccacagtctttgagctgactatgcatgcagacgttatacaatcgaagggaattctaagggagaaaagccaccctgtccccaaagagcttacactctagagagaggtaatgcctctatgtgcacatttgaactaaactaaatcaatgggtgccgccattttgttcctgcagactgcagagtctcatcggcagtaagaagaaagtaaaaagaaaatcagaccatgccaatgggaaatcaaacacagctatcgaatgactttgatattttctatttttcatgagtttataattttgtctccatggggacctctggggatctcttctctcatgacaactttagggttaggaagaaaaaaggaaagggagaatcactgtaacagaaaactctgggctggaaggaacctcaaagtatgttcagattccctgaattggtttaataatgtctaataaagatattagctctttttttaaataggtgaggtgagtgaaactttgacaggtaaagcaaattccttacagtgtgtattcataaggaaattcgtggtggacaggagcgtgaaggctgggtttcacctgcctcctgcatgtcactggttagaatgctggcaagcagctggttcttctctctacccagggaacctcctccctgcctccctcaacttgcttcctcccatcccgaccttcctctctgccccaacttggactccagcccaaaacaagtctcatctgggcttccaagtggtgctgaagaaagttacccaaccttgcaggcaggtgctgctggaaattcatggtctctaaactcagtgagttctgacaccacctagcaattctttattctttgtcagatcttttctgttccttttgatgactgttcccaacagccaccacttgtctcacacatcttcctcaccttttggcagtgaacactgccttttacttctctgagaaaactgggatcattgggcaagaattaccacagctttccaccctggcccatgcacaaatgtccatttctgcctgtccttccctgctcctctccacacttcaccctgattccaccatctcccattgcttcaggaaccttcctccgtcaattgtccctgctctcaattacaatttcaatcgcatccttcctttctgacctcaggtatcctcaaaatgtctgtgctgatgcgtgctccaccctaaccattatcttctctgtctctgccctcctagaaaagctgccaagccacactcattggctcacttcccacccacatttgaacccattcagtctggcttcttcctatactgtgcctctgaaaccacccccacagagaccaccaataccctccatgtggctaaattcactgggtgtgaggttgtatcttagtaggtgctctgatgccccggacaccaagaccactgagggtcttccgtgactctgctccctttgggctacctccttcctcctgaagaatttcctctctgtctccctcaggggcacctcctccctggcctattctgataagttctcgatgctgcccatcaggcttctgtctggacattttcttttctctctttgaccaatctctttcactctcttggtcttatataccacccctatgataatgttcctaacatctttatatccagtctcactttctcccctaactggcaaatacttattccaattgctttctaagacatcccctagggagttcgatcaacctgccccaaactcaagctatcatcactccctccatcaagcctccctctcttcctgtcttcaacctggctatggcatcaagtaaacctacagcctcagagtctcctagatgtttttctcttcctcatgccccatattcattcaacagtaaatcccatggccataggttagactcccttagaaacagaccctaagacaaagatttgagtgcaagtggtttatttgggagatgatgctaggaactctaaggggagcagggaagggagagaaaaaaaggaaaagactcatgcatgagttacctcatcaagcaagttattgctaccggcaaacagagcttactcctgccagggaaatctgagggccggtgtagaccatgcatctcttgttaacccactgagggactagggagctggggtatttatacaccaactcctgctattcattggttgaaggttgctcctatggaatgtcaataccccagcactcctagctggccatgtcacaggtgaagtaccaatcaaggaaatagatacagatgccacatctcttatagctggaggtgaagttagtgagcactgaagtggtaaaggccaggggacaggacagaacagggcagtagatgcactgccaattttaccacctgaacacttctctctccctttaccttctctccccaggatcactgctgtgatttccagtctgatctctctgcctctgtctgagtcttgtgctttgcctgtaaatctcttctgtgtactgcagccagagtgatccattcagaatcaaatctgttgcttccatgcttaagtctaaggttcccaatgctctggctccaacctagttctcctgctcagcttgtcactcttaagtcaactttggttcattcagagattcagctcaatcattttctgcaagcaactttctccaaatccctaggttgagctaaataatcctcggctgttccctgttcacagtattatacgaagatcatctgtttacatgtctgccttccccattcaactattagcacctggaggtgcaggaccatgttttatttatctttggatccctggagcatgtgtctgtcatacgttaggaactcagcaaatgtttgtggagctgaaacaaactgatttgttttactatatggcagatttttcaaacatcctaatagataatatttttttaaaaggggagtattcagagaccaaataaaggactggcttagataaaattcagtgctttttttttctttcagcagcagcctctagtgtcctcctcccagggactgatggttagccggttcccaaggacacagagggatctgactggtcagtgtccctgctatattggttagtaaatattatcacccccactcacaggtgcttgattctccaagaaagggagtagcattttccaaactcatttggcccctaacccctctgtcaaggagactgctgctatgtttggagtattaggaagacaaactttgacaagtgctgcctaagagggtgaaaggacaatagcagggcattggcaagaggggcagcattggtgcctgtggtgcagggcaggggagacgaccagaggtcaaaggctgtttctagacatctatgcaaacgtagagaccactgggtatgtcctgatcctagattccaccaagagggctggagactcattggcaatactatctgtgactactgcggccacacagaatctatgacatgcaaccgtcaggtgagagagaacgccaggagaaagagaaaggacatgaaggaggaagtggggtagacagacacttgtcttgcagaaagagcgctccatgaagccaagcaagattctcctgacaccagagttggctcagagcaagagggggagcaagccgcactggcggctgggagtggtggccggcagagcacacgcaaggaagtgaggacttttttctacctgaataaagcagctggtgaggaagtgactccatttccccccttatcatcggctcggcaggatttcctccacagccacattgtgctgaatgagtctagagggttccgtctgcagagcagtgtggctttggcagctgcatgcttgcttctgtcccctgtgactcttcctcccgcaccctccctttactcccaaaatattgtttccgggtttgggggaaaaggaaagggaaaaaaataacccttgagcatataactgaaggacacacagctgcctgggccggagatggtgaagaggcacgggagcgtgagaagcacaaggatttgccttcctccaggctggcgaaggctgctccccaaagccatctccagtgcctgggggttgatcttggaggaactctgggtccagggggaggggctggttgaaacatgggccaatgacattcgtgaaacctaatctccatgtcatttggatgtaacaagaaacctgctggagacatggcaggagatgaaaaacccaaacaaaacaaaaacaaaacttgcccgcttaccacagttggtccagggaagttctggtgtgttctgttatgcaaatttagctaagaatgcaaatcaggcaggggccctcaggagctggggaggctgaaaaatgagaagcccaaatgggtgcttcctttctctggcattattttcacagtttgaaaataatgtgcaaagatggcttatgccatgggccagggcagaggaagcttggccccaaccacctgctaatggagacttcagccggagctggctattccagagatggacctcagaggattccttagtctaattaccttctgggctggggtagaagatggtgtctggagggaagcacagaaccaagttccctactgccgcactagctatgcaaatactgcagggcacctgtgggctcatgtccctcctgcaagaaggtgtggtcagtccagtaattcaaaagacgtacttctgaaataggtggagaaatgcatttatagcaaaaagtgctaaaaatatgttaatagttatgctatttggttcaccaggttagtgtaataaaccataacaagagagactaaaggccgtatctatatgaccttgaaatctcatcttcagcgggcttattcattcagtaaccaaactatttttgtaaggtgctgagtatttagcttaaagctaaataagacacatgccctgccctatagtaactgcttggtaatattcccagtggcttccatgggcctgataattttcttagtactgaattcaaagcactttgtgtcttgtctgcaggcccatttgcccagcagtggccttgccaggagagaacaggcccatgctcctgtcctcattttaaggcacacctgaagaggccctaaagaaagggcctatatacacacaggcctcagtcacctgctttccagtgttttggctttaaaacgaagtttcttcatttttcttcctaccttcctcattccattaccttcttttggctagagcttccgagggccctgcctgttgtggtgctcagccctctcttgttttgggcttatgctatttcactgtttcggggggaagtatcaagcataaagtgacaaacttaacacttttatgatattgtgttggacatgaaaatatgtccagcaaaaaacttaattattataactcaacaataaaaacgtaagtagctaaattttaaaaaaggccaaaggattctggtagacattttaccagtgaaggtacacaaatggccagtaagtgcatgaagagatgcttcactatcattagtcattagggaaatgcaaatcgaaaccacaaggagagatcacatccactagagtggctctaattttaaaaatagataataacaagtgttggcaaggatgttgagaaattgaaacccctgcacatgactggtgggaatgtaaactggtgcagccattgtgggaaaacagtttgctgattcctcaaagagttaaacagagtcaccacatgacccagcaattcaactcctagtacacccaaaggaattgaaattgcacgttcacacgaaaacttgtacacaaatgttcacatcagcattattcataatagccaaaagtggaaatgacccaaatatccactaactgatgaacaaataaacaaaatgtggtctacccacataatggaatcttacaactcagccaaaaaaaggagcgaagcattgacacatgcaacaacatggatgaccctcaaaaacatgaggccaagtgaaggatccaggcacaaaggccacccactgtctatgagtccattgacatgcaatgtccaaaataggcaaggccatcaagacaaaaagtggattagaggttcccaggagatggggagacggggagactagggagtcattgctaatgggtacagggcttctttttggagtgatggaaaagttctggaattagctaagggtgatggctgtataaccttttgaatatgctaaaaaccaatgcgctgatcactttaaatggaattttatggcacgtgaactatatcccaataaaagagcttaattatgttccttacacgacatgaagagggactaaactatttttataccatatggaattccacagaagtactggcttgtgatggatcctcggctcacaagtgtaatgaggaatgagacgctgctggttagaaaatgtgcaccactgtcattctccaaaagaaaaaaaggaagaactgtagtaggaggtggcatggtttgtgttctggatgagaagttaggggtcggatgcatgagcagcaatcggggcactcctacttgtaaggtgagcagctcacttcacccctgggaccttcaattttcctcatctgaaaactccgccgtagcgaacctctaagaagtctctctccgctctaccatctgggcttacctagttagtgaccttattcttcaccctttctcgtgcatccttgaggatgtgacttgggttctgttggtgcgtgccagagctgtgttactgtaactattgcagaggatctcctgcttcctctctgtgtggtccatctcttccatccgccacttctccactgctcttctccccacctggcctcagaccctcctgctgtgagttaggaggaggcctttcttggcacagcactgaagctgtgacctctgatgtgcctctgtgcttccaatctctttgcttttatgagcataatccaagttatttgtcccagaccccaacccccatatgcccacaaagccctctgcctctcatgccagttttaattagaactggtgacatcagtgtggcttaaagtagggagcaggtgggaagctctgattatattcaataccgaacaggactctccactgcctgacaggggctggggattccacaggcagactggcgtttggaatagatccaccaactcttttttcttgggatctggagccacacatgtggctctcctccccaccccacgccactgtccatacctgtctccgtatgtgagtagaacataatcactgtgtgctccacagggattggcgacaggcaaatatgctctacttgtcggtcatgatttgggccaagcgtgccgtggctcctgtacctgccatgtgactcgtgaacacggggcatggcccaggctgcctccctctatttttgtcactgcaagagttaattcatgaaaatacgccaaaaatgggaactgaaagcagatgcttgttaagttctgcagcttggcctaatcgctgtcatcaggacatcgctgctgggggcagtgaggggagggagtccttcatttattaaacgtggagggccagagttaggggccaaatgtttggttttcacttgtttaaatcagtaagtgttgactgaggctggtggtgtggggagtacaaagaacctgcatgtcctaataggaatttgctgaaagtggcctcagacctggaggagggtatgtagaagaaaaagagcaaagcagactaggctggaggatgcggcatcctcagccagctgggcactgccagcctccagccctgccttgtctggcacttgctttttgggactggttaagaaatcagcctgggcatcttttctggaagctccacactgcattagctccagggagccctgatgacctaccgcaggcccagacatctgtcgaggaccagatgcaccccggatggtgctggttctgttgttcttggtttggggcaggtaagtcacaaatggctgaaacttcacagcctgcttacatcccactcaaaagcaccccaacgtataatagtcttactcagatcccagctccccagttctgcagctcaatgggtcattctgtgaccgtcaaagtgactgcgatgatcctctgagaagcccatgggagaggcttcttatccacaccatcaatctaccgatcaggaagagaagaacaattacatcctctgtgctctgggggacaaggggagctgacggatggtggtgaactcctcagtgagctccatatgggcatgctaagaaaaatctgctttcattttgtagtttatgatttagttcagttcacctggaaagactcaacatgaataaaaccagatgcatttcaaggaacactgcttggctctttgacaatcctcttccttcctcatcagacagtcttcctgtgcccagggaagacagcagacctctctatcacaaggaaaatgcagtctctgtcagtggcagcagctgttagtaccaggacaggtaaatggtgggccaggtcagcctgtggttctggatcctggctcattaacatatggacaagatacgctggcgtggcctctcatctgaatagctgtttacggcgaaggacctctgacagtatgctttctgttgcaagaaggatactgctgtatatagaactagagagagaagcaaaaacagaaactcagagagagaaacgggagacccagagacccagaaagacaaagagaaagagaaaaagagaagctgaaagcaatcatggatgagttttaagtgagtggaggggctgaaatatcttccatcagcacaacctacaggggcacagttgacagctggctgacctgacccaaggacacgctctcacagtgaagccagtgaagctggcctcctgggggcaggagcaaggtcagaacactacacgtgcccactgtacaaggcctgtcagcattgtcagcagtgggcacttaacacgagaaaagtcgtgcccctgggagatccacttccaaggcaactgtcacttcccgtcaaacgctcaggaccggtcagacacttttgcagcttgcagcggcgagcctgggggaccctgcctgcagaagggatgcaagtatgtgctggctgcattgcaaatggaatttgaactgtgctacggggcctttatacaccgactattcctcaggcaaaaatggcagagccagaatattccaggtgggactggcagctgagtggtcagtggccatgcctatgcatgtgtagcactggcagaaccttgctgccattgcagaaaccttggagcgagttggctcaggttgcattcagggatgcaaacatttactgaccgcctgagttgcacacagcattgtgcagagtgctgcaggggagatagtgagcttgactccatgacaatgagctccttaaggcaggacatcatgctcatcacccaaatcaggtactcagtaaacgctcttccaatgggatgactcagagatatgcacacctaaggtcgtaggaataagctcaagtttgggctggtgaaggcttcaagagaaattttaggtcaagcaaattgctatttccactgaggaaaccccttggccaatcttggatccacaggcaacatgtttttcatagtataattggcgctaactttggatagctcgttttagctctttctttcctctagctttgatctatcttttggacatatctgaatcgagcaatccaaccataggcaaaccactttaaaaagtatttatttagcatctacttctggctaggcactaaatctgggatgacaagagatatttaactgtggtgccaaagcccattaaggtggcttttacaaacaactctagacagaagagactgccatcagaaaggtcacacaacttgctcaaagtcactcagctcattgcagcaaagccggggttcgaatccaggactatatgactgccaggcatgtaccttttcaactatattttgcttctcccaaaggaagcagaaaagacatacaagatccaactccggctcccccggagcaataaatatgagaggctaaacaggaagtcccgaggagtgacagggaacgctcaagaaatgtaccaagagtgtttaagatgggctggaaggcggacagaaagtgagacaggagctgaggcctcaggacttcaaataaaagcaagaaaaccaaggatggtgtttcagggcaaggaagtggcatgggagtttggggccaccctggtgggtcctaaagcaagccggtgtatgccgtcaggggtgagtcagagcgaatggggccacatcaacagaaagaagaccctgtgaccatggagaaaccaccagtcacaggaccttccccatcacccccgcccccgccgccctgggcactgtgcaaggctggatcccacgggaacgtgtgcggcacactctggaagcccttgactgtggtctggccctgttgctagggctgcacgtgccatctcaagagtattttaaaatgttgtatgatatagactcaaatccccaaagagaaattctttccatattattcaggaaaagccctcctatttacagggctgcttcacagggaattctagaatgtgaaagagaacaaaatttccttgagtcacaaaaacaaatccaacttgaggcctaatttagaatattaaaatatgtggccccagagcttccacagtggcaactggattttgatcctttcaagtgatcagctcaactattcttgctggaccaaaagtggttgtgtctgcaacgtgcatgaacaagagtggctccacaccacggacagagcataagccctcaaagaagagacccagggggatacagggggcttccctggccactcgccccactgcccaagagatccagggggtgggggggcttctctgggccgctcgccccactgccccgtcacctgcttcttgcatggtctctctcctcctggaggcacccctcgtgactcctcatgactggaaacagcttttctctactcacatttaaaaaatcttcataatttaacaaaggcagatacctttaaattcctaggaacctacctgccaagtgttttacaagaacctagctctgctcaccaagcatttaatcctttaatgttcgatgtgttactggaaggccagaagtttgcaaggcaagtttgtgattgttgcagtcagacccaacaagccaaacactttctttcagcattttggcagttgcatgctgagagggaatgtgttcagtgcaacatctctaatacaccaaattaaagatgaacaaacaaaaaagcagaatcacagcatccttcatgcacagtgactataagctcagctctgtcctcagcacacaggatgcccaagaccctgctctgtggggtagctgaacagcgaggagttggtgggagacaaaaaatggctggacacggcccaggtccccaagatcccccaaacctctctcccctgccttcactataacccagacaggactcccgtcctatctcccaaatcccttttccctgccaaaattccctttatttttttctccttcactttgtcctttgctttcctgttccctccttgtcttgcattttatcagctgaagttcattcctcagctccgatccccacaacccgttctccatttgcctgttgtagtctaggacagaaaactcagagcctgaatttcctggaagacactaattccccactccctcagatacataaagaaattaagtgttggccgagtgaaacaagtgagacttctgcagccgcagccagggcttggccatagctgcgagggaccttccagcccgcctcctggcagaaggacgctggtcgtggacactgatggggaaatggcggctgtccctgagccccccaagaaatggagcgaggtaactagaggcagtgtggttaccatttgaccgtggaagtctgacaggacgccaggcctgcgatccacgctggagtcagccagaggcccgctctacaagcctcctttaacccttgaggagttaaatgctggcattgtggttatgggacaactggagagggatttgtgttggataaaggagcagaataaaaacgtctaaatttcatcttttctttgtgtgttttcacctctgccaaattcttggaattcttatgtcttacaattttatgtgcttttcatttccgtttgaaccagaaacatcatttaaatgtctttggaggtaatcctaacctactgaaacaccccgagaaactgtgaaaaaagtattaggatcacgcctggtgggttttaagaaatttttgatccccaggcataagttcatggttgatggaatatagattcaaacaggtatgttttactaacttggtacaccacctgaagaaagtgattttattaagggtaactttaaatgcgaaaaaaataatttcactgccatcatgtctacaataccttttggcgagaaaacaagaattcggagcttttaatgtttggcaatggaacacatcctttggaggggaggagtcccaggagagctcaacccctggctctgaagctcatcatgttatcctagatttataaccggataagctggtctgttctgatgtcttggttctatcacaagccacacaatggcaagctgtggggtctgagtgtcgacgcaccctttctcagttcctccacttgtggtccagggattcacctttccaggctttgagagcctcatttgtaacaggaagagatgccccatggtcctctaaaggtccttggtgacactcaagtgacatcacttttagattctgggactccgttttatgtttgtgcatcaaaagcagggaggatgaaaagggtttgatacagttggggcactgggagaaacaggtgcctgcagccctgctggcttgcattcaaagtcgcaatgtgccatcacatttattaccggtgcaaatagaggcttgaatcctagaggggattttactagaagaagccgggacgtgacctgccgtaatatagaagctaggaatgttcttgatattctagacatcaaaagaaacacaagccaaaatcttcatggcaccagacattagaatcccaggcagggtttgtaaagtcccaactatttctgcttaagaatctacccaagagatactccgacagctcaaatggcatgaaaaacatattccaataacactgagatgattttatgaaaaattaagggatgtcttctctggatgtgtcctacttctcagccataaacaatatccattatttatggtaacttttgatgataagttaataccccaaccaaaggagtttatggttttcatccctattcctcgggcaatggaaccatacatcactcaagattacagtgttattccctttggatgcccccaggagatatttcttgtatctcctagaataccctcttgaaccaaaagtttccacatttaagtcttttctcagaatgtttcattctccatgcccgacccctccctgcttggaaaatgcagagaaaatccatcagtcatttttgggttatcagactgtgacaaatttgtttttcaagcttcagaagattgttgaactgcgcttccccgctcccccccatttcagataactcaaaactggtttggatccgtgacatcaaccttggcatgtatgaagaacgaggaatgaggactttgccttgtttggaaccaaaagagaagaatatccattttctctctctctctcttttccatttttattaagtcagtattttttccttttagccagatgatgtatacttttaacattccaggaaaaaagtgtcagtgatatgcgagtcataataaaagaaaatcaaaagaaatgcaattacaagggacagggaactgtatcatttttaatataaaatgcccagatgaaaatctaatttaaaaaattaccagcaccatataaatgagaaaagaatataagaaaacatttgttattttaaaaattagcttaatccttaatctttctggctcttggactttcaactttatttttaaaggccaaaaatggtctttcggtgctggatcaggagtaaacctctcaatgatgcaatgagatactgtgaagtggcaacgaatttccctggcctctggcctgctgcctggaatgtagtaggaaaaaaaaaaaaagttgttaaataaaaacagtgaacaaacaggatgaaataataaccttctcattctccttattatagaggtatctattacaaacaaaaacaaatattcacatggcacgctgttgttgagaaagtgcttccatatagatcatctagtgtggtcctcccaacaagccacagataagttattactgctgtcacccctcttttagagatgaccaagaatacgtaacttttccaaggacacctagttaatcaattatgaaaccagaactcaaacccagaattctgacataaaatatcctgcctttccactcaatcacgcggcctccctaaatgtagctatgactcccagctaaacgggcctgcccagagccacgaagtcataagtgtgcatggagcagcgacgtgcttatgctgacacctctgtctctttgataacgtttacattatgagaaaagaatcaagctcatttatgtcagcagtccacaacctttttggcaccagggacgtgttttgtggaggacaatttttccacgaatggggtgggggatcatttcaggatgaaactgttccaacacagatcatcaggcattcggttcccataaggagcacacaacctagatcccttgtgggcacagttcacaatagggtttgcactcctaggaaaacctaatgtcgccactgatctgacaggagccggagctcaggcagtgatgctcgccagctgctcacctcctgctgtgcggccctgttcctaacaggccacagacccataccggtcccgggctatatgtataagttgcaactgttggctggtgccagacgactttcgcttgttctgtctctgtttctcttctagcccagggagatgtcattctgttaccctcaacccatgtgaggggaagctggaactattcacgtatttacagggagagtccgaataatcatgcagtaacccagccttcctttcaaactctttgcttgatgtaatcgccaattttcatttcaggcctgaaaaataacactgttatgacagtgaccggcagatgattaacagtgaagaagagaggagatgtcactaataatattgatttttaaccctttctctagtttttgtttggaacaaacacagtgcttaattatatggctctctacagaaagggttctcctgacatgaggcatttatttatttatttatttatttatttatttatttatttatttattttgagacagcgtctccctctgtcagttacccaggctggagtgcagtggtgcgatctcggctcactgcagcctctgcctcccaggttcaagcaattctcctgcctcagtcttcccgaatggctgggattacaggcacccaccgccatgcctggctaatttttgtagtttttttgtagaattggggtttcaccatgttggccaggctggcctgaaactcctgacctcaagtgatcctcctgactcagcctcccatagtgctgggattacaggcgtgagccaccgcgcccagcctgacatgaggcttttaggtacagaaagagaagtttcctttgtccagatgcaattttcccctattttgcttgggtcagcctgaaaacgaaagaaagagagtgacctggtggcaagatggctaaggtttctctcttcttcagcaacacccagctgaagagtggacaccagtgaatgcactctgctcctatcttcaatactgtgggcccaggagggctgaaagaaaagcagaaaaatcactttcctgcccaacgggcattgtgatggttttttttcttttattgctaacgtacgtcttctcttgtttttctttccctctgcgtctgaggttgccattccccactttctctccgcattttcttggctccctccagttttctctggagtgacttttccctttctctgtgaaaccatcacttctatgtattttccgtgtcccatgaacatgccacaagttctagaattagactctgctcagccttcccgtgagctgttttagtctgatattccagcagtctccaggtaggaaaaaagaagtcgatttaaatatgaattcctataaggctgaagctaagctaacacattctggagaccttgtggcagaaaaatgtccagaaatattggactataacataagatttgatgcttaagaatgagttatcaggtttgggggtgagaaggggtattaggtctccaacctccactgggctactcctgtcatatttttcctagcaagacaggcaacactcctcaaaggttactaagctgcgcctccaccaagaaggaaaatgggactcctttcaccttgagctctctttgtaccttcagcaaatgacttctgaagtcatcttgatctcctcttctataatgcaatcaggggcattccctgcttctctgtcatctctctaattactgaaagaaattttcccccttcttgtgtttttttctataattagcctcatagattggtcaaattcgtctgtccagatttccccccaaaattcccttctccacactgactgcggtgaccctaagctacttttttgcctatggccgggctacctcccctaacaccaatctaccctgcaactgactaacatctaacccagcagaaattactgggcatctgtaacatgactggcatgatcaaaaccctggggtggattcaagagaaaaatgcaactactcctttccttctatgaggtcaggagcaagcaatacaagcaagaatgtcctggtggcagaaggggtggccatgacggttcagagaagggcgagttcactcaggcaaggggggcgataatagatggggggcgataacagatgaggggctgggggcgaggggaggggacagcataggctacagggggaggataaatgtgtgcatagggaatgctaatggcttggcccgactttgtgggtttcaaaacaaaatctcatggaaaagataatttaaatgaaaatcggagcttattaattttctgtaggcccagcccaatttctcatagttctcagtcatgttggtacatgctagtttccgtggcagcctaagataaagctcttaatgcgatgtgagtcccttagagattagcactattataaatataaatgctcaaacacaagcaagttgaaaccaaatgccccccaaacactggctttctgttatatgaaggtttccagtggtgcactgaacccttggataaatgagctagaaaacagagagttaaatgggctcattggctaaatctcatggccgggctccttcatgggagggaagaaggaaacttagtagctgctccttacctatttaatctatagcagttggcaggacagttttggaggacaatcagagaaatgccctcagaacttcgagtaggggattgagcagggcatccaagaccctgatcaaaacagagggtctttactcaaagccaacctgcaaaacaccttcttgttctcactgctttgtatgacttccaagagactcactaacaactagtcataaatagacatcaaggagtttgtttatctaactaagagaaaacaatgtttgagttctttagaaacatgcatttgacaccacaccaatgtgctgctctgggagcagaatcggagcctgcttccttggggctggtgttttgatgtggtcattatttgctcagcagagcctctacttggcaacacctcgtttgcccaattctaggtatttgaaattttaaaaacatatctcttttaagaaaattctaaaatgaaagagtttttttaaaaattaattcgtaaataccttccccaaagttattctaaaatgcctgagactttaaagaaccatatctaagtcaagtctggtgagggcaaacagacatgacaatgaccaaatctattctttaattttctaacatttgtgtacaaagccaaacaatcaacatacatacagagtgctactcctaaatcttcttgctactaaaaaataaagggccaaccaagtattcccaggaggcaaaacaatagcttatcatgtgcttgtcctcagtgcctactagagcctccttttctcctggaagacataatgacttgggctgggtgaaattgtacaccacctatgagagcaggatgctgggttgatcaggtgataatgcttcaccatatcttcaatttttgtattttccacctatttgataatgggtccttcagcggagactacaagacgtgagtatacccacataacttcagctcagatttctgacggcgtccaacttgcttgcacgaatatccactgcctgcccactctctctcatctgagaaaactatttgactcagcttttgcctctgcctcccacttttcaccctctccagaatgctcacagctcacccatgctagtagcattggagaggaaagagcacacacattagagtcagacagatctgtgcttgaacctcaactctgcaaattactagattcgtcaatgagttgaatgagttatcagttctcctctcgttctctgcaatgcttaaatctaactcatgttagatgagttatttaacctccctgagcctaaatttatgaattcataaaacagagaaaaataaaaggctgtagttgtcgagtggtcaggaggatgaaatgacttctgtgaagtgcctggcagcaaaggcactaaaattcagtcatgactccctctcattcctctctcatttttgcattgaactgtcagagatggcaattttcctttcctaggtaccttctttatttacaagtagcttacagaaaatgcatatatgaaaggagttgtgtgaaacttttgaagccagttaagctctttttgcagagtccgtaatttttaattttaggatcttattttctaacatctttagtcaaggtaagttcttaaagaaaaaattcaaatgaagctcaatacctgtatattatcagctaggggcctggaagtagagttctggagttagcagaagtgatttcttgaaatcgtcagggcagagcggccagccaaatcctgagactcatcaaggcaggatttcctacccaacagcaagaacatcggaccttgtactaagccatgaggtccccacctggaatggtccattcagaattctctacacagacctggccactccaaaaagccagtggtgagtccagaggagggcagctgaaatgggacaaactaggcttctagaagacaatgatgactctgggaagggcaggcctgaatgtggattttgggacattcatgaagtcttcatagtacagaaaggattaagctataaccctattgtgaagcctttaggctcatgactcttgaatctcttttgaacctcaaaccctagtttgcgaccaaacagatctgcatatccatcaggtacatcaaacccaacacagcacaaagggaactgattacaccttcccaaaatctgcctctaagggtctaatcagcccccttgacagccctcagcctatatcctagcagaaaaaccggggtgatcctcaactcctccctcttcttttcctatggacacaccatcactgtcatctccaccttacagaagtctcttaggatgtctcctctttctggtcttacagaagccacttctgttcaccccactgcatggcttacctagacagtggcaagaagctcccaaccgatcttccctcatcttgccccattcagcttccctctggagtattcccagggtgtctgctagacccacaaagcagttgcgtccctctctcttatccaaatgccctgagtggctcctgttatccacagggcgagctggccctgacccacgcttccagactcccctctccccacacccactgcttgccttgaactccatgtgattactggcagcatcagctgcagcctcgttcctctacagatcctggctcacatgcatcctcaggctgggatgccactctgccttttgcacacctctccacactcagctcaaataccacctcctctgtgaagcctttcttgaccaagcccccacctccccatcatgcccttttcttattctgccccctcaaggctcaccagtgaactcactgccacctgtctctctcctccttgggggcactggctacattttcttcatcttggttttcccaggttctgatagtgcctggcaccttgtaaaagctgtgtgcatgtttgcagaatgaatgagtaaacacatggaaattaaaactatttaaacaggtccataaagattgtgttatgctcaaggaagatggattcattacacatctcaaaagaacctcaggaccttctgggactggaatggcaacaccgtgtggggtaaggagcctagaacgttcagttatgttctcaagtcgtcacagcttcaccttacccaagatatctaacatctctgagcctcaacttattcatctataagaataagaggacgctacaacatcaaccacaaaggctggggtgagaacgacacgggctcatgatgccaaacgtctggtggaggtcggcacagggcgggcagaggtggcaaatggcagtgtcctttgtccccaatcaacagaactgagctgaacatgagactctgagaaaggctcgggacagcagggccacagcacgtctcctggcctccagggacagtcaacttgaggaggcgacaaatctcatttgcaaaggtgagaaactgtacagcaagtcaacagtatcggatgagtcacgagacaggacgtgattgatgtcgggtgggcgtggaatgtgctgtgcattgcgtggggagggcccttagtgggggtgagcttggtgggaaaaggagggtctcggagggtccagctgctggggtggaggccacaggggcccaggagtgcagggtgggcgcggtaaagagactgccgttgttgcctttaggctgttctgctgctctctgcttccccctgttggcttgggagggaagagtagggctgttggctgagacggacgttagagcgagcaggtgagaagaggctgggaggaaccggcaatgcagcgaccaggagcaggtggtggagcggggaagagagagggagggctgcttggccagatgccaggcactctgccaattgcaggccctgcagatcttgccccgagctcagggtcaccttgaaccctctcctttctttctccagagtgcttgtcgcaccctctcccttcctggggccctcactcatgttctccttggaggttagaggcccatcctccctctcccaggacccttccccgcctccccagccagtgtgggccattggtgtgaccaaggtgaggggcacttggtgttcttgggactcttgttctttttcttgcttgagggcatttctcaagtaagaccagagatcattttagccctgagtgtcccagttaatattcatgaggcttgctgagaagccaaaaaaaaaaaaaaaaaaaggcttggacggcatcagacgggctggcaggggaggggggtgttcaaagaggagaagaaagcaagagccaacatagagtcttgcccagcaatagcatggaagggagtggcagcccattgtccctcaggaaaataaactgcaaataacttttcccgtttgtgtcaatctagtgctttcaacttacaaactattagtaggctttagaacttagatcaattgacattctgggtcaggtaattctttgttgtggggaggacgggctgccctgtgcactggaggatgtttagcagcttctctggcctctgcccacgacatgccagcggaaacccttgtctagtgtgaaaacccgaaatgtctccaggccgtgccaaatgtcccctggaaggcaaagtcatccccatggagaaccactgccttagattattgttaggtgctacccaaatgcccaacacctgtactggcccctccagtctcaccctcatctgagcactgcaagaacgtcccaccctggcgtccacctcccccgtccacctgatgtttacgtaaacagaaacagaagcttctttcagaagccaaggaatctcctcccaagtccagacgttgtgggttgggggtgggggtgcaggaatgcctctaactctgctcagtaactgcaaccccatggacttcataatggccaaggggactccacacccaaagccctcattccccaatttcctgggcagccagggatccaggtagaaacgcttgcccaggaggcgtctctctggtggaggagtaaaccttggagaatttgccctccgttttcttccctcgctttcttctccattttctctcccaggagctagctggtgagtagctaccgcagctactcatgtgaacatgaatctggggccaccctttttcaaatttcaacagcaagtcctggaactaaacaagaaagcctttgcacaaataaacaattaagttaattgtgggtctgacaaatattttgttttcccgaggaattaagtatgcatctggggttaggcttctgggctgagcctcttgtgtaaaaaaccagaaggcaagaaactgaaggaatatggtcaaagtcccttattttaaaatcaaggacactgagtcccggagaggtgaactgcctgtcagcacggaaaacaggaccagacataatcatggtaccttgttccaagtgaagttacctaatgctcccttcccatccaaacaaggatttgggatatgccgcccaggagggtggtcccaaaggggatcctcagaggatgcatcactaagtatttctgtaccccaggaggtggcttatttcatggaaacccttcacctggggctgttcatagaaccatgcacgcggcagttgaaaaggggcacctacgccttgctctgtgacattgttttcagtgaaaattagcgttcgctgttttcagcgttaaccttaaactccagctggctttatctcctctcacttattataattgtaacgcagtgcactgtgtaaaggtcacacctgtgtttatacgccatatgccatcaaaataccatgaagagaacactatgtggtctctatcagaagatcaaaagagaaggggtgagaagcagaccttcctcctaattcagggcccttcagtccttcccaaacactgaaataggcccatgtgcaccactgctcccgcaggagtttatgtctaggccaagtacgtgctgtttattgacagagaaacaaataccgctcagcacctgtccggtttcagagtgatgagggagtttccaatctggatctgagaaaacttttacactgtacccaaacattctttttcttttcttttcttcttttttttttctgaagccaaaattagaacaaaaacaaacatatacagagttcggcgtagcaggaaaaagaaactcagctcaagacatttcataagaaaagctccaagtccatctatactcacctggcctggaaccctgggattcatttgattgaggagggtcacaagctgtaccccagaggctcgggaggcaccactcggtaggaagaccctcctggtttctcaagctggaggagcagactgaaaggatgtttggggagtgaggaagtaataggggagtggatgcagaaggtattttgttgtctaacctagtggttccttgaggcgtattaatgagtaatattcatgcaccttctccttctgccaaggcagaaataacctggtactttttacctggtggccgagtgacctggccctaccagggacttcactaattagcatagtctctcatagcctggccttgggactggctgtcacacgctctcctccacaccagccatcagttgctctggaccctccgagacccccaggcagcctgacagccagtgagcagaaagacctgactccttcctggggccccttcctccagaggccccccacgaagctgtgctggccctgtttaggcagtggacacaagcctgttccaaccccagaatccaaggtctaagtcatcttcaataaggtattgcctgaaaccatgtgggataaaaagcttcttcctttaaaataaccttcaatgaagccaggccattactggaacttatcatatataatgacacacaaaatgccaagagaaatttatagcgccgcctgtctgcccaccatttaggcactggtgagtcattaattcatgagagatttatcagtttataaaagatgctagataagttaatttttaaaaatcatgtgagtatagatttatgctcaggttatctactttaaaaaaaggatctctcttgggctgtttttccaaagcagtgcaattcacgttaaccccccatcccactgcctccagcccatgccctagagagctgctgaaggacactggagtctgactagaggcagggctgggcccactgagtgtcaccaaaatcacaaaaacacaactgaaagagaactgttcttaaatactcatgtaccataaaaggggaatttccagaggtctctgatattagcaatttgcccttccattcccttcctctctagtttcaagatgagatgatgacaaaaagactgactagtgagaaaaagcatgaaactccatctacaaacgtgcaaaccgacacagagcaaacctgcaggaatttccacacccggtcttctgatttgccttgaaaagggggaaaaagagagaaaggaagcgtaccttcgcctccactaagacatcaacattaactctgttttcttaatttcacacgaacatcactgcgtctggagtctatgttttatttttcctgttaggcaaaagcaatttttcccaagtaaaagttctgaaacggatttcttttagaagcagagataactgggaattttctcaaaactagtacaagtatgaatgtttctccttttactttccatttttacaaatgcatttagggccaaatgcactggctaattttgatagaatgtaacagagacaggagaagcagtccatctcagtgagtgagtggacatttattaggcattcacttttcacaggcctgggatattaggtattgcgggggtgttgtattcaggaaatagaagtcaaaatccaattgagtagggaaatgagccaaacagaaatggacacaaagacaccaaaaacacctacaaaaacacagatgaatgtgcagaatcagctggagtttctatgagctgagctgaatctgctcaccttgcaaagatttccccgcacagtggggactgcccacgcgtacgcatttcttagtttctgctggccaactcgaatcgttttcagcggggtcatttacatcgtgtccactttttctggtttccaaactcaacccactttattatcttaagagttttcattctcagtatcatttacatacaacaaaatgaatatatcatgtgtacagttttatgaatattgacaaaggcatacatccctttaactcactcccctatcaagatatgcagcatttccatcctcccagaaagagcccttggagccactttgtttttaaattatttgcatctgaatatttttgagtggagattatcaaagccaaatgtgtgggaagaaagcctaatcattaatcatctactacaaatacaggtagtaaaggttttgaagatggtgcgtgagcctgcacagacaagtctgcgggattgggtcctgttatgaaatgccaaaggggctttttagcgacaggcacgtgggcccctctcagccgccctgtcggcactcagatacgcaactaagaccgagtgggtttcttttctggttttgttctttaggcatcagagtttacatgtttagaaagagggaagttgaggctgaatagtcacatccaccatattctcataggggcaaatgttctctgattaggagggctcaaccacagtgcagagtcccctcttccaaaattctgtttcaacaccgagaggagttcacatgaccaggcaaattagagattttcttagcatttcctgtttcccagatttcagaggagcccttcagggaatgtctggcccagggtagcacattcaggatgagggaaaaatggttatttttaggtccctccaaccatcacattcctccctgtctccacttgggcactctgttgttctagtgacctgtcaaagggatgggggcggggctgcgagaaaaaagccacatcgcttcctttggggtgggggtaagggtacccctgctccaggggtcctaaactgctcactagcccttctgctggagagggaccagaggtggaagacctgccagagtgagtgccaggcagctctagacttctgggtattcatttctcataaaaggttgcagtatttcctggacacctgaattctatgtcttcacggcaaaaacaattcaaaatgtcccaaaacattatgcaggaaggagtttttaattttttttaaatcacttttccaaaatggtaccctgaggtgatcctgtcttcaatctcccagcaatgaaaacaatgtggttgaaaagttgacagctttcaacccttgaaaaggtcacctccctgcctcacaccctctcgtaagtattaagagcataacggatattttgagtcacatgtattgttctttgttcatttgcatttggtgaaatcccccccttggaccaatttagtaagcagtgccttgggcttccttggtgattgttctcttgtcttctgtatattttttcctgtgaaaaaaatttagactcagccagtgaaatgaagttgcagcctctgtcactgatgctttctttttgctcagatgatctttccatctcgcttgggacagaattccttcttctttgcaacgaatgaagaccttcgaggctcagctgaggcccttgtactccaagactttctgaaagctccctcgcccctccccatctgaccttctgttggactgacatacttctccatatttcagcctcagatggcttggtgttcaccactagactgtgttactgaaagttaatcaagggtcctagggccatttacaaagtgggactgtaagagaaagtctagctagatggaaatgtatcctaaatacccccaagtcccagcacaggggttcccatcaacaaaaagcctcacctccaaatacattgctgaggacgcagggccccgtcttcccacctgacgcactacacaccacgtcagctgtcacaggaggtctgagtgctttatgaagctgcctgctttctctcttacctccatgtgtaagccaaccactctggctttcagaaacatatttctttctctatgagtaatttaaaagtgactcatcctcagcctcaccagccggtccatgtgacctgcagtgctggttgagtgttatctatagatgtgtaaaccaaagcagttcttagaacacagattccccctcccacgtgctgttgatttccctttgctacacagggagggaacgatgtcagacatgagcagccagggactgcccgctccgcactcaaatctggaatgtgtccattagaggaaacaaaggccatcacccagtgacagaaaagaagagacaggcaaaaggcctaatatatttattttagtattagcagaccatcaagaagctctgagaaaactccacaaaaattgaagacgatgatgacccatataaacaaaaaactgctcaaagttctttttctgagccagtagaaatttagacctcatgaaacagagatgacacccacacccaccccaaccaaaaccccaccaacacgtcttcattgctcaatcagaaacacattcctgggatctgctgtggtttgtcttgggaactcacatatatgaacatgtttttatttcttcaacttgcctttattccaccatcaccaaagaatggtgtcaggcccagctcggggacactactggtgcaggcaggcacgcgggtgacacagctggccagcattctagatcgtgtttcttacctctttctcacttcctattttctattaaaccaaatctgaactcatttgcctgctttgtgaagaccttcataatccagctactgtcgcctgattttctagcaccatctatgctcttggcacaattaatccttggctaccactagggcagcatcctcactgctcctccaaggaagacaccagagccttcatttccatgccttcaccctcccaaacccccaaactctgccctccttccttctttccttccctccttccttccttctttccatccctccttccttccctccttccttcctttaaattgagaaacttttgctctgtcactcaggctggagtgcagtcgcaattatagctcactgcagccttgaattcccaggatcaagtgatcctcttgcctcaacctcctgagtagctgggactataggcatgtgccactatgtctggctagtttttgtagagatggggtctggctatgttgccaaggttggtcttgaactcctcggttcaagtcattggtccacctcggcctcccaaagtgctgggattacaggtgtgagtcaccatggctggccacccttccttaccactgtctgtatctttaccttctgggagcactcttaccttcatcacccaaatcttaacccattcttccagctcagctcatcccacctgaaaatctccttaccttcctcacctgaccattcaagctgtcactaatgtctacatctcctaaacttctccaatagttcatcacatctgctcttcagttttgttttgctacctaatatatcacttcttatattttccaatattgtttgattgcaagttcttttgggaggggtatcacatatttcactcctattggccccacagtgcctagccctataacagcagatgaagcaacctttagattgaaacaaatattattttaatattgccaaaaaggtgtaataagcaaggtcttactaaacttttggccagctgttaaatttgattgcatgttgcctgaaagagaaactttactttttatcctagtaggaagttatgtggagaggaataatgtattggatattcagtaaaatgaaaaaaaacacacaacaatagtcatttatatagcactgtgtacaagcactgatctaagcacttaacaaatatccattcatcttaaacttcatagtgactttaaaaagtaggcactattatattccccacttcacacatgaggagatcaaagtattggagggaagttgtccaaagtcacatagtggctaagctagactcaaactctggcaatctggcaatcagactcttcagagtctgtgctcttagtggctgtgctatattcctgttaataggtgtgtgcttttatatggcctttttcattgaagcaaagaggagcttatcttctgtatggataccatgttacagttatgtgtactaaatccatcatgagtcaagtccagtgtaaagaaaactgatggtgagatgtcatcttccagggaagcttcagaaagaagtatggtggtggtatgggagctgaacaaatagagttttctttgaaatgaatggagtaaaatcttccagtccgccctcaggaccctgtgatatggtaccacccttccatgctctgtagaaataagagatttgaacctctgggcaatctttaggtaggcttgctccagaaaaatattactacatacccaagagaatcttcccaaatcctactttctcaacataaactcaatacaactcaaatcacagctgccattagatttgcttacaaattttaaatatgatctggcagccccagacatggtatgcctgagaactccagattaggtacaagaagaaaacctcatcctggtggtcaaatcacggcaggaagtgatgccactgacaattattcctgtattagcagttgcttaagtaccatgaggcttttagggggaaagactgggaggcagtggttggaaatgaagcccattattaatgtagtcaagctcttcagctggattcaataaaataaaaagccctgcccagaccagtgtctgtagtagaagatgctaaagagctgtttttcaaaaatctggctttattgaatccaggctttatacacagcattccttcttcctgaatggctgaaaaatcattccatgcatttgaaaccactggaggagaaatgaacttaagccatggcaagaaagcacagttagatttaaggcgtgaacgtcagcgttcaaggtaatggaaaccttggtagccctgtagatagattttcaagagagactgtgaaatcctcaagtcaattaatagaagaatatttttcacaatagcaaagacttggaaccaacccaaatgtccaacaatgatagactggattaagaaaatgtgaatgctagatgacgagttagttggtgcagcgcaccagcatggcacatgtatacatatgtaactaacctgcacattgtgcacatgtaccctaaaacttaaagtataataataaataaataaataaataaaaatagaagaatatttttattaattcaattcaggttcaaaattattattgggcgcctaccatgtgccagcccccatgtggtgccctgcaaggctctaaggataccaagatgaataaacacaaccactgctcaggaggaatttacaacccaagggaggaaacaggagctcagggctgacaaccatggagggaagtgtcttggtttggatgaacctcattgggtgtgactctgttggtctctgtccctctctctgggtttgctgctgtcacttttcatggctctggctctgtcttcattgttctctgactgccttgtctccatcttccaggcccctagctgcagacctccctggcttggggagccgcaggcatcttctgtgtttatccctccaaccacatccctggccaatggctgcttctgcttccataccctgctcagcaggctcatccacactcatcaggaatcctggagagacctctcctatcccaaacctctctcaggctaaatggctacacaaccggaaaaggagccgtggagaaactgactccttgggggtgaaggcctcgggcctaggtgttttacagtcacctgtgcaacaaacatttacaaagggatgcaaagggcccagacactggcgggagacaaaaagagattgagcaagactctgtcctcaaggaccttaggatctagagaaggcttgcaggggaggggggtggaatctaagcccgaggggatgtccgaataacaaacaagctatatgacaatgttgaaaacagagttcactcccaggttgggtctaattgagccagacagtcattgtcaaaaatcacatgccccaaatgggcagagttcgtttgctggatcgctttaaagctgtgccgtctgccttgaagcaagtccactgtcattttgttaaacaagggtccttcatccaatactggttatggccagggttgcagacccacaggacacaaagcctggccctcagtatgaggaccagctgctggctggcttcctcggagggggactgtgggcttggggggcactcacggctttatagactgcccagtcccatgccccagagagaggtggttggcaggaagaaatgtgacaccaggaagtgctaaggagaaagacaaggcagctcccagagtggggagaaggatccgctgtggaggaggagaaacttggccaaccttggaatgggccttggaagacgagaggatttggactgggggatgtaaggcgaggagtcaagccagctccaggaccctggacggggcagggacggcgtccctggaccctggacagcacgcatatcctgactggggaacgaggtacctgcagaagccacactgtcactggctgggaggacaccctgcagttgactgcgccagctctcactggccaagcccatacgatatcatgatcagatcatggaaaacgtatacatattaacagggaaccctggtgaaatacattttttggaaattatttaggagacaaacagtataataatgaactggtgtcccttagaacagtgttaaacaggagtgagcattaacacacccctccaacactgggcagatgctatcactgtattgacttggagtatgacagcttaccgacgggatatgaggtatcacataggttaagtttggttagtaaaacattaatgattgcagcattagaaatgatgcattcctgacaagggacactatcgtcttatacaggtttctttatcatattggttgactgatgtacttccctcccctccttctttccttttgtctttccttccatggagcactgaccaggtgctaggcactgggctagatgctgagactacacggcagaatgagatgtaatccctgctttatggtcgcatgctccagccagggagaccaacagctaacaaattctaatgttgcaacatgagaaggtgctggagtagagggatgtgggaaaggtgatgggagcacgaaggaaggtggcttctgttttgaatgggttttaagaggcctcctttggtgtataattctataataaatatgtctcattgctagggggttggctgtctcttacagtcacctatttcctgtctttctcgccttccttcattcatctatctacctccctttctctttcatctatctattcatctatcatgaatatcatctattcatttatctacttctttttctctttctctccatccaacatccatcatccatccatctagccttctaggacattttaaatacataacttttctctctaagtcagatttctcttcttgctataggaaaagcctagctaccaaggatcattttgctaaagtgaaggctgacaaaggagatttagaattccttctttgggcacatttaaaaataaaataggactggggccaggtgtgatggctcatgactatcatcctagtgctttgggaggccgaggcaggaggatcacttgagcctaagagtttgaaaccagcctgggcaacatagcaagacctccatctctacaaaaaaaattaagaattagccggatgttggctgggcgtggtggctcctgtctgtaatcccagcatatggggaggccaaggcgggtggatcataaggtcaagagatcaagactatcctggccaacatggtgaaaccctgtctctactaaaaatacaaaaattagctgggtgtgatggtgcatgcctgtggtcccacctactcaggaggctgaggtaggagaatcatttaaacccgggaggcagaggttgcagtgagcagagatcacaccactgcactccagcctgggtgacagagtgagactccgtctcaaaaaaaaaaaaaaataaataaaggaattagcaggactgaggcaggaggatcacttgagcccgggagtttgtggctgcagtgacctatgatcatgccactgcactccaggctggacaagagagtggggccctttctctaaacaacaacaacaacatgattgttgccatctggctggaatgggcaggtggttctgcctaaaggcagaggggcctattggagaatgtgtcaagagtgcccatgcctccttgttccatccattgccaatgtaccaaggatcattttgccaaagtgaagtctgacaaaggaggtttagaattccttccctgggcacatttaaaaacaggactggggtcaggtgtgatggctcatgggcaggaggatcacttgagcccatgagcttgagaccagcctgggcaacatagcaagacctccatgtctacaaaacaattaaaaatgtcctaagtccccttggaccaccagcagctgccacctgtcaacactggaactgatcgcccaggccaaatgttgaggtggggactgaggccctggaggatgcacatccatagtctctgaggtcattctttgctggctgcagttctaacacggactgatgactctgcatggagagtcacaggaggcttatcgtcatccatagctgacgtccacagccagacatccacgagatgctcaaactcagaatgctatgtggctagcattttccaatgcctaaagcttctgatctgtttccaactggggggaaatgtggactgctccgtttattggtatgtctggcctctgtcgcctaaatttccaaagattccctcatcttctgtgaagtataaagtcctcctggaatgccagggctttttaggcggtctgcatgttgtaggaagagaaaaggtgacctgagggtgggatctagaaacattgcactttccctattggaatccaaagtggggagccattctcaacaactaactagcaacaacccaagtcctcaggattgaacacgctcagcggtcatctgtctttatcttggggtcttaactgtatttgatgaaagctgcttattggcctaacagcattgaataaacaggcaaaattcccagcctctggctgactctcctgaagtatctccagccttgattctgagaatctaacatgggcttcccagcactacaggcacaggcaggcacctgatcatccctggtgacacttatttcctaatcgattccatggagggcttcttttgggcggtcagaaacaacaggcccttgttttctaagttaaatgcagacagaatagtttttccccttcgtgtttttctttctttctttctttctttctttctttctttctttctttctttctttctttctttcttccttccttccttctttcctttccttcctttctttctttctttctttctttctttctttctctttctttctttctttctttttctttctttctttttctttctctctctctctctctctttctttttctttctttcctttctccctctctctccctccctgtctccctccctccctccctccctcctctctttcttttctcttctcttctcttttttttcttccttccttttcaatggagtctcgctctgtcacccaggctggagtgcagtggcatgatcttggctcactgcaacctccacctcctgggttcaagcaattctcctgctctagtcacccgagtagctgggactacagtgtgtgtgacaccatgcccagctaatttttgtatttttagtagagaagggggtttcaccatgttggccaggctggtcttgatctcttgacctcatgatccacccgcctcggcctcccaaagtgctgggattacaggtgtgagccaccgtgcccagcgcgttttctttaaggggtagatgccggtggccgtcatcaaagtaattctaatgctatttaaaattcttatctcttgagaagaatagagatgatcctttaatgttcttttacacatttttcaatgttttccttgcaactgtaacaagcaaactcatgtcatcaatagccatattatgaccgtaatcagtgatcagtatgtggaaggaagcctaacttggtgactaacagcacacacatggctttaaacctggctcagtcacttaccactgcatgaccttgcgcaagctgctaaatgcctctgtgcctcagtttttttcatctataaaatggggctaatgatagtgcatacctcattaggttcttgggagtataaaatatgttactatatacgacatgcttaaaacagtgacgggcacatggtaagtgtgagctctcatactaatgaatgaataactcattgaactaagcaacaccaagcagacaaggcagcatctagaaacttgggttttcaatgggctacaataatatagcaatgagcttggaatggtgccttgtgcatagtcagtgttcaatgttagcaactcgtaatatggacacctgggccccacttttgcttggaactgttttatatgaccttgacttaatccatccaaagctcagctacattacattttgcttcctttcttccatctttggtgtttatgcggaaaagacccaaccccaggtcagagaaagtcctccactaacactgtgagatgcaagtcacattcggtatatgaccagtaaattgggtcccactttggagttcttctcccatttcattatccttctgcaaattttccttgtgtctgccctttatatgtgctcaagacttcaaatcatggggccatctgcactctttaaaactttcattcagtcgtacttctattttgcacataaggaaacacaagtacaaacgataatgtgcaaagcaggtatgaaattaatcaggcttgtcatggacggtcactgggctcacaagctacaggtcgcacatgggtgactgtcaacagttggctggacactgatagagagttacaccaatcgagtgtcttcttccaaaaacttagaatcaggtagacgccaatgttttcttaggtattcttagtaaatagacttttttgagcagattagaaaaggaacgatttatttttgaaataatgctagtaaaatatataaattcagcttttatgagattttcttactgttataatgttttcctctattctgaattcaaagtgaacttttaaaatgtctaaaaaccatgctttgcctaagtattcataagccatgtgtgatacgtgtccatcatttgacaatggccagagtttactagtgtaattttcaagtatcagtccctgtgccaggttaatggatttaagaaaaaaaacaaaaaccaacaccttaatttctaagatctggccttttaaccttttaggaaatgaaaggatttaaatagcctgctgatatatctcatagtgtgtctaccctgcaattccactagcacggtgtgaatgagcctgattcactgctggagtgagggaggttaggagatcctgataaactcagataacatgtaaagaaaatgcttagcaactggtggcccaggagcattcagaaggcttgcaagggcaaagcacttataatcatgaaatgagaagggatgttactgacaataaccaactgattgataacatctagttataatagagtctagttaagtgcactcacaaaacagctatatgatgccacaggtaaaatgaaactttgaaagaaagctagtccatatatggtaaatatgcttcaagctgtaagagataaaaataataaatatggccaggcacatagctcatgcctgtgatcccagcacttgggaggccaaagctggaggattccttgagccttgaagtttgagactagcctaggtgacagagcaagaccttgtctctacaaaaaattaaaagaaaaaaattatctgggagtggtggcacaggcctgtagtcccacatactcatgaggcccaggcagaaggattgcttgagtccaggggtttgaggctgcagtgagctatgatcacaccactgcactccagcctgggtgacaaagcgagaccccatctctaataaatagatacatacataaatatatacacaaattagatagaatatcaaatacatttgttatatatcagagttagatttcaactctgacctgtaattgggctaatacctataaggcacaggatgattctgactcccatgattcagagcatgttgagcttagcatggtcttatgtattaatagtttaaaaacacagtgaatgaacacaatcctaatgaacaatttctaaagatggacagagcacttcacctggtaattacttttcacatcctttcattcacgtactcacttgctgcacagctactatctcctcactcgtgagtattattcctcacttatctgtctgttgagcaagaacaacgcagacactaaacaccctgatgctgcttggtcctgaagaactggtgagatggatctggctttttcatcagaatattattattttcccacttgagtctttggggactcaacaatcatgccctgagagtaggcatcaaaatggtaaacagtgaattcccggccgggcgtggtggttcacgcctgtaatcccagcactttgggaggccgaggcgggtggatcacaaggtcaggagatcgagaccatcctagctaacacggtgaaaccctgtctctactaaaaatataaaaaattagccaggtgtggtggcgggcgcctgtagtcccagctactcgggaggctgaggcaggagaatggcgtgaacctgggaggtggagctggcagtgagccgagatcgtgccactgcactccagcctgggcgacagaggaagactgtgtctcaaaaacaaaaaacaaaaaacaaaaacagtgaattcccatctaaatgaccaactctacctgaaaatgtaaaagtattcaatgagatcatgaaggcagaaaagtcatgatgcaccaacggatctcaactccgcattcattcctcctttaggtcagctttgtcttcacttgcaccatagcctgcattcccattgattgactctacgcaggatgtctataaatagtaattaaaaactgaaaaaagacatcatattgtttaacttgaaataacctttcaaaaccacaaaaagtttagctccaatatagaagttgtgatcaattctcctttttgttttattccagaaagaaactggcacataatcgtaattaaaaactgaaaaaagacatcatattgtttaacttgaaataacctttcacaaccacaagaagtttagctccaatatagaagttgtgatcaattctcctttttgttttattccagaaagaaactggcacatgtaagatgaagaaaaattctgtttccaacatatattttgctaggctcaccgttaaaatacacacaagccaaaaacaccgactctacctgaacattttgggggttgtttaaacatgtttgttttcttagtgaagctaaaaatgtttttccctggtgtttttgaagagacatttagactaaaataaaaataaaaataaatgacatgtataaaaagttatagtcatcagacctggagcagaattcggaaagcggatggaggaagtgaattttaagacctgtgcagcagttttcctattttggttgctctaaatagacgtggaaaaacaaatcgaaagaaaaaagcccatctctctccaccctgtacaaatgagatataaaaactgattcctcatctggagttaagctcaggaatagattaatgtatgtccatgcaatattttttctgttattatagatcaaatgctattactatgaactctaataggacaagacttcttgtttgtatcagacttcttatcatttggtatattctagacatgactgagcttaaaaatcttagggggatgaaaaccacaaagaaatatttattgtagaatactgactataatcaaatttgacttgcagtttccttttaagtgagaaaaacataataagaatttcagtatagaaagggtttcctcacttggataattggaatgaggcccatggctttggaaaatctctgaaaatattaggctaagtttcttgtgtttgtgaatttttctggagagaggatacatagctgtaatttaattatcaaaggatgcacacacacatctataatactatatgtatatatgactatatatagacacatacacatatgtatatttactcatttaattcttaaaacctctatgaaatgagtactcttttgttcctcattttacagataataaataaacaaagattacctacttcctaggttagcagttgtttcacttaatgctaagggacccagccaagactatgaacccaaaactcaatgagaaacacaattgaaactcagaatttctagtacgcatggacgggtggatgaatggatgtctcaggtcttttattgttgttttttttttcttctctgctcctctttttctgatgtatgtggatggctctcctgtcaatttacaacctagtctaatgttaaacaccaactcatacttgtcttttctgagacccaagtaaaaaatggtacattcattttctgttataaagagcataaagaggctgggcatggtggctcatgcctgtaatcccagcactttgggaggccgaggcgggtgtatcacctgaggtcaggagttcgagaccagcctggccaacatggtgaaaccccgtctctactaaaaataccaaaactagccgggcgtagtggcaggcacctgtaatcccagctactcggggggctgaggcaggagaattgcttgaacccaggaggcggaagttgcagggagtcgagatcatgccactgcactccagcatgggggacaagagtgagactttgtctcaaaaaaaaaaaaaaaaaaaagcattaagaagttctacggtcttccctcaatctctctgtcatctcccccaaaacactaaattttgtggaattccattaagaactatatagcatactcctaaaaacacatgtctgccgttttcacctaagatgccacactgacccacaaatccaggttgaggggtatctgtcttgacattgtttgaagtctaccacattttgtcaaaagccaccttcctcaaatattatcgtcattcgcaagccccccacaagcacttcctcagtcactctccaaagcttggataaagttcattccctggaactttgggcaaccaaatcactagcattcatgaaaaaatactggaaaagaaggctcagccctaaacactgaataacttctttgttgaccctcaaaagatacaggcaaatttaaagattgttccatttgtcaattgattaaaaaaattatgaaacataatttaagttagacgtgggagtggtactagccaaatgctatagtcgaattagctaaccatctgttgtactgcctagagactttcacatatattatttccaaaagtcatattcaaaacatctagcaaccagcatagtgtgcacctaggccaatcagactaggcttcagccagctgtaagcagccagcacagctgggcaacctaggtgaattccagccctgttagttcatgtaaggtccccattggtgctaaacctgttttaccaatggatttaagaaggaacccaaagtgtgaaaattcaggcttcaggaagtgaaggggtggcctggatcaatcagctggtaaatgatagagaggagattcaaagtcagatttcccaacccttgctctctcctcctcccactacacaggtgcccaaaaatactctcagggagacaaagttgtctggagctccacgccacatcagacagcaaagctattgggactactcaggagacaatctatttagacaccttcttaagagtatcaggagcctgagagacgggcatcctctgatctccagctttctacggggctcacacctctctgaatagtttcactgtaatcttctctgctgcctgtgacatgggaggcactcacactggagatgtgacttgttatgatggaaggatacatgacttgggatgatgggaaggtgggtgaaaattgtggatggaattttcaagcaaagggaaatctaaaaaatgatctcagcttgaactcccacagcgtggtttggttgcctgcttccctagacgagctgttctgttcgctctggtcaggacttggcatggtctattgaaagaattttcctttattagcatggggagcaatggcaggatggaaatgagtgttttgagaatgcttgagataaaatcactggcagactattcaatattttctataatgatgagacctaacctaacaaattggtctgtctctcatcctctggccagtcctttctgacactagagacccagtgggcctgaggagggcagcctaggaggccaatgtgggtggtcaggcacctggggaccagggttccaaaaccctcctcctgtcggctcccaatagggtgtttgcctgcctagaccgtgtcaggcacagagtcagcatttgttcagggactgcttgttgattgaatgagtgagtgaacgagtgaaagaaaggatgaataaatcaaacagtgaataagtcagtgaataaaagagtgagtgggtggtagtagcgggtaaatgggcaagggcagtaatagtcttttctttcttttttttacaattgatacatagtaattatacatatttatagagtacatgtgatattttgatacatgcatacaatacctaacaaatcagagtgtttaggatactcatcacctcacttatcatttctttgtgttgggaacatttaaaatcttctcttccagctattttgaaatatataataaattgctaactatagccaacttactgtgctattaaacacaataacttattccttcatctaactgtatgtttgtacccattaatcagcctctctttatcacctcccaacccttcccgaagaacttgatgtttttcttcttttctttttttttttttgagacagggtctcactcccatcttctgggctggagtgcagtggtacaatcacagctctctgcagcctcgacttcctgggctcaggtgattctctcacctcagcctcccgagtagctgggaccacaggtgcacacccccacgcccatgtaatttttctatttttagtagagacgggttttcatcatgttgatcaggctggtctcaaactcttgggctcaagtaattcacccgcttccataggggtgagtcactgcaccctgccaacatttttcaaaagtaaaaaataaattaaaaaaaaagtctttagtggattgctgagtcccctctgacaggaggtaccaaatgtgcttttcctgaggacaggggaagagttcactattcagccatacctttgcatattttacaaaattcacttctaccaaggatgcctctccacaaaatgaggagtagcacaaagaacacctaagaaaccaggcctgacccagggcctctgatgctggggcaggttccccgcgtgctaatatcccaggggaccctgttgcagttctctgaataccggctgtgagctttccaacttcagctgagtcccagcatcctcctcacaccacttatcctccttgcctgtccctggcgcgtttagacaactggaatctttgctgacattttaaatgggctggctacttctccagcgtggaggcacctagcacaaggtgtgatagatcagtatttgttgatgagtaacaaagttattctggcaaattggacttttcccctgaaacgttttggcttttacatttttaatgatgggtcaagaaacagcccccaagaagaaggggcggagatagggggtaggaccctgcctgaagcttccaagctgactctgtttgcagtcacttaattcactagggagggctggatctgcctccctgtggtggactctccgcatctccagaaagtgcaggggtggagaattaactcagcccccctcctccccataagagccccgccaggtcagcctgcatgaggagggcacgtgcacacctccaaaaggactggtgcagccacttccctaagctcacagtcccagtgtgagctcagggcccagactcggggcctctggtgtttcaggcgtgagccaagtcccctgagcaagaggcctcatgataaatcagttggagcctgggggccatgaaagcattggttatggcagaaactaccagctcgtcaccgtttatgctgctttgcttaaaaatgacaccgcgtaagggattttgccaattcccaacctcgggagatcacccaccacctggctgtggtccgccgctgaacaggaaagcactccgagatgccaagagactaaaaggctcgtaactgttgtttagaaatgaaaatggccctaaattataaccagagatggaagcgcgtctcaggggagggcggggcgctgtgtaatcgagcctcccatgcgcaaggcggatacaaacggtttatggatgtgggcgaaggttctcagagcaaagaatgtccatttccatcagattaaaatacagtttgggaaaacaattacctgcctgagatcctgggaaagtaaaacttcctggtttctttgccaggaagaacgattgtaaaacaagggctgagaatctcccaaacaagattttagaattttatccaaacagctgcagttcacctttgaggagccccagactcacttgggtctgatggatgttgcaacaccaagtttgaggtctccccagcctggtgccaagagtgggccccaggggacaaacagagaacagttgctctcttaatcggagtagaaaacaaaactccctccccttcccacccccaacctccctgctttgttgtgaaattgtcactgcgcctttgaggagtgattaaaatcccagccatgaccaatttaaagggcaggttcccaggcagggaagggaaaggggttcaaggcaaaaaaaaaaaaaaaaagtcagttgaagtgagtttatggaggatttggggatcacaaaagtcatgggacttgagtcaattaaaattaatggaaaagcaccaacatgcaatttaaaaaataataataaaataaagcagtaaggatatttctggcttgctctctgcttccattcttgagcctgcttgggaatcttggagcagacttcctgaagcacagcatgagtgcccaatggctgttttaacctattttcctgcccttcacacacaaagattctgcaatggagagtgggaatgaatggtccacccacccctgaacatttcctgtgagttgggaatgcgctcagtaaggctgctggagtggagggaaaagaaaaggtgtctgagttctctagacatgggcagaaaaggagagaatttgagacaggctgagagaaagctgctccggttggcagcattgccagattctcagacacaccgtacattccagcccccgaaaaggccatcctgagtccctctagggcccctggggctctcatctcatcccaaatatttggaactgtctgtgcctgctataatacacaagagccccttcccatgttttctcctggtgctatttgtaaaggtgaggaaaggtaacgataccaaaggagttctaatcctatgggcttggttcccagaaagccctatgttgcggtgcggaaggcaggtaaggaggcgaaggttcccaactccacctaggggagggagcatatctcagcaaaggactcagtctttacccagcctgaatcttacctgtggtccttggatggacactcacattgattaagtcaagagattccgatcaagccctctcatcctcattcctacggtggggatgataatagtacctaactcgccggtgagagttcttatgacgatgaaatgagttgccaggtattatagtgtttagaatgcagcatagcacacagtagctcaacagatgctcgatttcattgctgttgtaagtgtccttattctctgattgatcattcatttagctttctcttttctcactcaatgagacttctgcagtattgtgatgaatgtcttatagctatccctttcatgaaagacctcagagccccaagttacaaaagcacatggccatctacgcaatctatcaattaagcactatgcttcacctgattaggaaacccttacctttcggcatcattccttcttccctttcattttcctcccttcttctcccttccaaacccactacacatgcctagctgatattttattaacccctgacggcttatggaaaatgtgttttagccataggaacactgatgtcctatagccaagttgcttttctgaatcagacaccagctccctagccaaatggggaagagcagggaagggagatattaaaatcctttgctaaagcagaagctctgggtgttgctaggaagtcttgctcttcagcaaaaactgcagcaggaatcccttctcctcctttgtgaaacggaaaacaaacggcttgctccgattccccggctctatgggggctgctgagcagcactgcttcccctggagagagaaggtggaggcagaagctgtccgcccaccccaccccagaccgcccatcccaccccaggcttaatctccatggcgttttccactttcccaggctgaccacggcaacgtgaatgcttcgctgccagccagctgagtactgcccttggtgagaactctgcctcggagaagcagggggaactgaagctgcattgtaggatagggggtctccagccaatgctcctagaccccctactagtgatggggctctcaaactactagtgatggggctctccatcatcaaggtcccttagccctccagctcccgggcctctcagggctcctacggtagctgctcctatgggcagacacatcccttttcctattatagttacagcaaaaacaataagcagtaaatccaccaagggtcctgtgggctcccacagaccaacattcccacaatgcccagtggaaacgtgtcagtgtacagacgctttgattcattgtgatccaaggggcttttcatgcctttaaaaacaaatattaatgtggagaagatgctttgtttcaccatgcactctcatggctcacgacggaggccccaaatgtaaagctttcaggacaagcaagtgcaacatgcaagacagaccagtcatttttacctctgccaccagaaatgaaaaagcgttttctccttgtttggctgcaggttactaatttggaggatgccagttttagagttcatctcagtttgacttgtaaatgaaaggtggaacctagccaaaattacccctgtgtggctgctggccctggcacgcctcgcatacccctctttcctatgttgaggtgggacagtcactgaaatcattagaaagagcaactaggaggtgcaaaacaagccctggaaggcagtaaagctctgtgagcaacacagaatctctctctcttagctttgcgattgggaccttcacctgtagagaggatcccaagcactggccgtcagaatcacccagggcgcttgggaaaaatgcagatgcctggacccgtcagtgagcccggacctctgtgtttctttttagctctcctaaaacaacatttcagaaccactgcctttcagcacagcagagagaacgaagttatggggagggttaacttgaaatagagttgtggacttcttctaaggtctatcatcattaagcttcccttgcagaatgtcagacatgtgtccaacttcaccatcatcctatcaaatccacatgacaacctgcaagtacgatttgacgtctctgttttgtggatgaagaaacagaagctaagagacattccagtgaactctggatctggaaatccacggctaggaagcagtctgtctgatgggaagggcagatgcatgcaggttccacagaaggagccctgcctcctcttctgagcctctcttggttcctcacgtccaagtgcagggtcagagatggggcaggcacatcgtccttttgctggggatctccaggcacctgctggggggcacctccttacttcaccacctctggccagcccttgatttcttccttctccctggttccaatcttctccccttatcttgctctgccttcctctttcctcctttctcttttcccagagagtagttagtctcaatcttgcaaacacagtgaaatcacttggagagcactgggtcttatccttagggagtgtggcagaattgatttggggtgtggcttggacaccagaacttttaaatactccaggctgattctagtggacagccaaggttggaagctgttccctatccagagctgtcagccacagcctgcacaatcaggagattcacctggacatgctcaggctgaagagggtctggccaccagcccacggtttgaaacagagccctgtgaagaaggatcaggtggtcccagtgccagtccagccacatctgtactgagaaaacacagagctaccaccagctgaccgcatggagcgaggatcctaacacctgatggacaaaatgcgtccttggctggcctctgcagagaagggactgtggaaaaacatatgctgctcccttgagaccgggggatgtccacagggtgggtgacaggaagaagagagagcagctaccacagccaccctgcatattaaacagcctgaaacaaggggtggctgtgcaaactccattctcctgccataaattagaccataaaacaggcttcattggcccattctgcaaatcaactctgcagttttattacacacacaaacatgcataccacatgtaggacaaaaaaattttgcatagagttctgctttgcactaatctctttaaggaaattttacagacggtaaataaaacctcatgtccctacctggggtatttgcctgaagataagagcaactcattgcaaaaggattcctgctgtaagacagactgtagcccatcaggggagagcaggatggaaacagaggcttcctgaaatacttgaagggttctgcaaactgttgaagccacggtactgcctggagcactcagcaccgagctgggcatgcctaggtcactgacgaatctctgtcaatgcacaaatgagcagatgcatgtcacactgatggtggggctcagacccaccccttgctatggacaaggaagtgctggggaaggaaaacaaacacaaaaccttccacccgaagtaagatcagctggcagatgagcgtgcagaaggggtaacagcaactcatggagggcaagccaccagagagggcaggaaatgacccctctggacacctccctcttggctgtgggctagcagtgagggagagaaagaagagggcaggtgtctgctcctctattgctccaggagaggaaaatgccccccacccccacccaggagttggtgttgtggctcacatcacagcaggcttcatggaagttgagctattatggcgaagagggtgaggtggggcacagagctgtttgggacacaggacttgctctccccatgggcatgggacagctgttcctcatgagagacagctgcagatggggcctccgcgcttggccatcagctcagctgtgcccgtgggtacctcagagggccaaagcagcctctagatgagagaaaattcaaagacaacaagaagtaaaccaattctgaaaaaggcgactgaagacaagggctggcaatggcatcattccatgtgtggaaggagttcagaagaaaggaaacacgccatcgccttctgcatggggcgggggcggggggcttaaacagatgtctgagaattgtatatggacatctgtaatcacacagtttccatagtaaacatttgcctggagagaattcttttgctctcttctttttcccatctcttgtgtacattaaacagtgcaatttatgttagcaagaataaccacacacctctctcaccacccttctttgagtgtatcttaaggcagcactccattatgctgtggaaggagcctgcatggggccctgccctcaaacataccatccccaggaccacagtggcacagacgcatgacagagcagaagagaaaaaggccccgcaaagaaacagaatggtcccaatcctgaagtgtttgattacaactcaactgagtacctgcaggagacagagctaccaatcagagcagggactcatcggctgctggttgagaggccaacgctggccttggccatggataaggagccttgaccaactacctaagaagaccttgggaatgcacgtgtgggctcagcttgacaccgacccactcttctaacttcctgtattcagattctgtgctcaccaagctgcctctgcagcatatctggcttcctaggaaaacttccctgcagagagagcatgggctggccaggcaagcatgaatattaatctgaaatattctcattacagatgaatacactggcattcttgtttgaacacctatatagttggcttttaatgggtgtcagcccctaagagatggatctggcctttgagggatgaacagatcagatcttcaagcatgccaggaggaagtccatagagctctgctttgcaccaatctctttagggaaattttgcagactgtaaataaaacctcatatccccatctggggcatttgcctgaagataagtgcaactcattgcaaaaggattcctgctgtaatacagactgtagcccatcaggggagagtaggatggaagcagaggcttcctgaaatatttgaaggcttctgtaaactgttgaagccccccgaccatgatgaattcagcaagtaatgccatccttgaaggcgccttgagggccatactcttagtcttcccctgatgacatccgagtaagttgttgaaagtctttcttggccacttcttgaatttctacccttcttcttgaatgtagactgtagactcagaaacgaccctgagttttccagggtctggatgtctgaatgtgatcaatgtggccccagaagcagtgggcatcttggttccactccttagcgacactgccaacttcacagctgataatcactcctgacctgctaaatcctctggtcctgtccaattctgatccaatcagactgaaagccaggcaagaaaggctaaccagagggagttatgagagatgcttgctctcacagaacacaggctttggttgggaagacataacatatacatgaaatggtcaaacatattcagtgtcacaaatgaaaatacagcccacactgatcaagaagtgagtaggccagaattgggtggcattaatcttaaaaggatttctgaaggaagtatttctatggaaaagcagtgtcgtgataaaaggacaggtcttcaggtcaattctttgggttctaacgtctgactatttgtgatttcacaaagtatggtcaaggctaggtgagtggggtaggaacaaagtgcttgacatacagagatgctaaaaaaagtgtccttacaaatatccctgcaagggaaaggatgagaagagacaagaagaagaaaatctgaagtgtttccttcagggctagctgctttccatatggtatctcatttgattctcacagtcacactgtaagatgtttattatcctttgcatcttacaaagaagaaaccaaaggtcaaggttaagtaacctatctaaagtcattctgctgatctgtggcagagtctaggtagtaaccctcactctgtgtcaggcattattctaaatgttttatttgtattaattatttcggcttcacaaccctatgaggtaggtactatccttaaccccacttactaaggaggaaactgaggcacagagaggttaagtaacttgcccaaagtcaacacagctagtaagtaacagagccaggacttgaacccaggcaatctgggtcctgagtttggaatgctaaccactttactatctttttccattacatatgccatactgcctctctttgaagaatatttatgaacagacaaaactgtcaaaacagcttggagctttaggatgaatattttaaatattataaatccctcactcgtaggggagtggttgtttgatatggtttctgctgatcactcagtaatctatccaagacagtgatgtgcacagactattttggtttcagttaatatatagcaccatataaacattgactcaactggagagcctgaacaataaattatcactagctcaagtgctaaaatagcacttgcttttctctgtgcctgagcatgctatctatttatactttgcttacttctgtggagttcaaactgctttatgcacatttcatcattgctgtacttacatggatttattgtctttattatacacatgtgactaatgtaccacacaacgcttaatatttactacaggaatctcagttttcaactagctttttaatctatgggtattactgactgcctttaatttataattagtggaagtctgctaacaataaaaaccatagcattttactgtttatcttttagctcaattcattttgtacatgatatgaccattcttgttcttgagtatgaaccatatattattttctggcctttctttacaattccacttatggctgaccttgaaccagaataggtctgtgattttactttccaaagtccaatacatgtatttttcttttgttcatgttgatatctgcattggcacacgtgaatttccaaatttggtcttcaccttttcagttttcataggcaaaaaataaatttggatgatgcaatagtcagtaaagaactccaaacaaaggttttcttgactagctggaggatatatggaaatccctaactgtggtgtatataaactgtaaacccaagtttatacattgtcaggagttaatagaacttaagatttagtagcattctttagtactagattcataaagagaaatgaagaaagaattgtcatttgatgtttttgtcctgacaaataaaaatagccaactgcttagcccacagctggggcattctgttttcttttgtcttcttttcatgtgaatatccatcttcattattgaaaacagaaactccaaccttaagcatttccctgtttttgcaaaaaggatattatatcaacagtcccttttaagaacaggaagttatcgtttcattctacacaagtccctacagttttcatcttgccctggtgtgtcatctgtcagtgtgactttaggaaggtgagacaggtatggccagatatgagagatttttaaaagtcacagtgtcaacaatggtgttataaggggagtgtttagtaacagagccatttattttaggaatgtttttgtaccctggtaatcctgatatgataaggctttaacaaggtcaactaagtaacctgtagtcaatatcctcattcaagagaggtcagatgcttggggactcacagctgtacagatgtactgtgtgcccttttatctctcccttatgcacatgccgttctctctacctagataagtgggcacctctacctctatgatttctctttcaggactccgtgtagttatcatttcctctaaaaagcctttcctaaaaccaagttggatgtctgttttgtgggcacagccccctacacccaccccacttatcctaatgggttgaaaataccaggaaaaacttcagataaagaccatgccccagtaaatagctgaataaagaacaggtgaagggtgtcagaaaagcaagaaatggagacagaggcttggaatggtcttcctagtattgttgttgttacctctacatggccaccctgggggtacacgtggagctgtggaaatctctaaaatcaaaaccaggccaggcttagaattagttcgactaatacagattacgttacttgaatgttttcaaatgcagattttgcttttttatttttctttgctctttatctcattaaaataaacagtggtatggcattcccatttgaaccaggtccagctctgaaagctggagcagtcttcagatggcatgctccatttggcccctgctcatagggctggcgttcagaccatggaaatatcagcagaatcgaatgcacttgggcagtttccataaactttgtaagtatacgatcaaagttaagacaaatgggaaacacagaataattaataacaatggtgagtggaaaatgctagcaagccataacaatccaaagcatgttttctatctctttttaagcagctatctgtcttacccacaaagacactgcctgaaaaatgaattcaccagctctatatctgaggcagaatgacatatggaaatagtacagtctttggcgttagacctgagtttcagtgctagctctgaaacttacttgctggctgcatggctttagcaagttccttaagatggcagggcctctgcttcctcatcaacttttacaattttggaggtttagagaaaatataagtacaagtgtttagcacatcataggggttcaataagggatgactagtgccatcatcattatcttcaacactactgaagaaacagtaaaataatcagtttggaaattatgaatgaccctaaactgaattggagtttaattatataggtgatagaaataaagattggaataagcaaattagaacataaactggaaaatatttaacaaatgtaagaaagcaaacttttgaataatttaattatactcattttaccataatactatgtatacatcaacaaatcttaatttgtattaatttgtaataatattaatttcaatttataatactcataatccttaaattatatattagctgaacagtatattatatatccttccagaaaatgctatgaatatacatgcatttgtatatgtatctaatttttttctcatcaataaaataatattatccatacagacttccactttttccctctacaataaatctcagacattttaaaatgtgagttcatatgtatccatcacctttcttaatagcagcattttatttcatatcagtttaccaatttagccagtaccctacacagacatttctttttttccccaagttttttttttttttttgctgcaaaattaaaatacataatgctgtaatagacatccttacacataggtagaaaaaacttgtagaagtgaaattaccaagacaaaggctatgtaaacttagcattttcaaaattaaggtcaaagcgctctccaaaaactttacaagaatttaccctcccattaacagcatataaaaaaaaaaaaaaaagaaaaagaaaaacaacctaggcttttttacacttgcttctcccaactctctctgtctaggcttgtcccagggcagaaggtacaatccagtcatactaataactgatttaaagggtcaccattcagcatttagccataattcatgatagttccttgtagttatcttctgttgttgcttagtctgaaaccataaacaacgctggaggtcaaaaagttcctgcttgtcctaggttaggtatatcaagttcctctagttgaaggtcccttaactatgtaggaagagctcccccacccctaaaagaaaaaagcaaaagtaaaccaaaccaatcacagataaactgagtcaagtcatcttgtatgtactgaatgtttttctgcgttaggctcagcactagggggcttttcatacattatctattttaggttctacgtatttttgaggaagccccccagattgccgaattatacctgggaaaacgagaactggtgtcccaccccccacccaccgcatccaatgaagtgctgctttcaatcagcaaaaacaggccatcccactatcagccagaaatccctattaacagccgtttctgagataactgatgttctccgtgtgactctgaggcttggtgagatatttaagtgtcttttaagtcattagaagagataaatatgtgttcagtatagttgtggtgtcaagtatattttgttgtatttgaattctataaaaatctgttgtggaaaagtggtctattgggtattcccagattaaatagaatgttgaactaaccagaatacgtcactcttctagctgcctgggggtttactgcacttaagataaactgggatttaccatattactcagccctgatcttggcatcataaatcttctcttcacttcactctcactgtcacactgagcgaaagaatagaggccccctctcccaggataaaaaaatgtgaaaaagggtaatttcccatcattctccctaaaaagaatcccatgtaagactgttgaatccaccctaaataataatctccaaattaacaattaccaccctgagatgagagcaaataaaaaattggattggaatgcagagcttgacaaaatgattccatgccacgggacattctctgtgatttgcgaatacaaatgatagcccattctttatttaaaacatcttttctaaggtcaggtttttgaaacttaatctacatcttctctctaaattaataaggttagatcccaagtacaaaggaatgtcccatgaagtatcagaagctggacaccaatagtattgtgagatataagtcaacatttaaagtccacttttcactttcagatggcagggacacaactgccacccagcccatgctccctgcaagggaagaagggattctcccttcctgagggtcaagcccctggagattgttctcaaccctagaaaccatgggcctgccccagtaagtgaaagtcttattttactttatttattttttaaaattttactttaagttctgggatacatgtgcaccatgtacaggcttgtgacataggtaaacgtgtgccatggtggtttgctgcacctatcaaccatcacctaggtattaagccccacatgcattagctatttgtcctgatgctctccctctcctcgcccaccctcaacaggctccagtgtgttgttcccctccctgtgtccatgtgttctcattgttcagctcccatttataagtgagaacatgcagtgtttggttttctgttcctgtgttagtttgctgaggatgatggcttccagcttcatctatgtccctgcaaaggacatgatcttattcctttttatggctgcatagtattccatgatgtacatgtaccacattttctttatccagtctatcattgaggggcatttgggttggctccatgtctttgcgattgtgaatagtactgcaataaacatacatgtgcatgtatctttataacagaatgatttatattcctttgggtatatacccagtaatgggattgatggctcaaatggtatttctggttctagatccttgaggaatcgctatactatcttccacaatggttcaactaatttacattcccaccaacagtgtaaaagcattcctatttctccacagccttgccagcatctgttgttttttgaagtctttattttatttatttttattttagcaactataataacttggtcttctaaggacagacccatcttcaactgaattccacttctgaggcagaaaaaactttgtgagattccagtatattcaaaaacagttaatttgtattcagtagtgtcactaacctactcatatgaaaaaacactttgtgtgtatgaaatacatcacactttaagtagctgaggtgggtttctggtgaaatcactcattgtaggcatccatgcataagcagctgcttactgaagaagttaagccagccttggagttcaggataagccctaaaggtttctgatgtgttaagtggagattctgaaatctgtgccagagagtaggttttaggccggtgcatttgcaaatcactggaaaaagcagtgcatttgaaccccctcaggacagactgttgcatgtgattaattaatctctgaccaatcagaaataactaagcgttgaggctgaaatatgaaattaaaaaagaaaattggcctagtcttcatttcttttgcattattaaaaaataacctacaaatacgtttgttacatttaaatcatctacagcctgagtgcctccttccttcatttgacaaactactcattgaactactatgtgcagggtgctcacctagggcttgggagcactgtcgggactatgacaggcatggtccctgctttcatggatctcaaagaataaacaagcacagcattgactgtatagaaatattcagagaattaaagtagggtgataggagagggaatgattgggtgttccaggggagcctctcaaaggaagtgacatttaagctgagatttgaaaggcaagaaggagccagccctgggaaagttaggggcagtacaatgtaggcagaagtcacaagtagtggaagatcccaaggagggagcaacctgatgtgtttggaggatcaggaagtcagttcgagtggcccacaagcaatgggggagtgtgcagttggtgagagctgaggcttgagaatcagtgcgaaggcagtgtaagattttggaaatcagatcgagagcctggatattattctaggatgacgggaagtatttggggtgataagacaagctaaaaagcatggcccatacatcttttccacaaagaccccaaactagagagatggccaacaagatggcaggtgtcctgaggtgcacgtctatcccttggtgcccctcacccaaagagccagactcttgaaagcactgatggcagctggctccttggaatgacatcaccaggggataccacggccacagcacttgccattgcatcagctccaacctggtcaagacctacatcatcaagacctcctccttcacccctgccccagcatccagacttaatacagcttctcactcctccccagaaatgcttccctgtctacttctgcattttcaatacacagaagggttttgtccccaagcactgacagattccatacttctgtgtaactaattttggccaaaaatattttcaatatctttgaaattctgaatgcgtttcatcaaggaaacaagggtaatcaattctacagccatacttgtttcatgtatgaagagaaaaactcccaaataacaccccgtgatgaaatgtcacactcaaccattaaagacctatttttagcaaagtcaaccgctgagttctcagccaaatgaaaggtcatgtgttatctgagaagcacatgttactgtggtcatcaaattgctaatctggggcaaggtattccatggaagatgcctgttatgaaaggagagtgtactgtagtgattactgctattcagaaatgaggatcaatctacaaaaatgataaggagaacatgaacttaacaactacatttcaaatgatgttttaaacatgtccattaaagtgacatttgtgtgtgtctgtgtgtgagtgtgtgtgttaagaactcttaacatgagatttgcttattctttattcctgttgaagggcaactccccatttctctcttcccctaggccctgacaaccaccactgtgttctcggcttctgtgaatttggctactgtagatgctcatataagtggaatcatgcagtatttgtccttctgtgactggtttatttcactgagcatgatgtcctcaagaatcatccatgtagttgcatatgaaaatattcttaaggcggagtagtatgtatgtgtgtgtgtgtgtgtgtgtgtgtgtgtatacacacacacacatacaaatacacacacacatatatatacacatacatatatatacacacacacacacattttccgtatccatgcatctgtgaaatgacattccttgatatatattattagtggacaaaaatgtgccctgaggtttcagtatggtggtccatatatcaaacatatggttctaaaatgatatcatcacatctagcatggtattgaaaagactgatgtagatttatttcctcactagtatgaccttaagcaagatatattatattcctaaatcttggttcttcatctgtaaaaaataaaaataatcatattcatctttcacagggctgctgtgatgattaaatgagataaaccacacaacacagcatatgacatagtcactgatattcaatacatatgagttcccttttcctttagctctctgctcccacagtaatccaaatttttggcaagctaatagtttttatttttcgatacagttattagcaccatccaatcccatataaaccacaaacaggctggaatttttgtctatttgtttgatgctgaagcagaaaagtgtctgccagatagtaggtgctcaataaatagccattgaatgaaatgaatgaatgggaagttacactggaatgaggctgaatgtgaaggtcagtcaaatatcttagcagaattattggatatgtttttaatggaagagatacatttttaaacttttttctttttttttttttgagatggagtctcactctattgtccaggctggagtgcagtggcatgatctcggctcactgcaacctctgccccacaggattcaagcaattctcctgcctcagtctccctagtagctgggattacaggcgtgcgctaccacgcccagctaatttttgtatttttagtagagacgggatttcaccatgttggccaggctgtaataatatagtgattattatagtatactctatactgtagcatagagattgaggttggcacatctcacatatgactatgaatacccaatcattatgcttatgaactacaaaaaaatcagcagataacttacaagtgcagccatgttacaaaataattaagtataaaaaccatctaataaagacagcagtggtcccactaaactctgtgatattttaaccataaacaaagcattaatgggaaaagtctgatcccaagggttcctggatcagcagtaggtcagtgatacccaggagagcaggaaccatggcgtataaggcttgccttggactcagcttcaggatctgagagtcggcctggggaagtcctggtaacctgcaaggtcacctctatagaagagccagtggtggcaggcatcgcctctccagctcttccagcttattttcccatgatagtgcagtgatatatcattttagaattatgattctagaattatgtagtcacatggagggggcatacccaacatcacagtggatggaaatcgaccagagtgaccccagaacaccaagaaaacatcatagtggggatggaaacctcccttgctcacaaagctggggattgggagctaactctgccaccaacaagctgtgtagctttgggtaagtcattgaatcttggtccagcaggccttggtttcatcatctgtcatttatcaatacaggccgctttcatctctatctcctcacttcagaagtcccatgcctggactgtggcggccctggctggtatcccttcccatgccttgctgttttggaaaagttacatgtgtagaaactacagatggtagtaggggagacaataaggaagaaaaagtcactccttcaccttcttttaaagtactatgctcacaactgctcacatctggcacacttcaatagcaatcacttgcaaggtccaaaaatcttgaaccatgaaagtgaaagaaggagctttatcttcaaaaggaaaattaaagacctggagaggaccacttgggacctttttattacacctagataatggcaggtattattgctctatgcagcagtatgtttttatgaatagactaacacacacccttaggctgtaaaatagtgctttaggatataacatgttgattcagatacaaaataaaatactgtttgtattgtaggcttttaatgaaaagtctaaaaacacacctatttaacaaacctctatttttatagggcctgcctaaaaaagcctgctttaaaaaaaatctaagtatgggtggtctcacacctagaagtggcacaagaatcctttgtcagacgacgtgtcttaatttttgccatggaaaatgtggtcaccataattatagcccagagaaaataaaaggtttttaaaattccatgcaggaggggaataagagtttgttagcattcaataaaactataatttaaccagcttttaggtacagcggaatcagcagttaaattacagcactggacaattctctattttaccttgtggctatttgtcgaagtgtcttatttcctcttggagacctaagctccttgggaacaaatgccaagttatctgtatccctgtaacctctaccagacctggtacacggtttgttttttgtgttcaatgaaccacaaagaatctttcaggaaaaatcacttgagaaatatttcagagtaagaggaaatcaatgcataacttgttaaaaactattttcttaggctgaaagatatttcaaatacacattttaaaaggttcatttatggaaaaagttcagttgtgcaggctctgaaatgagatttagccaagaaaagcatcaatactaattaagtattgataaagaaggaggggggagtttagctaggtaacttagtcacttggttactaaaaccttcttctcgatggaaagaaaccattagagattgagcgactcatattgaaggaggagctataatgcaatcgtttctctctatgtatggtcttttttttggctttgaaataaaagggtcaaaggtaaatgagcctattgaaaattaatgagagctgaacgctgcatgctgttaatatgctcacttaactcaggcatcaagaaagaaccgtgcggccctttatcatacgggataaaatacaaaagcctttatatacaatttttgtttgtcaattaaaaataactaaataaaaattttaaaaacttttttaaataaaagctttccaggaaggttgggcgcagaaggacctgaagtttcctgcacatggaaacatcatagttatgagtttttctcagcttggatttcctgtatttctcagatttcttaactccacagtgcaacttactttccctctaaccatgaatatgcatcaatcagaaattccaatattttagcatctgaactccatcttcctaactgcatctcatcatcagaagtagccaaaaaaaggtcttcttcaaatctatcttcttcacgttttgatttcttgcaacagaaataggatgacgataaatacaggtgagagaaaataatgttttcccgaaataggtaagaaagttatggcttgttgacatgtggctgccaaacacacatgggtggaaatcgatttgaagggtttgggtctgtgtaaagatgctgcatgaccttcagagtccaacccggctaagcgccccctgccacttcctagctgtgtgaccactgacaaatcgttcactttctttgagctgctgtctcctggtctgaaaatggagcaaatgctcgtacctgctacaggtgttcagggctcagacagtgcaagtcacaagcttatagcagcaccgtgtctgtcatgtggtgagaacccactacatggtggctatttctggtgtcatcttctgcagcaatttgtcctgcttgaattgtgcagaatgcaatcaaatgccaaactcttcttgcattttcagtgacaatcctctggtgacagctacctcagaggacggtgtctgtgaggcgccagtcactcctacagttgactcccccatgtccacgtctgctcaatcaggggaacggtcacagcaggaacagaaaagggaagggagagaggaaaggagggagggaaaaagggagagaaaggaggaagaaaggaagaaggaagtgagggaggaggaagctttcataagatgatgtaatattcaatttcccatcctcattctttgccaatcgtcaccaaatattttgaattcaaatgaaaagcatgttagtcagacattgaggggtgaacctgtcccctgtgagagagcatagttttgttggcaaatgggagtggagagtagaaaagaaatataaaacaaacagagactccagttaaactgatctgtcttcctcagtctggtgtgggattttctccattgaaaatttctgtttcttaatattgtatcataaggtggattttatttgagcttttcaggttatttggtctttcttttgtaagaaagtagtttatttgttttcacaacaaagcagagtggcttctggttgaggaaggagagaactatgagttgaaggaagacggttttgcatgactatgctatgcccctgtatacgcaaagatgtagagacacacacacacagacatacacacacacacacacacagagacacacacagacacacacaaacacacacagacacacactgacatagagacacacacacagacacacactgacacagagacacacatagacacagagacacacacagacacacactgacacagacacagagacacacacacagacacagagacacacacagacacacactgacatagacacacacagacacccattgacacacagacacacatagacacagagacacacacagacacacactgacacacagacacagagacacacacagacacacactgacagagacacacacagacacacattgacacacagacacacatagacacagacacacattgacacacagacacacatagacacagacacacattgacacacagacacatagacacagagacacacacacagacacacactgacacacagacacagagacacacacacagacatacacagacacacacagacacaaagacacaacagacacagacacacacactgacacacagagacacacacacacagacacacacagacacagggacacacacagacacacactgacacagagacacacagacacagagacacagacacacactgacacagagacacacagacacacagacatacacagacacacatagacacagagacacacacaaagacacacagtgacacacagacacagagacacacacacagacatatacagacacacacagacacagagacacacactgacacagagacacacacagacacacactgacacacagacacagagacacccacagacatacacagacacacacagacacacactgacatacagacacagacatacaaaagacacacacactacacaacacatgcacacatagagacacacaaatgcacacacacaacacacacacagacccatgtacaggcacagacacagagacgcagacacacacaccacacacatcacatagacacatacacagacacgcacaacacacagacacacacaacacacacactacacaacacatgcacacagaaacacacagacaaatgcacacacacaacacacacagacacatgcacagacacagagacacacacatatactacacaacatgcacacacaagacacacaggcacacagacacagagacacacacaacacacacagacatgcatagacacacacaacacacacagccataaacatacaaacactacacaacataggcacatacacagagacacacgcagacaaatgcacatagacaacacacacagagacacatgcatacacagacacagagacacacacaacacacagacacatgcacagacccacacacacagataccacacaacacacacacagatacagacacaacatagacacacatacaacacatgcacagacacatacacagagacacacacatacacgcagacacatgtacacagacatacacacaggtacagacacgcagacacactacatatgcacagacacacagacactggcacagaaacacatggagatgacacagacataaacacacagacgcacacgtatacaccatagtgaggctcatcccacttctgtgctgtgagtggcataatctcttatttcctttttcaatcaagaaaccctgacatttccaaccaccacacatggggtaaatacggtagcacggaccaaaaccgtaacaaacaaaacaacgcgcacacatgcacacacacacacgcacacacacacacacgaaggatattttcaagcaagccagtctctcatgaacttttcaaggctcagctcgtaaccttagttccagacgtatacctctgactgtttccaacatgttcctgttttgtttgtttgggtttacttgccttcgttctgcaggaagccctcacagatatgacagggtgatttaattctgcacaaacctcgcctccctcagttcttagaatgaagatagataccactaccggtattcttagagttagacttacacagcctcccacaccaaacagagtgaagcagaacccacatttcactggaatccttacttttaggtatttgcaggtttttctttatgacacaggaaaccaaatatgaggtaccattgcagatagtaataaatgggcttctaaaatgttcccagtggctggcagaacaataactgatttatatcccaaaaggggcaatacatctgaccccttacactttgtaaaggaaaggaagattctagacactcttttgtcaggtgttcaaatttattcaggacaacagattgtcaaagccatctttgaagggactggcaaaagtttctccctacactcccgcgtataagacagtcaagagccaaaaatgatagagttggcagtgggccatgggatgggaaaacaaatcaagctttattttttgttttgttttcttttagagccagggtcttgctctatcactcaggctggagtgcaatggtgcaacatagctcaacacgggtgggagaaaactcatcaactcctgggaaaaagtgattctcccacctcagtttcccaaatagctgggacacgcctggttaattttttaatatttttatagagatggggtctcgctaggttgcctaggctggtcttgaactcctgggctcaagtgatcctcccacctcagccttccaaagtgctgagatacaggcatgagccactgcgcctgggccaaattgagctttgaatgaaggggtccattcctatggagctaatgaatccgctgcatcctcagctccagcaggcacgggatgtttgaaacaagccaggcataacctgcaccaaatgggcaatgtgcaggcagcattacggagcagaagtcaagtgacaggctggggggtccacggtcttgatgatttctgctcctgctgctacgctgatagccagtttactgacgtacacatagagaccactcttaaccgcaggctgaattgtccctaccaagctatctgcaccttgagcatataacaaaccattgtgagaaaagttaaatttttttcacccaattctgacatttaagactttctgtaagatggccaaaatgtcttaagacccaaattcctgaaagtctttcaaaagacgctagtcaattcatccttataaccctcccttttcccaccgcccctaatagaaagtaccttgggggaatctcctttggttaatacataagtaaattaaggagatgactttccatgattttacggaatcagtgactcttaaataaatctctttaaaaaggaaataaatgtgtcttcatagtagaaggatttatgcacatgtatgtttgttgtggcactattcacaatagcgacgacttggaaccaacccaaatgtccatcaataatagactggataaagaaactgtggcacatatacaccatggaatactatgcagctctaaaaaaggatgagttcatgtcctttgcaggaacatgaatgaaactggaaaccatcattctcagcaaactatcacaagaacagaaaacctaacaccacatgttctcactcgtaagtaggagttgaacaatgagaacaacatgaacctagggaggagaacatcacacactggggcctgttagggggtgggggtctaggggagggatagcattaggagaaatacctaatgtatgtgacagggtgatgagtgcagcaaaccaccatggcacgtgtatacctatgtaagaagcctgcacgttctgcacatgtaccccagaaattaaagtataataataataataaattctacaatgaaaaaaaggaaataaatgtattcctttggctgggcacagtgtctcatgcctgtaatcccagcacttggagaggccgaagcaggcggatcacttgaggtcaggagtttctgaccagcctggcgaacatggtgaaaccctgtctctactaaaaatacaaaaattagccaggcatggtggtgcatgcctgtaatcccaggtacttgggtgcctgaggcaggagaatcacttgaactcaggaggcggaggttgcagtgagacgagatcgggccactgcactccagcctgggcgacagagcaagactcagtctcaaaaaaaataaaatattcctacattcacataacatttgttagaatactggcagcacaattttatgacaactacttcactaagatttagaagacctggtctgactcagaacaactgaggccacttacctaacctgtctgtacctctgttaactcattcctaaaatggtgaggcctggacaagacggtttgtaagataattttcagctctaacattttgtgactatatatttatgcagattctacttgtaaaagacacgctgttagatgccacagagacaaacatgcaaagacatgatctgtacctcgttctgtttacagtattattgcttggctgtatttccaaacttccatcataggctactttgattaggcatcaaatttctatctttctttaactctctttgatgtttagaggttcttagacaaatggggatcagtaccatatgcacaggctttgcctaaacatctttatattcaccttcactctgtgtgtcttgtgcagccatggttttcttggcacccaacaccatcaggggctctctaaacaaggactatgttggcctgccctgctgtgtcttgggaattctataatatagcttaattcttgcccccggagtggatttcttctcctctcttctccctcaagaacaagcgtcctggcctacagcctgcagcctggggactggcgacctgcttgaaaatctgtgcatgtcggacctgtcagcatccaggctggggaaaacaggctgcccttgagcagaacagctttgctaatcaatcacgcttcaggaaagtgggtggtttgtatgtgaggcccactttgccaggaccaagccccttacgaaaacgtctgagtgtgaattaaaagaaagaaaacagtctaccttctgcatccattgcgggagggccagacaaggttttatttaaaaaaactcctcttttctgaagtctgaaagcaagaccctgggcttaaagagaattcctccgtcaagatttactagaggctatgatcaggagatggagctctcaacctggatgccaatgacatgtgtaaaacaagagaaaacttcagggaggttccccacctattcagaaattagaaattaactacttatatatttttaaaaagagcctcctgaggtgatatcatatatgattgtgattgtactagcaaagcaattagcaagttgagcacatgtatatctttagaagctaagccagatacaagatacaagtccctactagtaagatgcgattaatgggacaacgtcaagtttattgtcacagggctgggtatatattctggctattacttgttagttggggcaagttaggtaacttctctaagcctttaaatacattcatacatatgcacacgcacacacacacacacatacacacacataatggggccaattatactttcaactcatagaattgttctgagaattgagatactaaaagcaaactaagtgtttctatgctgtaaacacaacagaaatgtaaagtattgttataacagacatacttgtatttcttcaaataatgtacacattactttactcaaaattatttgatttctattctagctttcatgttttttgttattttaggagtgagtttctaattaattcagtttatatgcatttcctatctaaagtcttttcacattttcaaagctcctgcacgagtgacagaaaaacacaagcttaaaatatctagagaaacagcaccacagaaataggatagatagataattgagaaggcatctgccctctatccagcacagggtcagtactacttctggtacttaccctgctcacatatgaactgactaatatacaagattatctattggagcattatctgcaataccaaaagactggaaataaacaggtgtccatcatcaggggctggttaattactccatgggtagtaaatagttacataatgacatctaatgaatttctcatcctgaaattgcttccacattgactctgggcttggccccatgacctgcttttgccaatggaacattaaccaatgggattcaagtagaagcttaataaaacctccacagcggggccaacccctctctgtttttgtgggacccagtcgccatatgaagcagctggggctggtttactcaaggcacatattccaactgaggtcagactctcccaacaacctgctagtgaggccatcttagaccatctagccccaaataatcacatccatatgaacaaatccaggcaaaagcagcagtaaaaaacccttggcagatctcaggccaaatagttcacccatagaattatgactaataaaagggttgttgttttaaaccactatgttatggagtaatctgttatgcagctaattgataactggcacactctgatatctccaaaacgatgcaatactaggaagtattatactacctaggaagaaaggaaaagcatgcattctatgtactgacatggtacatctcaagatgtaccatgataagatcttacatggtaaaatctcaagatatactgttaaattaacagggcaaacagtaagctgccttttgtgtaagaaagggaaaattttaaaatgtgtatatgttattttgcatggatgggcgctggatatatactcaagaaattaatagacaatggttccttattctgatggaagagcgagtagtgaattgggtggatggggacggaggtgctagcgagactttccaataaacacctttctaaactgttccagtataggaaccatgtgactaatacctatgcaaataagtattttgaaaaagggaaaaataaggctaatacaagatagaaatgacaaagcttgaaaaagttgaatttcaaactgacgattataattctgctatgcaaccatccttcatcaacaacagccttcctttgaaccggaataatcgtttctttgtaacacatatgattatttgtacacctggctgtcttccctgctagattgtaagtgctttaaaagcagggaccatatctcatgcatctttgtctcttcagcaagtggcaagcatcttgccgggcacagaagaaagccttgctcaataactgtttgttgagtcaaaaaaataaacaaaaacattcggacctcactaacagtgtctgttgttaatgctgatgagttcaataaaatcttcaacagcctagcttctatctgtacacatcctccacacaccatctttcaggaaaatggtgagcattcctcatgatctgggctcatgaatgtactctgaactactggggagagtatatacaaaagctaaattcgaacactacgaaaagaaaaatgcaaaacaacctcctctatttaaaaaaacaacaacatttgactagagggggtctagaaaaagaaaagaagaaggatcttttattatttctcataagtaacacatttgactactgtggttggaataagcagccccgctcccaccccctgcttgcaaagcaaactaagccacccgaataagtggaccatggggatatagaggcagaaaactcccggccccatccccaggcctccagagaatttgacactcaagccacggtggagaggttttctgttatgagtttagcatttctaagaaagaggagaccacaggctttccctgtagtccatttcaagagtctgatagctctcactggaaatcttcacttcctttgaacttgtaccttcctgctgtgcctcaggcctctccctcttctgagagttcttgtctccatgtctgatccctgtgaaagtgcaggcatttaaggaggaggtctgggcccccttcacggtggtgtccacacctctcccagggggatgtgctcggtaagtgtgcatgcagcaccatctcagccctgtgcatcctggaccgcaccaacaaacagcaccacacagcttggggaccatgtccagattcacacgcagacgataagcaccgtggccaatacccaagcgttagataattaaaggtccctccaaggataaacacaagtaagagtggaagcaaaggaagtgcacacgcttgtctcaagaaagacagggcatgtagccttttccctaggatctctcatcatcttcgcttctctttctcacatcaaatgatgccaattctttaactttcctaggttccatttcccaatgctttcatcagtttcactgtcttctgcgaggctgaatttccctaattaagggcagtgggagacgctccacatttggagtccctgtgaggcagcaaagatggagagctgagactgaccatccagaatccaggtgtgccttcgccacacagaacaacaagcatcgttgatgcctctagtaagtgccaggtgttgggttagatgctgttggagatataaaaggtggagacatcatctctgtcacttaatgagagtgacactgatcggacaggatttaaagaaggggactctggtgtgggtgggaagagcacagtgggagggttggggcaggggcacggccttgggactagagtaggtggaggcagtggggcggggaggaggaaaagaaggaaggaagaggccggtcagaggaagcccaaaagtggattcctggacacacagtaaaaaggggaggacgacttaaagacggtttccagatgtgggggtctggggagaagggaagcttttacagctgctgacagaggctgacagatgcagagagggctcgtggtgagctggctgaattcggggtaaacaagaggagatttcatgcttcacctcagatgaggaaataggactaggaatacagttttatgattgaagccgtgacagaaaagcctttccaaaggagcacagtggaggagagaactggagaagaggcacggagaccgccaagcgttccaggtgcaggcggcaggagggagcccaggatgccggcagagcgagccttggtctgtgaaccccagggccgatgggcaccggctcatctaattcatttgtgtacagatccacaaaactgcacctggctgtggccgtcagtaagtgctatataaatgcttcataagtgtttgttgaaggaagttgaaatgtagtcgtcagaagagtgagagggaaaccagcgacagagccttgtaagtctaagaaaaagaattcaaagatggtcaagagctaacattgcacagggaattacagtatttccggaagaccaagggcaactctgattgttccagactgcctgggagcaccagagtctgattgttccagactgcctgggagcaccagagtctgattgttccagactgcctgggagcaccagaggtctgggtgggggcaggagtcagtccacctggaacttctgcctccagtgcactgagtctgcacggaccaccagggctgacactgccttacttaatatgggggtgggggaagtccctgcgatatataatggtctcaatttaaattctgtgctgtttttattttagctgtgtaatttggaaacttcaaataaaaagcctgaaaggaaagttggactatttaagcttacacagactctattaatgctatatggttattctacccctgactttggaagaaggagaaactggcatgggaatacacttttctaaaaaaaatactatttaaaaatatgaaagtttatttaacatctaaggaaaggtacttaattagagggacactcaacaagaagaattgaggatctaagtaaatagtccccatctgctcctggtcctaccacctggcgattacttcctcttcttctctgatagattttagccaaccaattttgttttatttgtgcaagttgagaggccacctgttatggaatatacttccacattaaacaaagtgaacatttcctatttctgtgcttcccatatgatttttaaaacacaaagcactcactttcaccttaaacagatttaagaaatgctgactctgatgaacaggtataaacaaggcaatcttttgtttatgaaaattgttaacgacctacccacagaaagacatgccctgcgccacactgtaccccccacccccgcccacccggctccccgatgctggtgaattaatctatccacacgtttttgctcatttccctggctgttaccagctgaagtgaagaaaagacattttacaaggggacatggtatatttgtgctaaaacaggcaccacacaaatccagagaaaggagccaaaaggaaataccaggcagagggaacagcgtggataaaggcaaagctgagaagagggtaagtgtttcgtgttgggggatggtgtatctgggggctggggggagtggggtacagtgtattgggttgaggatttatagccaggaaaactggaaataaaggggaaggagactttgtgaagggttttaactatcgggctaaggaaagctgcattgttcctaacaactgggcaccagtggaagtttagagccaggaatataattgtcacagaggtgctttggactgaataatactgtggctgtaggcagctctgggttgggggttgggaggtacaagcctccaggaatccactgcagcagtgtgggccctgccacgttgtcctgaacaaagtgctatggggatggacacaaacatgaagtgaaaactccagagatcacctgacctccacgtgccactgctctgactgctggaccacagtgatgtttggggtctcctggaattagtgtcagctcagagccagtcaccagtagtccccaaaaggtctgattaattccttttccccagtgcacagtcaccctggcaaaaggctataggtccctttggggaaggctgggagaaaaagcaacagtattaattcttgacagtgtggtagggtccttcgtcaaggagacccggcctcctcttcattcaagggcttctgggtcggtaaattggtgcaagtgtgtgaattgatcgaggggccgtgactctctgttttcagggtgcaagttgggcttttgttcccttcacctagaactcctccacttatacagaccaagtaagggtttagtagatgtccgcctatgtcatttctaggaacgccatgaggacagggttggaagtgggggaaatgaagtgttagtctgtgtacggatacaaagaaagtgagatgatggaactgaagatgactaagatgtggggagccaggactagtggttcccattggcaggtggtctcctaactggcaatgctagggagaagtgtataaatcctcaacccaatacactgtacccaatacactgttagtggcggagggagaggcagagcttggtttgaaatggtgggggattctccaaggtggcatggacatacaggatggaaatgggagacgtgtcaggcctggagatatgggttttggaacaacctgcattaaaattggaaggattagagagagtaggtgagatctccgagacagaggaaacagagcgaggaagctaagacctaggctggggcaaatgtctgaatttacctgagtgggggaagacagagaagctggcatgttggacagagatgactggtcaccaagacagaaggaagaatcaggccgtttaacaggatcaagagggtctagtgtttaaagagagatctttccaactgctacaggaaagtaaaatgttatggctccagacacctgctgaaattggtgcatgatcccctcaaagacagtgtttccttaaaaacctgggaaaagaagagcccctggtgtggtggagggtggcagtagggacagttgggagtgaagctgtgcagtcaggaagaaaccatccagcttgaggaagctaaagacatggggaggagacacagtgcagaccaaaggagcagccaagctaaaggcaacttttttctaggacttcggggtcctaagtaaacttgtgggcagtgaacatgctggaagtgtctggactgttcaggtggagaacaggcagtacaagggacgaaaagcaaatgtccagatggcgattagtggaggccttgggggtggaagatctcagggctcacccctgtggttatcatcttagtgagggggctagtgtggacttcaggcccaaggaagaataatattttattctttacaaaatagtgcatgaaagattagctctgagtctttataatcttatcattggcttcaaatttcaatcccatattatactttccaagtatattttgttaaaatttccttaattcataatattctaatcagcaatgagtttctatccacatgtctatgagcacatatattaatttaaaaatctgcattgctcttgtatgaatgaaatataaagaaactgaacttctaacgaatgaaagacgctggatgaaaagataatattttatctgagtttcagttcagtcatatgtctgagaatgagtttatctagcccataagccttctgctttcctttcagttcttttttttccactgccattcataggttttttaaagatctttccattcacttctgcaggactctgctaaataatgctggttgcttgcagcttagccctaccctggagatgtggctcctcctggcagtcctggcgacccacactttggaccccattcaccatctcattgttctgtgacccacttctgacttctccagcccttttctttatttcatttcacctaagcccaaatagcaagtctcacgctcaaatcctgctctgtccttgctttccgccctgaatctgtccatttgtccttttgcagcttttatttcttcccatctttttcttttcatttctttttttttttttttttttttttttgagacagagtctcactctgtcacccaggctggagtgcagtggtgcgatcttggctcactgcaaccaccacctcctgggttccagcgattctcccgagtagctgggactacaggtgggcatcaccacacccagctaatttttgtattttcagtagagacgggatttcactatgttggccaggctggtctcaaactcctgacctcaagtgacctgcctgtctcagcctcccaaggtgctgggattccaggtgtgacccaccgcgcctggccatatttatttccatctttccaaagactgcagaaatctgccacttgagagaggctggccttgttttctctcgactcaaatctcctcctggttttctaagctcatgaaaatctctatgtgacatttttttatttgcagttttaagctatctatatatttttaagtcttcacctttaaaccttcactgacttccctttgcaggtgcactgtcattttggtaactcaacactgtctgcattttattttggtgcatgggcggggggctctggcttcgatttagtccttcagacacatacagtgaaataaataggtactcgacgatagtatgtgttgttgctgtgtagttcttttgctcctgaacagcaaataccattggacttggcattgtcctactgtggctgcaagctgtgtctcaccacagctaacgccagtgcagaggagccatgccacgcaaaggtcccctgcggcagcaccagcctgaagctcttcagtcatgaaaatcagggaacacgtcattgatgactgtcctggtcctggcacaggttttaccaaaatgcaatcaggtttcgccagaaatgcagtcatgtgactcctttcttctctgagggaggatggtgttcatgaatgcaatggtagcatatgacatttttagttgcccctaaccatgtggccctaaaaatactccatttaggtcaggtgtggtggctcacgcctgtaatcccagcactttgggaggctgaggcaggtggatcacaaggtcaggagttcgagaccatcctggccaacatggtgaaaccccgtctctactaaaaatacaaaaattagctgggcgtggtggcgggcgcctgtagtcccagctactcgggaggctgaggcgagacagaattgcttgaacccaggaggcagaggttgcagtgagccaagagcatgccactgcactccagcctgggcgacagagcgagactctgtctcaaacaaacaaacaaacaacaacaacaaaaaaaacacaaaaaaactccatttagtagctttgaaaattccaagtttcctttaaagaagggaggtaaggaaggaaattatgatgcatttaacagccacgtgaagtagacagtctcattttagagatcagaaaaccaagggtagagagtgagtatcacaataggtggccacaagccacagtgggaactcagggagcttaggtcaggattccaagctttctcaaataaaagttgctaccttggccgggtgcggtggctcacaactgtaatcccagcactttgggagatccaggcgggcggatcacgaggtcaggagttcgagagcagcctggccaacatggtgaaatcctgtctctactaaaaatataaaaaattagccagtcacagtggcacatgcctgtagtcccagttactcaggaggctgaggcaggagaatcacttgaacccagaaggcggaggttgcagtgagccgagatcacactgctgcactccagcctgggcaacggagcgagactctgtctcaaaaaacaaaaaaaaagttgctacctttacacaaaggatgaaaaagtaggaaagagactgcaggaaaggaatgtgagagaggaaaaacataaagaaatttcaaatttgtgaatacacctttcccctaactcatgtgttgttcatgattaggactaagtgctgaagccagaggtgacccaaattcttaggagcagaggaggacagaggcaggcaggtaggccgattcctgctggttctctgtgttacttttgctcccataacctcccctacataggttggtttcagattctccaataaaaatgtatgttaaaactgtaaaaacaataaaacatgcaaatctcttccatttgcagccaattgttaccatgcaggtattcttcctggcaaatattcaaatgtcaccagcatcacgtgcttaatattattttagtcaatatgatttgtgtcaaaatcgcctgaattcagtgattgttggatctcattatcaccaatgtaggtcctcacaccacacccctcactgctgatgaactcacaagaaagacttcatactttaagaactagtattttcttagaaaaggaagaaaaaaagcagttctcagtaaaagataaaccacagagcaactgggttcagatgagttgtacacattaaaccacacacacacacacacataaacacacacacacacacacacacacacacacactatgaaaatgatgttgaggcattgtctaatccacaaatgtgagtaagttcataatttaggagttaaaacgagaaccctactcatgacttttcccggcactgagaatgcactgaagaatgatgaaatcacactccagattaccccatttgttctcctgacagctctgtggaccattatcatatagaggccctttgcttggtgagaccctgaccacttgacattctttctcagagcgggctggtcagagttctctcgacggcagaatctacagggcccacctcaacgcacaaggaagccccaggccctcagggacctctaggtcccaaaaaacagtgtcagataaagaaattaagagggggctgggagaagcactctgtcaaatagaaagcctatccacagaaaacttagggatgaacagagctaagatgggctgatgaccttgaagttgcagccaaaatgatgaggccaggtgggcttgctggccaagaaatgcaatctcaagagtgggccatggctgtgatgcccaagcctttttgtgataaagctaagaaatacgggagaaatggaagggagaggggcagaacagacaaggaagatgggaagcaagaaggacaggaagtgccagcagacaccagcagcagggacgagtgcagaaagtgtcagacaatccatgaattggaggaggacacccagtgaggagggaaaagggattggactgtgccaccatctctgtaggggaggtgagacaaacgtccggtgcagctcggaagatggcctggaaggcctaacccttccacctgcctgactcctgacaccacgacatacacagttatttttaaagtgtttaaaatataaaccacattcatgggaacttgaagtcaggtctcaccctgacatccatccatctgtgtattttcaaggttgactcaaatgttgaaaagtcacctgtgatgtgttgtaccatttgagcttttgacaaaaactataaagaagcaaattaaaccaggagggaaatttctagctgccacactaatcaaaaactgtcgggtaataaaaaaaaaaatcatgctaaaaataaaattacatttcgggccctaaggctcatttcttttcttttttatttatttatttatttatttatctatttttgagacatacgctcactctgtcacccaggctggagtggagtggcacgatcttggctcactgcaacctccgcctcctggtttcaagtgtttctcatgcctcagccccccaagtagctgggactacaggcatgtgccaccatgcccagctaatttttgtatttttagtaaatggggtttcaccatgttggccaggctggtctcaaactcctgacctcaagtgacccacctgcctctgcctcccaaaatgctgggattacagacgtgagccagtgtgcctggcctcctaaggctcatttctataaataatacttccccagaacccaactctagaaagcgataatcatcccttaatgaattctcttttatatatattattgtgatggtcatattattgccccatatttgtcttgatgttttggatttcaaatggacaaggcatcccaccctttcttgcaatttagaggcatcgtcccttggcaagatacagaaagacttgctggtagaaatacgaatcaccatgccatttagaaagcaatctggaaatgtctattccaatctaaaaatctattcttttcttaatcaagtcatctcacgtcctgtaagcacagaaatgtttattacagtattatttgtcatagctacattcaataattcatgctacagtcaatcaaggaatagtacgcagtcatgaaaaaacaaaagagggatttcagcaatctatcactgttaaatgagaaaaagaaagatgcataaagggacatatgatatgatctgatttgtataaaaaacaatcacaacatatatttgtgactacaaaacatttggtaagattgtagaagcataaagtatggaaggacacagacaaggctgatgccactggcaatctagaagagaggaattagagtggaaggagggaagggaatgagaggaaaaaagtaaataagtgaaaaatgaaagcaagtgtccatgataagaaccgcatgggtgctcctatctcatttatgggaaatcatgtgtgtggaggtgacataaacacatggtggtgagatggtccccaaaatatcaatggcttttatttcagggtggtgagattttttttaataaggtgaaatgtttttaaaaataatttttactttattttccttataggtactattggaaatatgtacaaccacatgaattatttacataatcagaaaaaattcattgagagagaaatatgaaaagtcttatgccaggcaatgtatgtccccagaggaggtgcaagcagggagatgaggttgtaaagttaatttagaacctgactaggagggttctaagtgctaggcaaagacaggagcctatcaacatattaacaatagggctgtggttttgtttgtttgtttgtttttggtggtgggttatgagtgatttttttttcttctgtttgcttttctctattttccggatttttctgcaaaaattctatcttgcttttgtaaccagaacaaaaatattatgtaaaaaataacacagtggaagtggaagtggataatcatcaaagtgctgacccccagcaaaagaaatgaaaatccatttatgaatcagtaacgtcaaggtgagtcagtaaggaccccagataaagaagaaacagcgaacactgaaaggaacataggaggccttaaatgttttctaaaaaaaaaaaaaaaaagaatgagtgaaactttgcttaggaagaactgctaaggctcagtggccctctgtaaagtttacactgatgtctgcaaaaacacattcaaccaaatgtcaaagctggttgataggatccaaaaattacagagaactgtaattgctttagagactggcctatttttaccatcaagtctttaagtacagctacatcttggaacccatatcaaggaaaggtacaataccaagggaaaaggcaatagaagtgatagaaaccacagaagtggaagacactgtgctaagatgatgtaaagagccttcctctgcacaggagagacgtgcaccactgaaagcactgcctcaaagaaacactgggattttgcacaccaaaaaaagattccaatgtgattctggcttgattcgttttgcagtgcagtcaacataacaaatctacgatccatgttaggataaattaatttaaaagtttctattcaattgtggttttccttcttctaacagttggcacattctgagaactgccttttgttagacacattcagggggaggatggtggcatcacgttgaagaaggcggcagcaggaggcttccaaaagaacctcccagcttcaagattctctgactcgagatgagacgccatgccaaccaccagattttatgctttctctctctcagatgctccaactgaggtagtttagtaaataaactgtgtttatgttctctagcattcctgaagcagatgtaatataactgaaggcaaacaattttagtaatgcaattcatgcattgccatctaaacaccacgtcatcatgaaactgaaatgtttaccaaataatcaaagcccaagacaaagaaaccgaaaggcattctgtaaggcaaagtaccagccagtacttccaataaaataatttattgagagttatcctggagtggcttgtcagaaaaagtcaatgtgacttggtttctaatcactaaaaggactgtcttgctgttattcccaatggtcaggaaaaaaatgaggagaaactgggtttgttttcatagagtagtagggttttcctaacagagtttcaggataggctggtcagaaggtaagcaacgttctccttccaatgatccccaatagttcacccacatttcccaaaagcatcaaatcttgtcttgacaacctggcaagtgctgaccgccaaatgacaggcctcctccttatgatgttgtgaaataagagtgaccatcctttgagttcagtcccagcttttccactaactggccacgtgtctgtgggcaaatggctttatcagtgttgagcctcagtttccttaagtaaaatgctaaggttagacaaagtgatctttagaaaccttttgatctctggcaatccatgaccctttacaatcaattccaggttttgtttactacgttctaggtttaacacaaaattagacgttgagtgttcactttaagcaaaatggcaaacaataggttagtcctatgggttccttgtactacgaagatgtgaaattcccaagaaaatgtcacagagttgagttcagaaaaatagaagaatggaaaaaaggaaggaagggagggatagagggaaggatagaaagataggccccagaacatgcagaaactgcctccaaggtcagtcagcatccttctctttctctgcatcggtggtgtgttttcttccgtcttccttcttgccttcacaacttctactcccataattctcagtatggccttttcatcaacccaattctctttctttcttcaaatgtggctcaagctcatgtcttttctgtctgacaccagcaagttctgatcttctgttctttctgagtcccctcttggtgtgccacctaactaacatgaaaccagcagcaagtctattggtaggaacagcccaggaaaaatgcccaccagatctcctaaaaccctcaatgtctctccctactggggcacagcagagaggtagagagaagggaaaagctccttcttccctttcttttttttctttcgttccttccctttttctttcaatttaatgttcattgaatatctcctttatgcaaagcattgttcaaagttctttcacatactatttcatcttatctctccacaacctccctggaaatccagagtcttggccaatcaaattctgatcctctctgtgtctctccaccaccatccactcatccccctccactcatcccatccactcatcccatcctccactcatccccatcctccagtcatccccatcctccactcatcccattctccactcatccccatcctccactcctccccatcctccactcatctccatcctccactcatccccctctactcatccccatcctccactcatccccatctactcatccccctccactcatccccatccactctgtcccttgggattgtgtttggttgttctctccaccttggcccttccttcaatcaactgccaattctgaatctcatttctggctcctttttcttctcctgcctttatatctctcctgaacacctaagcctcttcttaactggtctccctgcaaccaggttctcattctaaagcatgagttggttgatatcactgcactcatccaacactttatgtgactccattttctatataacataacctgagttccatcatttgacattaaaggacttctaacttccccaaaccaacatcattaaatcttatcttctgaacataccaggctttttctgattctccaaatatggcttgcaattttactcttgcaggtttttgtttgtgctgttcctaccatgtggaacagccttctctcacctcagtcctagagaaaaatcttatttttcaaacctagctcaagtgctacctcattcctccaagtcaaaagtgattgtcctttctcctgaactttctaaattttagtggcttatggttctaaagttgcctctaggtcacaaagttctggagggcagggatcttctctatttttctttgcattccaacaccatgtatcaaccacagcagaactttttttttttttttttttttttgagacggattctcgctctgtcgcccagggtagaacacagtggcacaatctcagctcactgcaacctctgcctccctggttcaagcaattctcctgtctcagcctcctcacgcagcactttttaagcgtaagcagaaatgaagttgctaaccctgataattaatttaccagccaccattgtcttccaagtgtgcctccgaatttaaaatctacaagcattgatgagggcctactatgtacaaagcactctggcaggagatgcaagggcaagtgagctcaggaacaatgatgtttataatgagccattttaaagacctacctcacctcactatgctaggccaccaaatacaccattatcatgaacacataatccagtttggggatcatcaatccttcagaagccttccttcctcactgaatatactagcggtaaaatccgtatgtttcaaaatgcacccaagaaaagtaggctcagaactccagaaatcggggcctttatttccttccagaagacagagtggttgataaagaagaatgaaggcatttgttactcagcagtactaatcttcaaatctacaatctagtttaacttcagttataatgcgcatttggagccatggaagtagctgaaaaaacaagaatgtctggaaaaactaaaaattttattacctgtaaagttgggctcgtggatgaaaacttttgtaagggatgataattttttgtttgaaagactggtatcaagagcagctgtgcaaatagttctgacgagctcaaggtgatctagaacataagttgaccgtctgtcccagcatgttagggaaagtcccaatttatacctgttgtccctgcacaattattaccattgccccctttcactctgaaaactgtcccagcttgcatgaaaaattttacaaccactgtatcagtgctattgtcagacaccagtagtttctccatacaacatcggtggtttgcataggtctaccagggagcagagaaatggggcagaatccaggcttcctgacaccaaactcaggctctatctaaaagaacatatttcctctaggtttttcgtcatcaactcatccacaggaaaacactttggaaaatggtaaagatatataagccatggtttctgcaagctagcacttacaatcttggggagatgaagcacatacatattcaacaattaaagaggatcagatgaattcatcatatggtgctaatgacatggttcaaatgacaatttcaaaaggagctagaaaaggtgaaaaaccctctaagagcttcagacttcagggaaggtttccggtaggtgatggatcctgaaagatgtcttcaaggagaaaaaaaaaaaggcgtttttctttgaaaaaataaaggtagaaaaacaaacaaactggcacagcaataagccacttaaataattcaacaagcattactactctgtattcaagaagagaaaaacacaacagcaagtcaagacaaacacaaatggtatatgtggcttttccaaaatgtctcagtgacttaaggctcaacaagcattggatcttggtgtcttgataacctggcaagtgctgtcagatgttcctccttgtgatgctgtgagataaaagtgaccactctttgaggtcagtcccaccttttccactaactggccacgtgtctgtgggcaagtggttttatcagtgttgaggctcagtttccttaagtaaaatgctagggttggacaacggatctttaaatgccttttgatctctggcaacccatgaccctttacaaccaattccaggtttgtttagtatgttccaggtttaacacaaaattagatgtgagtgttcattttcagcaaaatggcaaacaacaggttaatcatatgggtcccttcccactacaaggatgtgaaattcccaagaaaatatcacagagttaagtttgggggaaaaaaagggaaaaaaggaaggaaaagggggatagaggaagggagagaaacagaggccccagaaataaagataaaattgaagccagagcttttatgtaaggctgactacacagtgctcaaggaagtttcagactctcgcaaatgctcccgaagccctgggaatagtggtgagattctaatgcccatgcagggacatgaccttggtcttgcatgaggtagcggggccagaactgagcccctttcctaaatctcaaagcctcaaaaagtcaccctaaccatgaaaaggtggactaaagcactctgcccactgcctcagagataaagagcagaacattcccttgtatccctagctcaggacacctttgggaaatcagaaccttaagcatgaaccactttcagttgtaagatcggaatttatactacctgtgtatctgagtaggggaatcccatgacaataaattaatacaaacacagttctaggatcattgaaagtccttagatctccagaaaagacaaacatatgtccactatgtagaaacgatttcacaactcaggactcacaagattcctatagaaaagaggccgggcatggcagcacatgcctgtaatcccagcacttttggaggctgaggcaggcagatcacttgaggtcaggagttcaaaactagcctggccaacaaggctaaatcccatttcaatacaaaaattagccaggcatactggcatatgcctgtagtctcagctactagggagactgaggcaggagtaatatctgaacttgggaggcagaggtttcagtgagccgagatcgcaccactgcactccagcctgggcaactaagtgagactccacctcaaaaaaaaaaaaaaagaaaaagaaaaaagaaagaaagaaagaaaaaagaaacaaagaaaaggaaaaatatctgaggttgaactgccagtatcaccccccaacacacacacaaataaactgccatgagggacagtgataaagggaaaaaaaaaactttaaatcctaagaactggaaagatacaatctcaaatggagtacaaaataagattgtttaaaaatattatagtgataaagactaaaagccataaggagaaaattaggattacatgaaaaaaagagaataagcagatttgaaaaaataaagtagaactcctagtaatcactcaatggaaaggttagacagtagagtaacacaaaacaggccatcagtgaaccggaagacagccttgagaaaattaaaccaaaatgtaacacaggacttccaagcaaaaatggagaattgaacacactgtatctaatatggctttcacctgaaacgtcactgtaacgagggaagatgaccttttaaaagacataaaaccaccaggacaataggagaggagattttaaataccttttgatctctggcaatccatgacccttttacaaccaattccaggattgtttagtatgttgtaggtttaacaagtaacaagattttagaaataacagtaataagattttagaagacggaaagcagatggagaagcagtgatagaattaacagacaaaggaagctgaatcctcagtgaggagcaggaaagttaggaacaaccagtggatcctccaaaggctcaggaacagatagcaccggtgacctctggaactgtgcggaagggagatgagtcactaaaataagaagaacagggcagggcgtggtggctcacgcctgtaatcccagcactttgggaggccaacgtgggcggatcacgaggtcaggagattgagaccatcctggctaacaggtgaaaccccgtctctactaaaaatagaaaaagttagccgggcgtggtggcgggcacctgtagtcccagctacttgggaggctgaggcaggagcatggtgtgaacccgggaggcggagcttgcagtgagccaagatggcgtcactgcactccagcctgggcgacagagcaagactccgtttcaaaaaaaaaaaataaataaagaagaatgtgagggaaactgtttaagaatcagttagatccctggatcctttccttgaatccaccctgctaggcagcagcctttatcacaactgctaatactggaggtttgaactctgggagaggattttggaattgggagatgccacacatcaaataaaaggaaatatgcatgctgaaggctgaaccctccagtctcattcctcatctcagctcccagcctgggacaggcagggcggcatcttgcagccaggagtctggaagagtgttctctggagaatctgaccattccctggttttcccattaggagactttaggagttgttagcattaggagttctccaacctatgacagaaacattttattctacagtgatgctcagagttgacaagtccctcacgcatcctcagagctttcaatacatctgttattcattcttaaatatggtcagacaatcaggactgcccgacatgcaaggaaagtctctacaggaaagacagagttcaaaacaaacagactgaaaaagacaacatggaggagacagagaccaggagaggcaaagacaatttctgaaaagaaaaaaaaatgcagaaaactaagagaatgacacacatcctgaaaacagaacagaatgcttaaaaaactatttatagatgaaaagaggaaacttaagacggtaacagaaatgaacccaatagatgggttggaaattgaagttaaagaaattgtacaaaaagagtgaaaaaagataaagagatggaaaacaggtgagaaaatatgaaaaaatcacaaaactgtccaggaagttcaactcccaaataatagaagttctggaaagaaagagcagcttacagagagaacacagtcttgacagattgaaagaccacaatgatcactgagtacaacaggtgaaaacagacccacaattagaacagtcatcgtgaaatttagaatatagggggacaggaaaaatcagaggttccaggggaaaagaaaaataaggtaaggcacagaacatcaagaatcagaacagtggcagctttctgatagcaacattgggagattgcgtgcaataaagcaatatcttcaaacttctggggaaaactgttttttaacctggattttcccgtacaagacagacaagtcatcatgtgacacaacagaatgaagacaatttcagacatgtgaagtgtgaatgtgtctctcagggatccattttccataggctactgtaagctgggagccacagaaatgagagagtgtaaagggagttttatgagaactaacacaggaccacaacagagggatgacggcactgaagtgagataccccaggatgatgactggctcagccacaggaccagtcatccagacagggccagcagaccaagagcaaggcatatgaaggctgttaccactgcaccaggttttaattctgatagctgctggaggctgtgcttcctcaaacaatggggtaaaacaagagagagaatccaacacagaagaaaaggcaaagggaagttctagaataacagtgaagacaaatctcaggatgtcagctatctagcaggccgagagagaagtctagctagaaggaaaatgtaggtctccagcagagatatcaccaagaaaagaaggagaactgacagattactaatgtgatcagctttgtggaaaaaggtactgtgagcctatggaagatagaggaaaagtctgtaccaggtacaaagatcaattaaggacatgaaaaaaagacagatattaacttcattgttaaaggtttagctgttaatgccatttattttgacaaaatagtgaaaacactaggggctgatttacccccaaattgtaatataactacactgggagaaagaggggagaggaagctgtggatatgatcatatcagacaggtaaatttttatctactataatataaggttaagatatacataaaattgatgaaacaaaagataacagtatatacattatttagaaatgcagagacatatatatgctagaagaaaaagctaaaatatacaaagttatattctttgagaatagggactggggtaagtaaagtggcattgaattggcttccacagaaattaaggaaccagcacataagtaaatatgcacaaggatgtttatggccacaatgtttgtggtgatgaagcaggattatttccctgaacgcttcatgggtgggaactggagtgcatgggcgctggaacttgccagccactctggcactggcaggggtgaactccactcatgaagacatgctgcactccacccctcacggaggtggagcacgcaggtgagtagatgcaggagccaggtgagtgctttttgggtgctggaaggagcgaattccataccagccccacagcagcgtctggagcagtgcctgcaacccctgaagcccaagaggacaggttacagtactcttttagctctgccatccatggacgccttaagtgctaacagctcagtgggggcggtcagtgtgacacagcattttacacctgcattgtggcacccaagttcttgtccggcgtccaggagaaatgaggtcgcacaaacaaactgaagatggtaaatacagaggattttactgccaatgaaagtggctttcagtaggaaggggagctgaaaaggggacggggatggaaggtaatcttcccctgaagtccagccatccctggccaaactcctgtctgaagctacaccgtcaaactgtccctctgaactcaagccacttctctccaacgtccaactgtagtcttcaacatccagctgcttctcttctctctgccagtggagccagggattttttatgggctcaggatgggaggcagggcaggccatgggtggttttggaaaaggcaacattcgagtgggaaaacagggatgtaaattctccctttggaccatggtatcaggcttttcagcttgagggtggggccctcactgggacccaccctcttctgcccagaatttccctgtctcctgtccctatcagtgacataaaactgaaaacaatctgaatgctcattaatagggagaaggttgaataaactataatatagccataacatggaattttacttagctatttttaaaaatgaattaaatttgtatccatttatctggagattatccttcatgtactatcaagagagaaaaacaagttgtgaaaaaatacatgctgtatgattggattttttttgcaaacaacagtaacaaaacacccttatttaagatatatatgaatatatatgtgcatgtgtttataggagcttggagaaacatgtagaagaatgcataccaagtgttaacattggttaccttggagggacaggaataaaaaaggtagggagatgttaaagaaaaaaatagaacacaaaaaagagagacatgagaaatctgaaaaacacattcagagacatgaaaaagagaataacaaggtccaatatacatataaaagaggactcagatagataaatagaggactgaggagagaaaatattcagagactaggacaaaatttttcagaatcggtgaatgtcaggaattcttagtcttgaatcccaagcaggattgtggtgaaaccgcagatcaccaaagataaaaacaaaaaaaaattttaaagcaatatgagagagagagagagaaccctctaaataaatgacagcctgaagcagactacaccttatcaattacacaaatcaaaaggtaatgaaataatatactcaaatgctgagggaagatatctatgtaaaattctatacctagaaaaattattattcaagaccaagagtgaattaaagatactttcagtcagagactgagatgctttaatattcccaaatccttaatgaaatagctattcaaggatgtacttcagtaagaaggaatttgaactgggactacaggtgcatgccatgcctggctaattttttgtatttttggtagagacgtggtttcaccgtattgcccaggctagtctcaaaactcctggactcaagcaatctgcctgcctcagcctctcaaagtgctgggattacaggtgttagccaccacgcccagctctcaaatataatttttaatgtttgagggtaacaactgtcaaaacaataggacaaaatgtatacattacaaatcagtggaaaacagtgtaagaaaaagtcaagtaatttaatgtgaggcagaataagaagaaaaaacaagtaaagaagtagcatggtatatagaaaacattcaggctcctagtgaattccaaatatatgagtaatcataataaatataaatgactttaacctgttagaagacagaaaacctcagattggattttttaaaactccagctctttacaagaaagaagcctaaaacacaaggattaacataaaggaagagaaagcaataccatagggaaatgctcacaagaacttggtatagtcattagacaaatcagcttgggctgtcataccaaaatgccacagaccaggtgtcttaaacagcagaagtttacttctcacagttctggaggctggtaagtccaaaatcaaggtgctggctgatttcatttctggtgaggcctctctttttggcctacagatggccgccttcttgctgtgtcctcacatggtctttcctcaggtgtacatacagaaagaaaaatctcttccttctttttcttaaaagatcactaatgccattgtgagggccctgctgttctgacctaatgacatgggaagagaacactccacccaataagcatggaatacacagtagagaatgtaactttaattacttcccaaaggcctcatctccaaatattatcacattagaggttggagcttctgcgtatgaattttggtgggacacaaacattcagtttatataagcaatataaacatcaggtggctccttcaggcctctgctcaagtgtcaactaatccaagagctgcccacgactacatgatatagaacagcataactttataccccccagcataactttatctacctcaccttgccttatttttctttatagcactataccacctgacaaattatatattttgtttgtttattatctgtgatctccaaataaaatataagatctctcagatccaagagagtagggactttctcatttgttcactactgtatctccagtgtttaggacattccttaaaaacaataaatgttcaataaatgtttattttaattgaatcagtgaatgaataaatgaacggatctgataaaacagactttacagccaaaagcaatttttttttttttttgagacagaatcttgttctgccgcccagctggagtgcagtggcatgatctccgcttactgcaacctccgcctcccgggctcaagtaattcttgtgcctcagcctctcgagtagctgggactacaggcatgtgccaccaggctcaactggttttttgtatttttagtggagataaggtttcgccatgttggcgaggatggtctctaactcctgaccttgagtgatctgcccgcctctgcctcccaaagtgctgggattacaggcatgagccaccacgcccggcctacagccaaaagcattttgagggataaagaggatcacttgttaatatgaagatatattcaccagaatccttttgtatgcctcatgacgcagtgtcaaatatttacagcaaaaattgaattaactacaagaaagtaacaattcaaaattatagtgggagattttatttatttatttatttatattttattttttatgtctctattgaacttaatacattaaaaatagaagaaaatcattttacatgtattcaatttattattttaaaaattgaggtattcaatgaaaatgtcaaaaatatgcaagaaaatagaatacaggaaagtggtatttaggtggtgtgattgtgtgcctttgcatttagaatgaagtcctctgttattaactgatatatttgagtatttgtccccccgaatctcatattgaaatataatccccaatgctgaaggaggaggtgactggatcatgggtctggatttctcatgaatggtttagcactatccccttggtgtcttctttgtgatagtgagttctcatgacatctagttgtttcaaagtgtttggcaccttccccgtctcctctctcttactccttctctggctatgtgatgtgcctgcacccatttcaccttctgctacgagtaaaagctccctgtggctttcctagaagctgagcagattctggcaccatgactgtacagcctgcagaaccgtaagtcaattaaacctcttttgtttataaattacccagtctccggtgttcctctatggcaatgcaagaatttcttggcctactcctgttcagctaaaatgtcacatccatgaggatcttctttatcctcctgcaaggatgggtgccttggatatgctgtttcatttaccacatttgtgattccttaacacacatgatctgccagaagcatatagtgggagatttttagtacacatctctatgaaattgacagctcaagttttttttttaaaaaagggaaaagatttaatattgaaataaggcattatacaagcttcagctaatgacatgggaagagaattctctacccaataaatagagaatgcacatgaaatgttcataaaaattgaacaggttccaggccacagaacaaataacaaatttcaaagaactgttatcatacagaccacattcttcaaccaaaatacaataaaaaaattgagatagataaaaccacaatccctaaacccaagtacattttgaaatttcagaagcacactgctaaattattaatatgaaatcaaaatgaaagtaaaacatatttaggactgaacaactgaagccctaaatttcagttgaagaaaatgtttagcattgaatttaatattagtaaacaagaaaaattttaagaaagttagagaaagggcaacaatgtaaactcaaaaacaatagaagaaaatcctttttccacacatggttaaagtagcaggaaggcaataataaagacaacaaatcaatagaatcaaaacagaaacaatagagaatagaaacaaaatagaggctgattctttaaaaagactaataaaataggtaaatatttgacaagattgagcaaggaaaaagaaagagcacaaataaacactattaggcataaaatgggtcataactaaatagagtaaagattttaaagcatgagaattcttttctgtattttaaagcaataaatctaaaaacagataaaatggaaaaccttttagaaaaatatgttaccaaagttgacacataaaaatatggaaaaagaacaaagaatcctgaatgtatttttatgagttcagtctaaacctacattgtagaaaaacactaagacaatacaaaaaaaggcaagtattggtcaatctcagttaaagtatcaatgcaaaaaatctgaaaaaaaaaattagcaaaaattccagcagtatagtgtgtgcacaaatatatagtatttctttaatatacatatttgagattatatctatcaaaatatcatgtttatcacacaataaatatacggaatgtgtgtgagatgacccagtaggttttatcccagaagctcaagtaagagtcaacattagaaaatcttaatgtaattccccacattggcaaattaggaaggaaaaaccatataatcatctcaatagatgcagaaaaatcatttaacaaatttaacccccattcacaatttaaaaataaaataaaatacctagccaacagaaacagaaggaagtttctcctaagaacctacaagaaactttaggaacatttcctttaaaatcagcaactagataaatatgtcttctctctcaccactctattcattattgtatgagataccttgctgatgtaataaagcaagaaaaaggagtaagaaaatcagaattagaaatgaagggggaatatgtggcattatttgcaaatgataagattgtctacatagataatccatgagaaactatgaacaattacaagaaataagagggtttggcagggacgctggagacaagattaatatacaaacatccatggcatcagtaacaaccaattagaaaatgtaattttcataagatgtcattagcaatagagatcttacacctgtgaggtacctaggaataaatctaaagaaagaggtgcaaggcctatatggaaaaaaaaattataaaacttcattgaaactcataagacctaaataaacagagatatatctcatgctcaggagtgagaagattccacaatttcaacatcaaatcccctaaaattaatacataaattgaatgaaattcatataaaaatcccagaaaggttttcttcatggatatttgtaaccggttttaaaattgtggtccaaaagcagccaagataactttgaaaaagaataatatggggacttgtcctaccagatatcaagacatatacaatatacttaattatgccataaaattaagacactatagtattggtgtaaatatagataactagactaacgcaatagagagagccccacacatgtgggaatttggtatgtgacagagatagcattacaaactatggggaaaacaaaaactaaactaataggtggttcgcagacaactgttacccatatggagaaaaaaaatagatcactaactcacactatatccaaaaatgaattccaagagaattacagttaactttaaaacatttaggaaaaaatgttttttagacactatttttatggtcttaagtgagggactgacaaaaaaaaatacaaaccataaagtaaaaaagaagaagaaggaaagaagataaaattgagaaatttgatgttaaacattctgtgatgaaggatgccaaaaaacaatgtttaaaggcaataaatagccttggagagagaaaatttctgtaagtattcataatatttagtgaacacttagtactctataaggaaaaaacaacccactacaaaaaagtgagcaaagtctagagtcaggtaatacaaagagaaagaaaaaaatcccaaatgatgaaaaaccgtaggaaaaaccaacactaaacacataacctcataagtaatcagagaaatacaaatcaagacaattaaataccttttcaatacatcagattagcaaattttaaaagcccaacaatgtcaagagtgggagaagatgcagaataataagaattgtacacattgttgctgaaagcaaactgagagcaatttggcaacgcctaccaacctttatgatgtttgtaccccaagacccagtaattccacttcttctgtatctttgaaaagttcaacaaatccacatggaaacaagtccagagaaggtcacaatagaactgtttataaaatgacaacctggaaacatcagttagggagtggatatattatgatatatttatagaaagaaattggtttatgtctgagtcttttcaggttgctataacacaaataccatagactgggtgacttatgtaacatttatctttcagttctgaaggatggaatcccagatcaaggagccagcagatgtggtggtgtggacccacttcctggttcatagaggaccttcccactgtgccctcatacagtgaaggggtaagagagctccgtggggtctcttttagaagggcactaaacccactcatgagggctctacccttgtgacctaatcacctccaaaatcctgcctcctaatagcatcgtatttgggattaggatttcagcatatgaattttgcagggaaagaaacattcagtttataacaatataacagttaaaggaattagctctacatacattaattaggataaatctcagaaacataacttcaagtgataaagcaagttccagaaagatggattattgataacattaccattcgttttttaaacttgcaaaatgatactagttattgtttatgacagtggtccccaacctttctggcactggtttaatagaagacagtttttccatagacgggggtgggggatggtttcaggatgactcaagcacattacatttatcattagattctcataaggagcgagcaaccaagatccctcgggtgcacagttcacaatagggttgcgctcctatgagaatctaatgccgtggctgatctgacaggaggtggggctcaggtggtcatgctggctctcctgcagctcaccttctgcggtgctgccaggttcctaacaggccacggacctgtaccggtccatggcctgggggctggggacccctggcttatgacacataatcacatagcaaaatgcaacaggtatgtaacagtgcaacttctaaagagtgtttactgctgggaaagctgtggaagaatgctgtcagtttggggtcacaaaagaggcttaaactacaacattttctgttaaaaaatatttttaaaatgtggctaatgtcaatatttattaaatctgagttggggtacctgattgtttgctatattattctctgtaaattttgtattttaaatattaaatagttcataatttttaaagttactgtttaaaagggtatacatgatctttttctgcacatttccccaacattttctttttcttttaaaatttaattttattttattttaagcactgggatacatttgtaggatgtgcaggttagttacataggtaaacgtgtgccatggtggtttgctgcacctatcaacccatcacctaggtattaagctccgtatgcattagctatttattctgatgctctccctcctcctgccccctccaataggccccagtgtgtgttgtctccctccctgcatcaatgtgttttcattgttcagctcccacttataagtgagaacatgcagtatttggttttctgttcccgtgttagtttgctgaggataatggcttccagttccatccatgtccctgcaaaggacatgatctcattcctttttatggctgcgtagtattccatggtgtatatgtatcacatttcctttatctagtctatcaccgatcatttccccaacatttcaatctaggtatacagttgtgttggcagtctgggacctgaggaacagtccttgttccaacactaccacgctgagtgactctgagcaaatcagtgaacctctctgggccttatctgtgtgctcatctgtaaaatggggatactcatagtagttatgacttagaggcagtggttaagcgcatgggctctggaattcgatctggacttgatcctcagctctgctacttaccagctgtgagaccttagtcaatttacttaaactctctaagatgtactatcctcatctaaaaatgcaaacagagatagcatctagctcacagatctcttatgagaataaaacaaaaggaataatgaaaatctcttagcagaccatcatcaacaaaataaaattacaaaaccaagagaagatatttgctgtgcatataatggacaagggagtggtgtcaagcatacattacatactccaataagccaataaagaaacaacgaaccaatagaaaaacgggccaaggaaagaaagagataactcatggaggaaatcctgactactcggtatgcaaatgaaaatatgctcaacctcactggtaatcaggaaattgcaactgaaacctgaaacaactatcagattggcaaaggaaaaaaatttttaaatatgactctaacaagtattgaagagaatactgagcattaggaattctcagaccctgctgctgagaaggggcttgcactttggagagcaatttggcaacatccagggaagacgatgtgctaattcatcactttgctactggctacatatccaagagaaactaccaggcatggtgtgcaaagaacatatcaaaaagctagacacacctgtagcattcttccaaaggacatcttaaaattagaaataacttccatgtcctccatctgataactacaacacagcatggaaaatgtatagaggtccatgttttgcaacggacaaatcttacaaatacaatgtagaacacaaactccatgatatcctttatataaagtttaaatacatttaaaaatatatatatatagtttaaggatacacacatgtgaaagataaaaccatgcatggttataatgagcattgagcatcacatttaaactgatgactgtgacgttcagggaaggaaaaagcgggtggaaatggggaaagtctatctcttttttacaaaaaagaacaaggacatgacaaaatagtggtgaatgcacatttatacacaatcttattctctgcattttctgtttgctcgagatctttcacaataaaaaaatactgtgtgatgctcaatgctcattatcaccatgcatggttttatctttcacatgtgtgtatccttaaactatatatatatatttttaaatgtatttaaactttatataaaggatatcatggagtttgtgttctacatttataagatgatatgatttggctgtgtctccacccaaatctcaccttgaattgtagctcccataatccccacgtatcatgggaggcacctggtgggaggcaactgaatcatggaggtgggtttttcccaagttctcgtatattgaataagtctcacaagatctgatggttttataaatgggagttcccctgcacatggctctcttgcctgccctcatgtaagacgtgcctttgctcctccttcaccttccacagattgtgaggcctccccagccatgtggaactgtgagtccattaaaactttttctttacaaattacccagtctcgggtatttcttcatagcagtatgaaaacagactaatacataacctgtcaataaatatttgtttttaggagccccctaaagtaggtaggagagtgttaatatgatcatttgacagataatagaggtgcgggacaaaaagctgacagagtgggctcgtggtctattgtcccataatgtcaacgccctacccttgacattatgatgttcattccactcatttagtaatttacttaatacagggaactggaacttgacgcaacttagggcaggcgggtgaagaagacaacctcttcctttctggaacaaaccacagtttgaggaacacaatgacagaactcgataaaaagggaagaaaccagactgctccagtcatctgacggctcttcaatgaatctgtaattcactcacggagggcctgaccattcactgcgcatctgccgaagaggaggaaggggccggaggaagtgagatcgatggcctccgttccagcatgatttcgcctttccagcaccctatctaaattaagaacagggcactgcgctgcgtttaggggcattagctctgagatcttgtccgggacaggtcccttttctgctctgggctcttcttgtttaaaattgaggagtagactaccatctcgaggccagtgaaattctagactcttcattctgtttttcaggattttttcttttcttttcttttaaaatctgaaacgggagcttccgcatttattatttgcacgtggttttgaggcgcactcctggccacatcacagctatgttctcttgcctctgggaaatacataaaatgcctagcaacagttcctggtggcggctggtccccataaacgccgctggtcggcccccaccccacctctataccacgacccctctcccagcccggggactgtggtatggaggccgagagaggcccattttaaggaagaagcaagacatatgcaccatcccatccaaggagtaaacaggcgggggggaggtgggcgtggcctcgatcaatcacctcccctgaagctgcaccacatgcacattttaggctggaaataagaaagaatttcctggctgtaggaattgttaaataatagggcggatgaccaagggaggttccggaatctcctcttgagatctttaaaaatgcgatacaagatcgcatgtctgagatgatttcttgcagtcctggctagagacagacggactaggtgccttaacgggcctgaccctcctcccaaggcatatgattctgtcttttgctttctcttacccttagcaatatcctcagtgcctcctttatatgttcatccccctggtgaagctcacttactgccatccctcaggctagttttcacccaatccctagcctcctcacacctttccttgttattttatggaaagctggtcaaaggtcagagttgcccaactccccacacatagtttggtggtagcatctgatacccagacaaaacacggcaaggattccaataccagcatattgaagcttaaacaccaaatctggatggaaacagagaattagctgttgctaacaacccattgtaaatgaaaatatgatcttggtaattgattttaaatagttttttttaaaagaacccttggccgcatttcatcaagaatacagagtttcaaaagcgttcattccagggttggattttttttttttcctctttcttctggcttaaaccccaaatggccaagatcccagtctgaataaacaatgtgggtggtgacttttctgtgaggcccagtagaggatgcaatcactttcttattcggttcaacattaaatcatgtgaaactagcctgattactccacacaacttttactccgtaatggagggcaacacaacatgtattctttctctgcttctcagggagaaagaaatgaattctcctaactgggagtgtttaattatgtataaagttcgttgacctcacaggcggctgtcagatgatcttgctaaggcctgtgaacggcatcccaggaatgcagtgatgtgggcagaaaccgagtgagttcatgccaccgaatgctttaaatgggaccgaatcagcagccgtccagaaagactccagcgaaaacagaacttttggataatcagtaatttaatctcacctaagcattttgaggccttcaaaagtgattgttataaatcagaaactcaggaaaaatcccataggcatggggcccataacaacggggtgaagtaattttgtttgctggttattgccacagctggttggaaatgtatgtatttgcaatgttctgtccccgttttagaggtaatgctttctgacttccctgctactgacattaaaagaaaatgatgaagcaatcccattcataaatacatggtggggcctgaaggagtgtgcagagtctatgtttatttacagttttgatataatgcagcctccacatgtgtatgcagtaactatacctacttgtcagtaaatgccttgaaatgtgttcttcctacgcagagggctgggttctcctctttgggctcagggagcggaagggtaccagcaagatgagcgtatggattgtgtgttctcttttgtctctacctggagcatccccatctgtctattgtgaaaggaccaggaaacgctgggagacgggctggcatgtgcttcttggtaacgagagagcagagcccctggagagctgtgggatggctaactgcgggagccctgctactccgggtaggggagaggcgggggcctgtgaaataggtgggcttggtgcttcctataacatttaaattacctgattgggggtccaatattatgttccttcagtagctttctcaccaaacacacattttatccatccaaatattatgctttcggctggtaaaacttcacaggattatattctaaaacaaaactctgctgcattcatgctggtacctttattgttatgagtataaagaaagggaggctggaatttagccaataactttgacaccctgctggaagcaaaatggaaggggcctcccctgagcatctcttagactaacctaaaagtcttgaatctttttccaaatcaatcacctaggttttgagtgcacaatgtctgtctgcatccaattcgagttaattcaatagatatttggaaaacacaaataatggacaaggcaattctggtgacacaaaaatcaggccaggcgcagtgactcacacctgtaatcacagccctttgggaggccaagatgagcggatcacctgaggtcaggagtttgagaccagcctggccaacatggtgaaaccccgtctctacaaaaataaaaaattagccgggcatggcaatgcatgcctgtaatcccagctacttgggaggctaaggcaggagaattgcttgaacccgagaggtggaggttgcagtgagctgagatcgcgccactgcactccagcctgggagacagagagagactctgtctcaaaaaaaaaaaaaaatcagaactctttatcaggtcacattaatcccaactgggaggatttgggtagttttcatgcatggaatcttcccagggttgggggctgaacccttaaaggggttcaataggccaaagggaaatgggaacttaccaaaatctcagttcacactcgcatgcattgtggagaagagagagatgtaattgtcactgagtcctgctattccatggttagggttctataattttatcttgattttttgtttgtttgttttaagacagggtctcgctgtgtctcccaggctggagtgcagtggcataaacttggctcactacaatctctccctcctgggctcaagcaatcctcccacctcagactcccaagtagctgggactacagacgtgccaccacgtttggttaatttttgtatttcttggtagagacggggtcttgccaccttgcccaggctggtcttgaactcctgggctcaagtgatccatccaccttggcctcccaaagtgctgggattaccgctgtgagccactgcacccagcctatcttgtttttatagtccacttgatatttgagggtttccccacagaagcctttctttaagacccatagcatttaatattacactgtgaagtgaacaatcagcaaaaaagaaaaggaattccttctgtcttcccaccctgataaaggaagccttccttcaaatgttcaaaaattttctataaatatgatcatccccatagttacaggggaaatatgcttctagataaaggaatctggacacaaagtaatattctaaatcacttccactcttttggatactacaatttataaaattccatgaaggaaattagcctgatttctcatgaagttccctattgggaaatcactgtgtgccacagttatggaagcaatatctttgtgcatttcccaattccctgcctttgtcggaggctctcatcatctctaaactaccacagcaatttagctatttcttgtctgtagtacgtgctgcattctgcctggtcagaggtaaagatgaatacatgacttgtctctgttatttgagtacataacttgtctctgttacattataagctcttggaaattagagactgatgtacttatctttacattccccagcgtcattaacagggttggtgtccactgaaagaatgaacaaacgagtcagtaaataaataccatgaaaatatctatagcatgggttggaaaacatttccagtgaaaaaccagatagcaaatatcttaagccatatggtctctatcataattactcaactctgatgttgcagtgtgaaagcagacatagacaatacatagcaaatgggcatagctatgttccaataaaactttatttacaaaagcacgtggtgagcaagatttggcccacaggccatagctttctaactcccggtctttggtggttatccttgctgtaaacctcagtatattctttacgcttttacatagcgcttgttattttcaataatgagacaaagtgcagaaaacataaatgttaaagggttgttttggaactctatagcaataaattcacttaaaaaccaatcacaaagcacatatggaaattagctgacccaccaagcatatttcatggtcacctattttgtatattgtattcctttaaagcgaaaaattcttatcccaagaaataagggtagtagttttgccatttacgtcatcatgactgagataacttgatatgataagatctcagagttactgagtgaaaggtctggtgctaggtcatgctgaacttgacactctcctgggaaaggggaagaaatgctcccccatcctgctgtccagcagatcatctggtctctaattttactgctaaaatccttcccgaggttattaatgcagaagatactcctttttcttgataaccctctggaaaatatccagctagaaagagcacaatagaatctcacaagttcagcaaacacacagaaaagtcaagagtaactacgagaatctgatgaaaacaagatgtcccggcctgccaccctggcctgatttgagagtgcctcacccgtcattactcttgtctcgctatcaggtcacctttcgtaaaaaatacaactttgaaaaggagttggatttgaattgtggccgacactaataggatgcaaagtcctaggtcaattgcttggtttggaacaaattcaactagtcctttccaaggtatgaggaaatatacaacaaacaatgtaccaatgagcaccccggctgacattttgtgagatgggtgactccaaggtgtagatcttcaaactgcgtcagctatccacaggttgtgatgaaacagttctacagatttcttctaagaaggaaaaaaaaatgaaatttgagtctttccattatgccaagcttctcctcaacaccagaccaagtaatgggatgaattctgtgccttaagaatatgagaaaacagaggcttggaaatggaaggtgccatgaggcagtcaaaagacctgagatcacatctaccacattcaacccatgtgacatgaggcagattatctgacttcaatgtcacttgatgtcctaattttcaatgcagggctgggaagcacacattattgaggagaaatcagggaacacatgatatagagcccaatttatttcaacaaaccctgagaccccattgtgtgccagtgttggagagtgcaaaacggctgtcagggattctgagtatagcgtaggtgagcattccatggggagagcatcacatattgctttatttgcaacactccagtgcccaactatcctgagttcctctcttctgtttattgaatttcctcccctgccagttcaccacaatcccttattaccagtctctcctcattaaaacatcccccctcacccctgccacaaaacaaggagggcattctcaccgttctccagaacagggctgtagcaaacaacttcacgtatgtgaagtggtatgatttataccagcttaattgatattagataaaatttcaaattgctgaaaatgcatgtggcaatgcacataggaatcttactgcaatctgggtttggggtaagatgtataaaaataaagacaagagtttgaaagagggatcaggtggagaagacaatgaaagggaacggagaggcgctggaatattgtgaaatgccccaaaaagttgtttacagtaatttaggacaaattcctacacctcagttacggtcgtcttcaagtaacatggattgggtaaggtatgttcttcaaggcgaaaatcactgaatatgaagtgcaaattcatcagcatctgcactactcacaatagcaaagacacagaaacaacctcaatgcccatcagtgatagactggataaagaaaatttggtacatatacaccatggaatgaatacttactatacagccataaaaaagaattagatcatgtcttttgcaggaacatggatggagctggaggccattatcctaagtaaactaacatcaggaacagaaaaccaaatactgcatgttcttacttattagtgggagctaactgatgagaacacatggacatatacaggggaacaacacacactaggacctatcagaggatgaagggtgggaggagggagaggatcaggaaaaataactaatgagtactgggcttaaaacctgggtgacaaaataatctgtacaacaaagccccatgacacaagtttatctgtgtaacaaacctgcacatgtaccgctgaacttaaaataaaagttaaatttaaaaataaaaattaacattaaaaaattcaccagcatcccactgtgaagtctgtgcagggaggaggggtaatgtcccagggtgagggctgaaactctttgctcataattctctcctgctcccactccgggaaatcgagcatgggaatctatggagaacacctgatctccatttcctttaaaatagcctcttaggctgtgtttacagaacacaaaccaatggctcaagagaaaaaatatgaataagtcaagggactaatatgacaaattttcaattcaatctaatatcgagatagatgctcctaatgtcttctgaggcttcatgagaacattatctgctcctctcttctggctttcaacttcattattactgaaaacttctacttgaaatacaaaatattggaagagtcactctcaagatttctagaagtttcgcggccgggtgcagtggctcacgcctgtaatcccagcactttgggagaccacagcaggtggatcacttgaggtcaggagttcgagaccagcctgtccaacatagtgagacctcgtctctattaaaaatacaaaaattaggcccggcacagtggctcatgcttgtaatcccagcattttgcgaggccgaggtgggtagattgtgaggtcaggaattcaagactggcctggccaagatggtgaaaccctgtctctaccaaaaatacaaaaattagctgggcgtggtggcaggcacctgtaatcccagctactcgggaggctgaggcaggagaatcacttgaacctgggaggcggaggttgcagtgagccgagatcgcgccactgcactccagcttgggcgacagagcaagactctgtctcaaaaacaacaacaacaacaacaaatacaaaaattagccaggcatggtgacgggtgcctgtaattcctgctactcaggaggctgaggcaggagaatcacttgaatctaggaggcggaggttacagtgagccaagatcgcaccgctgcactccagcctgggtgacagagcaagactgtctttaaaaaaaaagatttccagaagtttcgtttggcagagtaaatggactccccttatcagtatgtctagaataatccaggtaaaatgttgctgcaaccaactgttctaaagttaacttctctggcgtgctacttcagcattgagaaacaggaccagatgagttcatttcatccgtcctaggcagtattctgggcagagcaaacagaaaatctcaaggaaagaaagaaactttcagagcccgctttgggcctctgtggattccttttttaagcgttacaagattggtcctagaccacagatgcaacttttggatgtcagatccaccagacagatgttttcccttaaagctgttgtctctctctcaatctgtttatagcgtgtttccatttcagcctgcaccttccttaagttctcactgctaactgcacgtcctaaaggtttcttgcctccacacacaaaaggctatttttctatcatgtgttctgttttccataaggaatgcacccactcttcgggtgacctgttaacccattactggtgtgtctgcttcctgggtcatcttcgagaaatgtgccaaacgctccatatatatattattaatcccccaagttgtgtggtgccagaaagagttttcttcttagaaataaactactcaggccacatgactggtattagcttcttaaaccaattgagcatcaactgatggactctcataatgtggtcagggttacttattcaaacctgtgttttttggttctgagcttgtagatggtcttcatataagtcagaccaaggaactccatttctatatcaattaagcagattctcagtgccaatacatttcaaccaatagatttcaaagactcatccaccttctctcactgtagatttttccagaatatgattcagactaaaagcaggacagcatctgctgccatttctcatacataaaagtacagggagacaagggagtttcttggtagggatggaataaccctgtgtcctgatggcggtggtggttacaggaatctagacatggggtgagatacacacacacatacaaatcagtgcacataaaccatggtgaaatctgtttaaggcctaatactaacgtcagtttcctggtattgataatgtgatgctatatacatgataccatttactattgttatgcaagacgttaccattcaagaagcaggatgaagagtacatgggccctctctgtactatttttgcaacttcccacaagtctataattattgcaaaataaaactttttaaagttctatgagaaagttactgcctataaggcagtagcttgcccaacttagcccgattgaatttgaagctctaaactgcttctttcttctactcacagtatttttaagtattttccacaactttcctctaagaaatggagtctactgactttctaatctgtgaaaggtatcctttgtcaatatgagagctctagagagtgggtggggtgggatcaataggtttttgaaaagttcacactgggttcaccagcatcctgcattacaacgagcattctaacaaaacagcatctttcagctgttttgtggatgttcccaatgacctagaggtttaaagaggcatcaggtcatagtcccaagtggcaaacatatacatgaggtcattcagtgggagaggagtccgtttgttcttccttctgtctccaagtttttcctcaggacttctcagggctggctcctcatctcacaggcctcaagccaaagaaacaggtcctgtgaaactcatatttaaactagccttccccctgtattagtccgtgttcacgctgctggtaaagatatacccaagactgtgtaatttataaagaaaattataaatcacaatcatggtggaaggcgaaagacatggcggcaaacaagagaaaataacagaacttgtgcaggcaaactcccctttataaaaccaccaggtctcatgagacttattcattatcacaacagcacaggaaagacccgcccccatgattcaattacatcctacccgctccctcccatgacatgtgggaattgtgggagctacgatccaagatgaaatttgggtggggacacagccaaaccatatcaccatcctccccagttacaccctacgttatccattttgttgtctgccacgttcttatttttcggttttacttattgcccatgtggcaccatgagaattgtgtccctttgctcacactgtgtccccagcacctaggacagtgtgttatttgttgactgaaagactgaagaaatgaatgaaacattcctaaagccatggcccattcttagacaatggtgattgtcaaacatgcagatcattattaaatagcctcaattaatgatcatctaggttagtttatgtaggtaatgatcatttttatgtttggctacgagaataaacaagacaaatttgagtgatgtcttcaacactagcagctgagctcaagtgctatggggaatcccaatgaaaagccatgattcctattgaattttctgaccgggctagaaagagatcagtaggcaggtagatagatggggagataggaatgaacatatactcaagtacacatacacacgcacattttctcatctttgaagatgcaacaggattttttttttttttttgagacgaagttttattctgttgctcaggctggagtgcaatgatgcaatctcggctcactgcaacctccccctcccaagttcaagcaattctcctgcctaagcctcccgagtagctgggattataggcgcccgccaccacccccagctaattttgtatttttagtagagatggggttttgccatgttgaccaggctggtcttgaactcctgatctcaggtgatctgcccaccttgacctcccaaagtgctggcattacaagtgtgagccaccgcgcccggccacaataggatcttggtacttcctttatccttgcaagtcaacctgcaaagaatggaaatcttctactaggggaagaaccagaaaaacatcagggagataggttttctgggcataggtaggcagagcactagggagaaggagttccctgttgcggctggtggagagcgtcctgaatggtgtcatcacctccactgtctggactcacaaggtcatgagaggtcaggagtgagggatgccctgtcaccaagccaccattccagtgccaagctggcctccccatcacgtcacatcaatgtttaaaagaggagaggcttcagataatctaccatgcccaagatgtcgtaagaaaacttagagggttatgtttatagacatagtgaaatatatttttttaattactaaccttacatgcatctgctttagcaaggaaaaaaaaattcccccaaaagactccttcaaaatcatgggaataagaaacaaagaggccaatgaccccataactttaaaagcatacatggtgccaagcagcccaaaagttagccttctgataccagagtcagcatgtgctgactgactccccttcatttcacgcttctcttaaaagaaaacaggctggattgtttcagtaaataacaaaaggtcagagaaacgctactcacaacatgagcaaaataactgctcaatctgccaaaatgtttccaaaggcctaacaggcagaaaaatccagtggtgaaataatccacggatctgaccggtgagaaaaggtccttcccagtaaaatctgccatcaggcctctggctcatctttcatcaatgagaaataaaaacaaactacgtcgtcaggttctgccaacattgagatgccatgtccttcacagtaaagcaaggttgtctactacatagtttttagacttctcgccttagattatattttgactttaaggccaagtgtagaaatggtggtcaaataactatgtactcaaaaacgaagtccaaagagtccattttgtaaaatcttctcctgaatgaaacttcccattggtttagctcctacgttcattttatctgcagaatttctccgtggtgaactggatgctaataccattataagagcttcatagagagacagagaataagcacatccgagagagaaatcaggactttgcaccctggggatactgcctcaactgaatctgcatcagtaattcggtgggatattgtctcccccaaggcatccctgctattagccatgtagacaatgccaccactaatggcttattgccagccttgttgcagaggtgggatcttatccatttccgccctccacaggatcttgcgaggtcagtgctcagcacattcactgggttgagtcaatgcccctatattgtacctcattcttggtttaaaaccatagagcagcacttcacagagtattttccatgaaatactggtcctgtaagatgctacttgggtgcaacataattctgattccatgaagaaataagctttagaaatgcttcctactatgactacattccccaatttcagaatcatcatgcatatgggcatattaaagaatcagagaagtcctgcaggaaagaaacctggtgaagttagcatttcccaaatgcttttcagaaaccttttttcaattaacatctattcccatcctcagcaactagtgttttggagagggcatcctggggaacattacctcaaaatagtttccaattcatgtctaatcacatttaatgtgtcactaagtccaattggttcttccttcaccatataagattgtgatcagtcctgtccatttaacaccctactgttaatctcctagtctcaacttaatgcttcatagtatcatagcatcacagaaggatagatctggaagtgctttagaaataatcataaagtaaaggtcaactggccaagtgtggtggctcacacctgtaatcccagcactctgggaggccgaggtgggtggatcacttgaggtcaggaattcaagaccagcctggccaacatggtgaaacccagtctctactaaaaatgccaaaaaaattagctgggcatggtggtgcgtgactgtagctccagctactcgggaggctgaggcaggagaatcgcttgaacccaggaggcggaagttgcagtgagctgagattgcaccactgcactccagcctgggtgacagagtaagactccgcctcaaaaaaaaaaaaaaaaaaaaaaaggcaagctctgaatttaacagaggagttaaccaagacccccagggtgaagggacatgcctaagatgtcacaacatgacacgtttgactcactaaaaaaaatggtagtttcaggcaccactctcttcctccccgtctacttggtgaacaggaattagaggagcaggcccccagtgtggaaggaaagggaagccagtgctgtggagtacccaccgaatgccgcaccgcacacttgcacatacatcctctcacttcaactcagcaagaactctgcagggcgggtattttacagaccaggaagcccaagaccacacagtaagcaagtagctgtgccaggatctgagccaagaacagtttgactccaaaacatatactcctgctagtgtattatactctctctcgacaaggaggccctcaataaaagcacactgaatcacatagtaaactaggaactgcacatctgaagttggtggctgcaactactaccgctactgcaaaggagaacatatagtgagtctttggttttccatcaaaatagcctatcatttgtgaatgtaggaaagagtgaatttttaccattcatgaaaaatgaattaagttaatgaagtcataaacactaattgagagtattactgaatacacaaataatatacctgcaaacttttacaggaccatttaatgttagggcttgttggcttctcctgtcaagtcatttttgatggttggttatttttcatgaaatctacaatgggcacaagcccagttaatatgatgacgatgatgatggtttattttcattgtatacacaaaagcatatactattcaaagccgttggagtcttaatggagaatggaaactttctccagggatagacaattgataaactctaggagtaccctttttcatattcatctttccatatttgcatcttttgaggtacttggaatactgttaagtgatttttcttcccacttactagggatttgctgtcttttgaagaatttctgaaacaaacatgtggtccataagtccaagtaaaatattttaaaaacaacaacaaaccaataaacagcaaataataatggtcacaaatccatgaataatcaaatttaataaaatattgacatgcaaggatttttattgcttattacaatcactaacatgcaacccagcttatggataccacggagttccaatattggtgggtggggacatttttaattttagtatttaaaagttgtaggggagagagaaatggctttcctccaccgctctgggtttcttggctgggttatgaattgacgtaagacaaattaacagaaagaaaccccatatttaataatgtaggtgcacatgggagtcccacaaaatatgagacttgaagaagggtcacacggttgaaactcatttagcatcctgagctatggaacggaataggggcttggggcttctgggggtggtggggacacaagctgtgcgttgatgaggggaggctctgtatggtgggtcaagtgtgtcttattatgcagagaaagtctctcaggtactagaaattatattggaacagtccttggaaaaggagatgatagtctggggtggcatgtcctgagcccctacaaagtcaaccatgactgtgtaaccttaagaaaaagagtgactacccagcactttgggaggccgaggcaggcggatcaccaggtcaggagatcgagaccatcccggctaacacggtgaaaccccgtctctactaaaaaatacaaaaaaattagccaggcgtggtggcgggcgcctgtagtcccagctactgaggaggctgaggcaggagaatggcgtgaacccgggaggcggagcttgcagtgagccgagatcccgccactgcactccagcctgggtgacagagcaagactctgtctcaaaaaaaaaaagaaagaaagaaaagaaaaagagtgactgacactaaggaaggtttttttttctttttttttttgacgtagtttctctcttgttgcccaggctggagtgcaatggcgtgatctcgtctcactacaaactccaccttccgggttcaagcgattctcctgcctcagcctcccaagtagctgggattacaagcacctgccaccacgcccagctaatttttgtatttttagtagagatggggtttcaccatgttggtcaggctggtctcaaactcctaacctcaggtgatctacccatgtcgacctcccaaagtgctgggattacaggcgtgagccactgtgcccagcccaaagaaggtattttatatctgattgtcaagacatttttattcaatcttaagtactgaactttagcattaaagtatgcaaagaagccacaaggatagaattatgtctctaccaatcttttagtcctcaaatataagtaatcctaatattcttaatatcttaaaaaagacaccaatgagatcttcattcacaaagattattagatatagtgaagtaaatatttacaaggaaacaaaacctgttaaaactttaacattcgtgtcacatcttactgacagaaaatttgcttttgaaagccaattttgagttttatttcctcactttctttgagttttatttcctcactttctgcatatgtcctcatatcttagtgggagagctcttaccaaaaaatagtattttacttccttccatacctattgatacggtttggctgtgtccccacccaaatctcatcttgagttgtaactcccacaattcccacatgctgtgggaggaacccggtgggaggcaattgaattatggtggtaggtctttctgcactgttctcatgataatgaatgagtctcacaagatgtgatggttttaaaaatgggagttccctgcacaagctctctttgcctgccaccatccatgtaagatgtgacttgatcctctcctcttgtctgccacgtgagatgtgcctttcaccatccaccgtgattgtgaggtctccccagccacgtggaactgtatgtccaataaacctctttcttttgtaaattgtccagtctaaggtatatctttatcaacagcgtgaaaacagactaatacactttgtaaatttgatggggtcagttctgcattggttgtacataggagcaaccctgcacagagaaacagatcaagtctggaactagaatagagtaggtagcaagcagaaagtagaaggaagagcaagcaaaataaataggttcctaacatctgctatttcccgatttttaaaaagtgaatgcacagacaacagacaccaactctgtacacaaaaacacactttaatgttaactagaattattcctcagatgcacacagtttgcgtttgtttatgcatggtgtagctgccacttacgtagtgtttattacatagctggcactgttctaagcagttaactcataaacgcatttaaagctcacagcagccctatgaggaaaatgctgtaatacgtggcacttagcagatgagcagaaggagccccagaaaagcctgggtaggaaaggacagagcagaggtttgaatccaggcagaccatctccagtccatactgctcacacctgacactacactgatcgcctacgaagtctgctgtacttactctgctgacatgcttggaaaagaaacacattctaagtagttaataatcaatcatttcccatataagaatatattgcaacattcagaaaagggttaaaatattctgtaatcctaccactatatcacattgctggggtagcccaatcaccgcagagactttatgaaagaggtttctgagtcctatttcaaaacatcagtgactagggcaaaacccctccctaaacctaagccgtttacagtataaatttgggaaggaaactatttgagatggccgttggagatttctactagaacaatttgattatttcttttacagtctacatatgaatagttgaatcatttaattgcaggagttaaaagacttgtctgtgtttagaaaaatgagatttttatttgggattccccagtatattagaaagatgattctcagtaaattgtgggcaagaaggaaataatatacatatttgtggctatgagagctaaccagaaaaaaaaaaaagaaagaaagaaagaaagaaactctctggactcgcacagttccaaaaactgctgaatgttgtcttttttttttttccaccctactaagcatttctctcttatcgaggaggattcatttcccacctgtttcttttacgttcttgaaatacatataaagttagtgtttattttctacccactgaaatcttgttcaagttattctttctttggtctctactttcagaagtcacaacttgttttgaaaacattagcatgagagaaggcttctttttatgtaccacaaactctcaactatttagaatgcttgcttcagaggtaaagagatgcctggtggcttttctgctttgtaacaatggccgtgtaaacaacatgactggacaaaaccaaaaatgtgcttagacagagttccttcttcctgtccaggcaaggtggctcacgtctataatcccaacactttaggaggctgaggcgggtggatcacttgaggtcaggagttcaagaccagcctgggcggcatagggaaaccctgtctttgctaaaaaaaaaaaaaaaaaaaaaaaaaagctgggtgtggtggtgcactcctgtgatctcagctacttgggaggctgaggtgggaggatcgcttgaaccagggaggcagaggttgcaggagctgaaatcatgtcactgcactcaagcctgggcaacagagcaagaccctgccttaaaaaaaaaaaatggaattccttcttcttctgatgagtgcttctcatcattggggtcacaattatcaataccagttttttatagcccaacgttatttgaaacatccatatgtttgtgttataaattaatacacgtatttaaaatatgggttatagaaaagataccatatgcagtggtccagaattttgagttgtactgtccttgttcttcacatggggtattagatttcaaccaaaatgaagatcatatcttcaagtagattgccagaaggcaccatactggaagctcacgggtagtgcactctgttcaatgagggcagaaagacagtgacatatgaggtcttccaaaggtgacatggaatgcaggcagagatgaaatgtagaggagaaagaatgcaaagctgcaaaacatgggccctatctgtacttggatctggtccttggattgcagagctcactgctgtgtgcatagacctggcaagtgtacggctgccagtttgattccgatgaagggcatttagaagaatcaaaggatgaaagacaacggaaaggagttaacatcatgacctccattttactgatggcatggctgaggtccaaaagagttaagtgacacagagctagagcagcataaagccagcacttgtcaccttctctagtttcataattcataacttttctgtggtatatgttcctggtcaccaataaaatgggatgacagtgtggacagctctatccaaaccattacttctgataaacaaatcaaactcagggatgctgctggttcagagctgcttcctcctctctggggactggcctatgtcccaggggctcaaaagcatcaccaccttcatttatccttacaatgaaaccttgagggacacgactgtctacacttctaattggaaagccgtatctgattcattcaaatgttcagatcttcaaaaagtaaagtggcctagagtggaatcttaaagttgagagtatggactcagggagatgctgttcattagccaggataagagatgtggtttgaaagagctggacttccttttctcactttgcaattgacctgctgactaaacttgggctactcacttcttaacctcagtctgtcttgaatttcccctgtgcaaaaaaacatgggaagacaatatctaaatgcctctcagggatgttgtgaagaggacctcatcgatgttttaaaccacatggtcctaggaaggtgctatatattaccatcattaaaatcacctgtggttggctgcagccctccccccccgccacacacacaaacatttcttaccaaaaaaaaaaaagtaagaaattaattttcttcttatctgaagggatttcacaaaacttcctattaaagcattaacattctgaaaactgaattcaattcaatgtggcaagggtatgactgataaccaatcttaatcccaatctcttcttccttaaggagagaaagaattttacctgatggttaattaatcaaatatagtcgatgggatacatttagtcaataatattccattttagacttagtttagtcagagaagattagaaaaatggtgtcattgtgcattggttgaatgcttaagttttactagttatattacctcaagctggtaaaatatatatgggaagacaacattatggaaaaaaattattattatttgagaccgagtctcgctctgtcacccaggctcaagtacagtggtgtgatctcagctcactgcaacctccaccttccaggttcaagcgattcttctgccacagcttcctaagtaactgggactacaggtgtgcaccaccacacccagctaatttttgtgtttttagtacagacggggtttcaccatgttggccaggctggtcttgaacttccgacctcgagtgatctgcccgccttgacctcccaaagtgctgggattacaggcgtgagccaccatgcccggccaactttatggtaataaattaagacagtgaaagcgtgacttactcaagggctacatatataaaggtgacagatctgtatgtatctacttaaattcatgcccaacacagcacatgttgggcaagaatttgtgagctagctcagcttacaaatggcttagactaggggcatgtggcaaggggtatggggttctacttacagtttagggtcacaaaatagggcgatccaactctcccacttcacacaaagcctgcccccttctcctgcacatcttccataccaggtcctaatcaatcaacctaaccatctacagagtaagcagagtcattaacagtatgttctactctattaaaaccagacacatggccactaaacaaggttgatctaggacaaccattccattcagaatgttttcaccagtctatgccaaatgggaaaaatgagggaaagtaatgagttctttgaaagttaaattcattcaaaatttttaaaattgtgtaacttattccaaggttatgtccttactattttgtttttcatgttaaatgttcttattttaccagtgagagtaaataatagctgatttattaatatcccattctggcaaaataaaaagttagcatctctgtattggtctttaaaaaaaagaaatgaaaagcattgaaatccaaagtttggctagcactaccttagaatggcttacctgttgctaaaaactcacagagagacccatgcggctactgtgtcatgtgatcaaacatttataagacacaaagcctcatttcaatatgtaatgccaaaggacatcaagaaaaacgaatagacagtttcccaattcagagcaagcaaagtatgctgccatctaaaatcaaataaatgtagattctaaagtactaaacaaacagaaattatgctgtcatttttcaaatggtataaagtattttaattaaaacccagagggcatgcaaaggtataataatccaggagacagagtcacgataacactgtttattggttttcaactttcagatcctatcaatagaagctgtagacaaatatccattcttcgtctgaggacaaatgacagaggatttaaccattcagggaactgaaaagaacacggatggcatcaagcttggccctagctgacagaggctcagaggtagaagatgggagccgaaagagtgaatgctttcattttttaaatgagtaattaagtgatgctctctaaggtcaacagaatgagaaatgaggtttccaagaatttgtttgagaaataagcaatgtcctttaagtggagggacggagcatggagagggaagaggtctgagagaagacacagacgaggctgaatcagggagagaaaccccattgactataaaaggaaggcaataaactgagaaagagtagtgttatgggtcgaattatgtcccctcaaaagatatgttcaagtccccagtacctgtaaatgtgacttaatttggaaacacggtctttgtaaatgtaatcaagttaagaggaggtcgttagggtgggctctaacccaataggactgcgtccttataggcagaggaaaatgccatgtgaggagggacacacagggacacagagggcaagctaaggaccgatggcacttccaggagctggaagaggtggggggtggatccccctgagccttcagaacaagtgtggccatgctggcaccttgattacagacttccagccctcagaactatgagataataaatttctattgttttaagccacccagtttacggtattttgtcacagcagccctagaaaactagtacaaatggtactaccatatattatttaaagatatgaaggtagccacccaaagaactttcaacaaagctgggagggttcaaaggtgtttcctctggaaagtgggaccaaggaaggacaggacccaggcagggctgttattttttattaaaagccttctgtgttatttggctttttaaccacacagatgtcactctgatcatcttttaaaaagtataaaatatctatgtgatgttatcagaacaaaacctggccagctttcttcatagtggatgacaaactctgaggattgatagccacctcctccacttgttctctggcgttgccctccggtcccccagatccctatacacggtctccggcttcagggggagcagagccgagttgggagggcattggcctggacctcaaagtagcctaaatgtcttggcacgttttgttcacatgcctaccatctccatctcaaaatcaaacacaaattatttttggactttttacgggtttgcgtcatcgatgatggtgattttctctattgacttggatgattaagaaccgactaaagggaaaacagagaacagtggtgagcttgtcactggcttcctttgtagataaaaatgcaaaacaatgcctgacaaagatttcagtaattatgttacatatgatcagaaaacctcacaatagagcttcaccacaaacatttgttcatcacattttattgaacccataaaaagacattctaagtgctccccatggcccagatggaggatcttcgcactgtggtgcaggctgtgacttccctggccgtcagaagtcccatgccctttgctcactctaagaagaatgttcacattgagccctgcagcctgtaatgtggcaaaatgttgctgtcacctcccacatgaacagggctattgatgactgtgggggcctagtgcaaaggcaccagcccccatcacagaaagaaagcgggcagcgtgtaagtgtcccaagcatggccccgagagaaaagcagaatgcaaaaggcaaacgcagtttgcatgcacgcagggcttcgctgaggtctatttgtacccggctccccatggcagctggggagcaccttgccgttggttggcactgaagcagtgccaggtgggtgaaagctgaatgaaatgtctaacagctatcatatggatgaacacgcaggaagcagaacaaaggagcagcattttatcagcagcagaatcctgatggcagtcattgcccaaggggaaaccgtttgcttttattttcatcctggccttcagtttccctgggtaacaccttccagccatcccagtggttaccttacccacctacgtggttatcagacgtctagactcagccaggtgttttcccattccatattgcagggggcaaggtcacctcggaatggacttccaaaggcaggtgggaattacgccaatgagaaagcaagtcacaattcaaatactcgctgtatgtgggaatctatattgaacagaaagaataaaatgactccatttttattctgtgaactctcccttccagaccctcatacagaagagagtgtggatccatttaaggctgactacattcaattgcacacatctgctttctaattgtctcagttaccattctccacagctggccttttctccgtttttgcttttaaaacatcacctctcaacatattgtgaggaagaccaaacccttagactcagatgttccagaaacctgatctattagttgtgttttgaacacgtctggctacttttcatctgcttttttttttcttggtcacatgaacactgctgtaaacaaattctgtagtttgagttatgatatccatcagaaaagcctaacaacactgtagccttcactacaatgcataagcatgaaacacctaattttcctcattccatacatacacacacatgcatgcacatgtacacgcacacacacagcaatgtatcatttgaaaacggaggcatagttccctagcaacataaccaaaaacatggcaatatcttttggatctccaagttctggatttattatgtaaattgtttgaggctcatgattgaaggcttcaagatctcattttatcaaaaaagatcttagcagttactagtccatagaactttccctgacagcagggtacctctgcaaggagctgccctgtccatgagccaggcacgccctggtcagcaggggcggacgatagcacagacagcaaagggccaaccaggccagaacagtgccttaatccctaggaataaacataacccaacttcttaagggtcaggttcgttactaatgaggctctgcgttatgaaacaaactcacgagagaaaggtgatatctagccaattgattttaaaaatggaaaaaaaaaagtggcccatgtcttctcctattctcctggcagataacgggggtagatgaagtgggagaaataagaggaacaataactccttcaaaaagaagaaataaaatgaaaaagaaaaacaaacatgagctggatcaggaaaaaaaatagggcaaaacaagcagaaatgatctttagataagaacagtattacataaaacagcacccataatatgttaaagccactctgcagtacaaatcacttttccacaaagaattaaaagaagaagaacaaatacaaaaatcaattaaggtccagggaagggctccattccttctcgaggggctgcttcttatccaaacactggctgattcatgcaggtactgccaggctgcctcagagagggtattttttatttctgcttgactttgtccatagagtgattttcccattttagtttgcaaggaaaggttaagcaggaggagtagaatgttattccacttagaaaagaatccaacccatcccagggcctcaggctcagtgcttccctttggtgaactagttttccaagagccgacaactagctgcttggttgtgagtgacatgaaacactgcccttcctctcctggaggaagaaaccatcagcatccttccaactgctcccactgggaacaaggcagatggaagaagaccagcacgatgcttgatccatagggagcacgaactagatattcactgaaggagtaaggagcaagaaatagatctctgacccaaagtgataaaacaccaaagccaactgctcatttcattagctgcaagagagccatgcagggcagcctttcctcccataagacaactcagcgtggagttgttgaatgaataggaaaaagggagagctttgaaactcacatagaaataaaaacggtcttaggggataaaccatatttatattatactacctacgccatttaaggaatgtggttatacattttctgaaaaataaaatgtcctatcctgtcttaaaaaactgaatttgtataatattgggtttgcctaaagagtaaagcacatatactaattttcttttttgttgttattttttctttttttttttttattttgagacagaatctcgctctggagtgcagtggcatgatcccaggtcactgcaacctctacctcccaggttcaagcaattctcttgtctcagcttcccaagtagctgggaccagaggctcctgccaccatgcccagttaatgtttgtatttttagtagagacaatgtttccccatgttggccaggctggtctcgaactcctgacctcaagtgatctgcccgcctcggcctcccaaagtgctgggattacaggcatgagccactgcgcccagccaatttttttatatttttagtataggtggggtttcaccatgttgtccaggctggtcttgaactcctggcttcaagtgatccacctgcctcggcctcccacagtgctgggattacaggcgtgagtcactgtgcccagccacatatactaattttctttggagtaaaggcacaagtacattcattgtacaagtacagaatccaggaaaatcatcagaagagctttgacgtaaagagtatttgttacccatcagtagttggtagtgtggctgatcatctccttgaaatgtgcaaacgtgtgtggtaaaagtaaagaatcggaggtagggaacttataccaggctcacaactccacctcctgttcagagtaagtgctgggttgctgaccaaattaggtcttcttggacctccggagcagcccttctgcatttccaggaaggaggtggacaagtggctattttggtctgtctgtccatctggcttgtttgtggctggctagttcaccacccagctcatggtcaggctggaggattgggtacctttgctccgaccagtcagacatcccactatgacacaggccactcactgcagactagagggattcaacaggaaagtcccacggggtaagcaaataccaccactacccaaagtaaaattccaggctaggggtcagtggtgtcctcatcataggaaaaagggaaagtacatcagaatttgacagaggaacaagtaccaaactgctgtccccaaataaagaacttacatcaacaaggaatataaaaatgttatttaggacttctgttctcagatgtttaatacaaaggagagattgttgtgccagggaacaaagtgatccaatatccacaaagccagaattctcctactgcacattttgtttccaaaacactaaggaatacagcaagatttcaagttggagtaaagaagctacttctggaaacaagagaggagataactgaagactttcacagaggggctgaaatccttcccggaaaactgtgctcatcagggaacctcagcctagggggcagcgagggtggacggtgagctgacctatccccagacatgtggaataggtattgggtgtgcggggggtgcagtgcagaatgaaggctgggagttgttaaagctacagaatattctagtagcataccacgggaactcaggaacctcaaacgtttttcaaaaattaacgctttgggctcagagtttcaggcagtccagtgtaattttacttccactgggattgttgccagaaagaaacaagcagtgctccttgactacagatttttaaaacctgttttgttacatgcaggtgtgtgagatcctaaggagacttatttaattaagatgggggtgagggagcaggagggctgatgagtggcccttctcccttgaatggccaccacattggactgtattacagaacaaaaacccaaaagccctaaccagaaagacaactcaagggtgtcaatctgtttctcccgtttctagttcattacttttactcttcactggaagcagtcacatcattgcatcatcactctctcctttactggactgagcatttccagagggtaatgcaataggactgaggtgatggggctgggaaaccaggtcccctggatctaatcttggctccactgtacaatgggatcaatgtcaagttactcctcttcaactcagtatcctcacccatacaatcggaataatggggcctaccttctggactgctgcaaattttttttttagacggagtttcactctcatcacccaggctggagtgcaatagtgcaatctcagcttactgcaacctctgcttcccgggtttaagcgaatctcatttttgtatttttagcagagaccgggtttcaccatgttggccaggctggtcacgaacgtctgacctcaggtgatccacctgccttggcctcccaatgtgctgggattacaggcgtgagccaccacgcccagcctgctgcgaatcttaaatggaatagtatagtaaaacgctcagcatgcagatggccccgcctttgaatccgcggactgcaccttacccgtcttcacatcctccttcatatttgctcatagtagggcctcatattaaaattttttaaagaacaacaaaatgttttatttcctctagtttatttttttcctgataacatgctccctgcctgtgccctaaaccctctccctggcactggactggatgcttcagatcagttgtgattaacattttacacaccccctgtaaaactggacactagcactcaagcattattttaattaacggccagagagtggcaaaattaaatatgagatgacctacctcaatgctccactgtgtctcctacccctggaatttcaaggggcctttgttaaaagtgagtgtacaaaggaaacacaaacaggcaaaggagaggagaagggagcagcagagacagataaaagccaggaaatcacagcccgattccctgcactgtctccaaattactggtgtctttgaacagcttgcatgatattaaatatttttaagaagttacaatccatgacaataaaaactgtagtaaatattaacagaaactgacatcgtagaaatttttaaggggatcatccactaaagaaatacatgatttggaataattccttcctgtgtaatcaatgggaacgaagagatagccaagagatttgtggctcttccagtcaatatgacaccccaaacctcttacttctcctaacttctttggtcaaagatatttacagggcacccatgtggggagtacgctgtctcaagtcctctcgggatgaggcctctgtggcaaggggctgcagggggcccaaaggaaagaacacggactctcaccggtgacccatggaaagaaaccaagtgccaagatctggagaggcgccagggtcctcaagggactgggagaacagctgcgtggcaagtggagaagcacctgtggcactccaggtggctccagccagaactccaggcctctctgtcgccaatcaaaataaacagtgaagcaatcaaagtgagcactcgagtcccatcagcagagcaccacgctaaggtcttgctggcagcagagtttgggaaggggaagggccacaatggcaaggggaaagcaaaagaaagagaagaaagggcccttgttcttgtgcaattattattaaacttggagaaaataacacaataaaaacagctatcagtaatttaatacaggacgatttcctatattgtggtatgtgatcttcatagtcacctgtaaccctgggatatagatattactaacccattaaacatttcatccaagattaaagaaatagagatgaaaccagggcagttaggtcagtctgactccacagttggttttctcagcgattacactctatcacttctttctttgaaacaacctcacacacccatgcatgcacatagaagaggattttataatttaggcgtggggaaggtcagtcttaactatgactcaaaccccagaggctataaaagaaaaaaaactgataaatctgatttcatgaaaataaaaattttctgcatggggaaaaaacaccatcaacaaatgacaaaccagggacctatctggaacatagatcacagacaaaggatatatttctttaatatataggaaatgcctataaatcaatatgaaaagagccaacgaatactaaatcagctaataaagaaaatcaagatagttcataaacacattaaaagatgcataacgactcataacaagaaaaaagctggttaaaaatactagaagggtgaacatcaaaacattttattatataggcaagggtgaggctaagaaggaaggggcaatctcataaactactaatgagaaaataaatgagtacatccgttatgagggacaatctggcactatctatcaaaattataaatgcacctgccctttggccgcaaattccaattccaggattttatcctgcagatcaactcgtatgtgtgcaaaatgatgtctgtaggaagctaatctctgcggcactgattgtactagaaaatgtttgagaacaacctaaatatccaaaaaggagactgattaaataaactatggtatatccctacaatgggctattatgtagacacagaagagaagaggaagctcttaatatattgatatggaacaagccccaaggtatactgttaatcaaacaaagcaaattaaaaatctcaagcagaataggctatcataaatataaaagaaaatcacatagtgtctacatatatatttgtaaatatccctggaaagatacacagggcatgggtgacaggagctgcttttggggagaagtgggaggtaaagtgaggagggaggctcctgtcactgtatacactttgtattttttgaattttataatatgtgcttctattgtctattcaaaaaataaattgtatatataatttattatatattaaatatacagatgacaaacccggaaccaatttggaacataaatctctctctctctctctctctctctctctctctcacacacacacacacacacaaaaatatatatatttatactacatacaaatcaaaatcaggagccacacaaaggcagaagtagcttctggcccacaaggctgtgtgaccttgggcaagctgcttcaccactcaagcaaggtctcagcttcctcatccataaaatggggactggaatcctccctttctcctaaagtttggagaagtaaaggaaggaatatatgtaaagcctttaggtcagtgcctggcacacagtaaatttatgcaagtgtttgttaaataagtctactcggttggtcaaggaagacatctctgaaaagtgccctcaaagtcagattagaaagctcagtaggagttaggcaaggaggagagaagcaggggaaacagagagtgctcctcagaaggagtggcttgtgcaaaggtcaggaggtgaggagatgctcgcactgagggaagcctgggtgactggcacagagcctgggagggcaggggacagcacgatgcaaggccgaggaagtgagagcgtggatcagtcacgacagtttctctgggggtgctcagcaacccatggagcatttatacaggggcattccgtgcttgggtaggttttcctagaaaaatttctctggcaagagtcaggaggacaggttggagagaggcaaaaactgggtggcagagaggccagctggagattgttgcagcaactcaaggaggaaatgatgaggctgtgaactaaggcagtggcagcaggcaggggatggagtggggaagacacaaaggaggtgcagtcagctgggctgtttgacctagatggtggctagaggtgggacagaagaaagaattgaggataattaccagagttttgacctcatcagtttggaggactgtgatgcaactcactgagataagaagatcaagcaaaggaagtggcggagggagtaagatgatgggttaagtcccaaatttgttgaggttgaaacatcttataggtgatctgtagctagctacatgtgtctgaatttcagatgaaggacctgcagtaaatatatatccttgagaggtatcagctaagtttttaatactgaaagttctggactgtggttaagggagctgccaccaatggtccctctggtccacaaaggagactttggagaaggtatgctacctgtaatgcaggtaaatccctgctctctccctccttccctctgtctttctcttcctccctctctcccttcttccttccctttccttctctgtttttctcttctgtctttcttccttccttcctaaaaatataataaaagtctttacaagaggtttccttacatgcttcacgtgaagtaacccatctctgatcagtcccagctaatcagcggcgatgcctttattttctctaacattcctgcattccttttgcatctcttttcacgcatggcggaagccactagaaagctgtcactgttgtgtatgtgcgtctgcacaccaccgtgagtagcctgaagaccttatttttccaacaggggagtaatttacagcctaccaatgaaaaagagagggagggaacaccaagtgtatgcctcatgagtgctgtctagatgtttcttagaaagagcattctgtggttttctcttgtgctcactgtcttcagcaaaaccaacccccagttaaggatgacctaccacatggttttactaagagaccttagaactgatttctaaaagggcatacattcttccactacaaaaaaagtgtgtttaggcaagatttctggaacaatttagccaggtgaggtctggggccaagattcaaggatgccagctttgtaactcactcattcactcacttgctaacatgttcctaaccttgccccagcttcagtttttttcacttataaaattgagacgaactgctggaccatctccaaacctccttctggctctaaaattttgtgagtctagttctgagcaagggtttacattggtttcacgacagtgtggaatactttaacaattcaaaattgccattacacacttaaagcaacttcattttggaggtttgttgatttcatgactgggcaacagaaatattattcacaaactttgtggcaatgacaaatatatttatcccaaaggtaaatctctactattataattcagcagatggtcagttttcaaatttcatatttgccagacaagctttctttttatggcctgaaggaaacataggcagggactcacaggggagggaaaacagtacccaatccatgaaagtattaaatattacatattattattattattcggtctttttttctttttccattttttttttaaatacagagtctttctctgttgcccaggctggagtgcagtggtgtcatcatagctcactgcagcctcaaattcctgggctcaaatggtcttcctgagtcagcctcccaagtagctaggactataggtgcatacacaccaccatgatcggtaattttttaaaaaattctatagagatggggtctcactatgctgcccaggctggtctcaaactcctgggctcaattaatcctaccacatcggcctcccaaaatgctgagattataggtgtgacccaccatgctttggcccattggtctttagctatgtaaagtatggacttacagttttaaaatatgacatggaaagttcggtgtgccaagaaatgggcaatttattttcccacttgtagagattcatgagacttttgtgggacccaccaagaaatatggacaaggaaacctaacaaataacagactctcacctttctctgttgagggacgtgggatcatctagatgaattcagttattacattaaagaaatagtcattaaaatttgccacaagggattttcatctaaatctcaacccatagaaaaatatcaaggagaaagtggccatttttatctaaaagaactttgcttttttatcatgtcagtcacttggtgagttctccataatctgtgtgcttttggtaaaaagcaacatacatcagagtttaattgacttaaaatattgtatcttaaaagatatcatgtaatgtgcccttacaaatcaaaacttgatttgattagtttgaaatgtattattttgaaaaataatgtcagtcgaaattggatttcagcaatatgtttttggtaatcacatgaaggagaatgttaggtatcttccaacatttgcagcatatttactgttaataacacaccaatatagaaattagctatctaatttactagaaactaggtataatttcctagtgttttgagggggtagaaaggaaaatgcacaaacaggtttccacctttgaaatgtatatatatacatctaactacaaaaatttatcttttttcctttaaagtgctcattatactcaacatcactcaaaataagtgaaagggcaaattaaaccataagctgggatcattatttcacctactattttcacaagtatgaaaaaagctgacgagtattcatattgctagcagaattgttaactgttaacgtctatggagggcaatttgacaaaatcaatcgaaatgataaatgtacttactttcagctgcaacaattccatttctaggatctttttcctagagatatacaaaataatgtgatacagagctattcactgaatcactgttcatcctgggaaaaactggaaacagcccaaatgtctatcagtcaggaagtagttaataagtcatcatacagtagtataatgtagccttaacaaagaaagaagaagctcttaacctaccgataggcagtacattccaaaatgcatttaaaaggtatatgcagaacagcatatatgtttgccaccctctgcataaaaagagggaaagtatttacatatatatgtacctatgcatatatccatctatacacatatgtgtatacataaatacaaatatatgtacacacaagaccctgacaacatagattctgcggaaaggaaacccttttcccagaatagaagtctggggacaataggaggaggaggaaagaaatcactgcataccttttgggaccttttcaattttgaaccatgataacatgttacttattcagaaataagctaacaaatttgactaataaattgttcactgataagcagtaaatacatactcatatgtattatcatttaataagaacttgaagaattttttttttttgagacagtctggctctgtcgcccaggctggagtacggtggtgcgatctcagctcattttgacctccgcctctcaagagttcaagcaattcttgtgcctcagcctcctgagtagctggaactacaggcatgtggccaccacacctggctaatttttgtgttttttagtagagatggggtttcaccatgttggccagaatggtctcgaactcctggcctcaagtgatccacccacctcggccttccgaagtgctgagattacaagcatgagccactgcgcctggccaaagaaccatacttttaaaacaccaaaatagttaggccaagattgctcttttttaaagcaaaagagatatatagttaaagacatgaagaataaaaattaggcactcttcctctttcccagtctcttggaattcttataaaataataaattaaacctaacagtttggaggaaaaccaattaaagggacataaatcatcattaaccccttctccagatgaatgacaaagagacacgtgttctaattaacaccgagtaacattgtgtaaagagcagtttgcagtggaaatgaacagatggcaaacaagcaaaagaggtattggagagcaagaaagaaaacttgatctgatgctgaaaacttcaagcaactgaaagaaattatatctcaatgaaaatagctctaaaaggatggatgaactcgccgattcaactttagtttttaggtacatccagttttgctgctttcaatattcagcccccacaaggccaatactattccaatccccatcccactttctgtatttgcaaacaaagccacacaccaaccaaccaaccacctctttacaacagaaagattttctatccctaggcaatgaatggctcagttatttcaaaccaagctagcatttcagttcaacaaaaggttttggacatcatcttggggtctaatgtaacaagagctgacctggaggtttatgctttaacaaccatcccctttctttcctttgaaacagagatttatgacaggaggcagagaagggggcaagatcccagggttgatgaacccctggtatgaaccaccgtgcaggtacgtaagaagttcctccttctgcttcccccttgctcaaaggcaaactggagctaaagtcatggggaagcatagcaccacttcctcttgttttcaagttcatcctgtttttaggctctttttggtggaaacaagagtgccacaagcaatcaagtctcattagctgaaccctcagcaaagaaccagtgactgactccatatgcgggagacttcaacccagctgacagatgctatttctctctgtccctgctgacccaggctggggagacagcatatttcagacaggatgccctcccaagagttgtgatgcaaccctggaaaaaatatctgttcaagatcccaagccaggatctggtttctgccaattcagagtgacagggatcagcggctaagacactggccattacaggaggtatgttgaatttacacatatttaacaatagcagacacttaatattctcgtgtcttttattgtttaacctacatagagcattttaaattgtacattctgtagtgcataatggttggataaaaaacaaaaaacttcgggtaaacatccgagacaattcttgctctccatgtaaaaaaaacagaaatgttttttgtttgtttgatttttgaactccaaataaccactcaaagaaaaaagggagataattggccaatcaggttatctttagctatatcaacaacaacatttaaggctgagaattataagtacaaatgatttgtgtaatctgaatgttcagacttagactgacactttaactcatgtgtttagagaggaatatagagatacagatcataaatacacacacagcaggctgccgtatatattttatataaaacaggcagtttctactaaattacttgaggcattaggattcaaactcaattcccttctctatctgagacagcagactcctctggtctgaggatatttttaaatataaaagctaattatcctatctcactgcctataaattcaatttctatttctgaggctgcttctgttgtagatctcttggtagtccattcacattatagcttgtttacaacccagtctaaaatcacagcaaagacagagattgaaaaaaaaaaaaaagctttttaaccttttaggaagatttgataatgcagcaggattttcataatgatacagataatcaagtccattttctatgaaacaagagtttttaagtggcaaattttatagacaaaatgtagaaagtataaagtagactcatgagtggggctaacgccagggtcggaatgctttctcttggttaggtcttccagcaaaaccaatcaaccaatacacatggaaaatgcatcatacaaacttttcagatcagagctggggctttgccttgtgtcagccgacgaagaactcccaaggccgttctggattgaatctcagcgtagagatatgtaatatgccaccaactttcctcccttctaccggctcctttgaaagagagtccttcacaagcagttcaaggaaaaagcacattaacaatgacaatttacacttaccagctggggtggtgaaggttaaaggcaaaccaaagtaaactgacaatgataaagaacttaaaagcctatgctttaaaaaaaaatactcaaatctgtccttcgattgctaggtcggccgattagctgtacaacccttggcagtctcttgaactctttggacctcatttttcgtgtctatgaaatgagagagttgaacctagcgactttgaggttcctcccagttctaaccggtcatggtttatgatcaaaggctgtggctacacccctgaccacccacccctcacaaagcctcacgcctgactcctccctcttaaggctctgtctatactgcgttgtctgaacttcacaggtgatggtggcaaatgaaggtggcatgacatctttttgttgcttggtctttacaagcatctcagatcaaattaatattaaagagggaaatagacaaatgaaataagactactaagatgatattcttcacaaaggaataaaaacacatattcctcaaaaaggaggggaaaaccacttttggaaactctctggacatttttttccaagaagggacccagggagccatttttacattgtacttcctcaatcctcattcttgaagctctaaatcttcttgttttccatctcccttgagattaggaaggagggagagatattttttctctctatcctctgagttggccaaatctggatgactcctacatgcctctacggtaatttcctatgctatgctaatatctgggacttgctggtaaaccttaattaggtccatctaccatgggagtcaagcttttataaagatactctttttttttttttttttttttttgagatggagtcttgctctgtcacccaggctggaatgtagtggtgcaatcttggctcactgcaacctcctcctcttgggttcaagtgattctcctgtgcctcagcctcccgagtagtggggattacaggtgcccgctaccatgcccgggtaatttttgtatttttagtagagacagggtttcaccatgttggccaggctggtctcaaactcctgacttcaagtgatctgcccatcttggactcccaaagtgctgggattacaggcatgagccaccatatgcagccgattttataatgatactctaaataacacttttcctacactggatatgcacaaagatcaattggtgaacccttcccacccttgtttttgaagcaaacggaactgcagggcaacaagctttccttccacctgccgcggaggacctagtaaaaccccgggtgtggagtctgcagggatttctgcctccaaacccaccttcccccaaatgaagaagctttcaagcatttggttgaatccaagtattcggtgacctgatgggtaaatataaataaaagcttaatttttaaaaccaaaaattctgaatccagctatgcacacgctgtagagtatagtgctgctattacatttgggtcctacattcacgggcccaaacacctattgaccaacacatctaaggacagaaatagattctgccttcacagttttgtgtgtggcccctgcagaagtatttatttgaccactatggtatacatattcactcttttgctctaatatccttttatataaaaaaaaatcaaggccaggtgcagtggctcatgtctgtaatccctgtactttgggaggctgaggcaggaggattgcttgaggctgcagggagccagtcacgccactgcaccactccagcctgggtgacagagtcagaccctgtctcaaaaaaaaaaaaaagggaaataattttcgatcaaggtttatgtaacttgaagaccagtgagttactggagatcatgttaaataaggttagatttcatgaaaacacactcagcaacaacaatgcctttcactcctgccccaccttcactcaacaacagcaagttaaagtggctctccccttcctgtcctccccgggaccactaaaccaaacctctcagtggccaaaggatggaagagaacttggaatgggtgtttccattctggtgctaaatactacacagccgtgacccttttcttgagcacattttgagagtgccccgagtgtcacgaataatgagcttcatattgtcgaaaaataaaaataaaaaggacttgcttaagtagtttcatatgtaaactaacagagtagttattgtttgtaatttccagtttagggtttatccaattatctctctactgtctggaaggccaggcatgggggattccagttacaggaaaggcatctgccatggccaacccttgcaggccaagcaaaccctggcgcagactgcagcagatcccactggggtgcccacgtggtggagggggttacctaggaaaggaaggtctcctggcaaaataaccctagtgtgaggcttaacttactaatttcttctaaccactttgcaagaatctgttatttattgcaggaaaaggaatcaaaatgagctgggagtgtgtgtatggtgggaagggagtgatggttgaaacctgcttcaggtgacagccaacacctgttattgtaaagggtttagggcacaaaggacaccatggggtgcccccaccctactcctcattagagggaggcctctgatggatggtctaggtggctctggggtagaaagacagacttctgggtgagtctaagcttgagacagacagaggtcagcctggtacctctgcagctcactcttgggggccgagtccttgctaagtgacacagaaacctcagcctccccttcattatttttatgaatggcagatctctttaaaacctaggttgggtcacttcacttccctgatccaaactgtctgctggcttctcattacatgcaaacaaaacccaaaatgcttgaaaaagcatctggaaatccatgggggctgttctggtagtcacaggacaattgggagtcattagtggcatttaaggggtggggccagacaggctggacaacctgcagtacatgggatggtctagcacaagccacaaatattctatgtcccccaggactttccagtctcccctggaagggctgaaaagcctacgccattttacctgtcaacacaagggtttcctccatgattttcataaatgctggatttcaatagggaatgatgtactttgttttgtttagaactttactaacacgtattcaccatttcagaaatatcacatcactaaagtcaacaccgattatgtcatttgagtggccaatataacacatctgcagccatctggatttatagctgccacgtttgcagtgatcctacaagtgggtgcaaaacatatgaccacaccattatgtcttccagtgtagtcatgaaatacttcttagttcatgatacatttctccccttttgtacttcctttctattacagttaaggcattgtatggatggtttgtaatgatgtgggtagataggttatattttctacaaatttcatcattgaagagtgaaaagggtgttactaaatatctatcataagaagtgaggttttgggtctggccagggctgctttcctccatctcatttcccgccactttccctccctcccactgcaatacctctttctcccctgttggcatgcccagcctttgtcctggaccctccacctgccccctgtctgggagactcttctctcagagatccacagggctccttcgtcacttcccttcctctgtccctgactctcctttttcttcctatagaatttatcagagctcaacattacatcttctatttaataatttctcgactgtctctagtactagaattaagctctatgagagtgaggattttgtctatcttgttccccagcaccaagaacagtgcctgagacataaaaggcacttcttggccgggtgtggcggctcatgtctgtaatcccaatgctttgggagaccaaggaaggaaaatcactcaaggttaggcatttgagaccagcctggcgagaccctgtctctatataaaaaaaaaattgttaatgagccagtgcagggtctcatgactgtaatcccagtgccttgggaggctgaggcaggaggatcacttgcctgggtgacagagggagatcatgtccttttttttttttttttttaaggtatttattaaccttagtagatgactaaaggaagaaacacacatacaaaagtctggtcctaccaatgggcttagcttccccaggaaccaggaaattttactctcccacccctataaccactgttgcaaaatggctttctcttccactgaccaggtttctcatgcccaccctttgctaggtaaagagtagtaaaagagaaaatggccaatgaaaaggagggggaaacactttttaaaaataactatattttcaggacaggctctgtgtgagatacactctaacgtggggacacgccacagtcctcagtggcccctgcccatcctcccaactcactgtacagaaacactctatggaggccaatatttgattctagaagccagtgtccctcaacccaacttctgcaactccatacccaacaaatgatgctcaaaaacaaaagcagctattttaagatcactaaacactggctggtgatggcaaaactgtgtctttccttattcttttcttcatttttgcttttcatcaggccactgcccctcctacttccttaaaatgaattttactcagaaattatcaggaagaaatactattcaaatcaaaatctcagtagctatttttgtagatcttgataaacttactctaaaagtcacctggaagcccaaaaggccaaatacagtccagatacacttgaggaaaagaaaatgaggtgaaggtcatattctacaggatattgacaaagactctcctagatcaaactcaggtcgggctccccggagccttctcttccactagaccctgaccttgggcttccttttctgtcttatagaatccagtttaagcaagaatcctactagttttagtgaaaattctccacccttggtatctgtcctcacccctaactcttgatatcttatcaccctggcctgccttcagcaagaattctgttgagttggtctagcaagaatacccctgtctctgatgtttcctcttccatccactgaccccaccctgctgcttgactataaatcccctcttgtccttgtagaagttggactccagcccaatctctctcctcaccacagcaagacctcgttgcagcagtccctctacctatcacaatgttcccctccttgaataaagtcttctctgccatttttaacaaatgttacaaatatttttccttaacaataccaagacttatagagctataagtaagacagtgtggcattggcacaagtgtaggaaacagaccagtggaaaagaatagacagactcataaacagacccacacatatacagacacctaagttttgaaaaacctaacactacagcgcattagaaaaaaagatgtcttcccccagtaaatgtggctgagttgattggatatccatgtgggaaaaaaaggaaacacgcccctcccaaattcacagcattcatataactcaattccaggtgcattatgtagatataaatataaaagacaaatgatacaacttttagaagttaacataagagaaaatcttcatgactttgggataggcaacattgtcaaacaagacacaacaagtgccaaccatgaaggaaaagagtgataaatgaggttacatcaaaattaagaaattcttttcatcaaaagattctgttttgagactaaaaagacaagtcacaaaatggaagaatatatttgcaacacacaaaattaatgaaggatgcatagccagaagctgcaaagaactcctacaaattcataagaaatagaaaacagttgaaaaatggacaagagacttgcataggcacgttctaaaagaaaataagcatatgaaaagattattagtaataagtaatcagggaaatgcaaattaaacccacaatgtgatactcctgtgaacatgccagaatggctaaaattaaagagactgacagttctaagtttggagagtatacaaaacaacaggaactctcatacatggcattacatctacaacaatttcactatttggtgtgttcccaatagaaatatatgcacaaggcaccaaagaacaggtacaataatgttcacagcagcattatatatcataacaaaaacaacaggatgaataaatacagtgggtgaactttcacaataaaatacaacaaggaaaatgaacaaactttagcttcatgaaatctcacaaacgtaactatgagcaaatgaagcccaaaacacaaactacatacactacaatttcatctacatgaagttaaataacaagcacaactaatttatatcatttagggtgacatacttaggtggtaaatgtgtaaggaaagtaaggaattggctaccataaaacttaacataatttctacctttggtggaagatacagggctatgattgtcaggggacatggccttatgggggctggcaatgccctgtttcttttacctgcatgatggctacaaagtgtttactttaaaatagcccaatgggatatacatttatattttatttacattttggtatatttattatacttctaaataaaagattttttaaatgaaggaaaatcataaatcaaaaagatagaagagtatccatgccaaactgcatgagatcataggctttggagtgagacatacctgtgatccaatcctacccctgccactgactaattgtatgaccttgaatgagttatttaaactttcaaagcctcagtttccgtatctattaaatgaaggtgataatatctatttctcagggttgtaaaatgaattaagatcctatatataaagcacctagtagaacatctggcatactgtaagcctcaagaaatggtagcattgcaaattgtatatctgataacggattaacgtccagaatatgtaaagaacgcctacaactcaataacaacaaaacaacctgattttaaaaaatcaacaaagaacttgaacagacatttctctaaaaacaagataaatgaatggccaatccgcacataagaaagatgctcaacatcattaatcactaggaagatccaaatcaaaaccacaataagttaaccacttcacactcatgaagagggccatcttgaaaaaccagaaaataagaaatatcggtcaggaattagagcagctggaacccttgtacactgctggtagaaatgtaaaatggtgcagcttctatggaaaacagtatgatggttcctcaaaaaattaaaaatagaattacaataggatccagaaatgccacttctggaagtggaatttcaaaagaattgaaagcaggcactcaaacagatatgtgtacataccgttcatagcagcattattcacattagtccaaaaggggaagcagctcaagtatccatcaataaatgaacggagaaacaatatgtagtagatccattcaatggaatatcattcagccttcaaaatgaaggaagctgtgacacaggccaaaacatggatgaaccttgaagacatcatgcttagtgtaacaagccagtcacaagtgtgagtccacttatgcgaggtacctagagtagtcaagttcatagaggcaggcagtagtatggtggttgccaaggctgcaggcgtgggggaacaggcattactgttgaacagatcctgagtttctgtctgagaagaaaaaaataatctggtgataaatggtggtgatggatgcatgacattgtgaagaaacttcatgccactaagctgtacactgaaaaacggttaacatgataaattttatgttacatacattttaccacaatttaaaaaaattattaaaaaatactaacaataggccaagcgtgatggctcacacctgtaatcccagcactttgggaggctgagacaggtggatcaattgagctcaggagtttgagaccagcctgggtaacacagtgagacccctgtctctacaaaaaaatacaaaaattagttgggcatggtggcacgtgcctgtagtctcagctacttgcagggctgaggcaggaggagttcttgagcccagaaggttaaggctgcagtgagccatgttcatgccactgcacttcactctgagtgacaaattgagaccttgtctcagaaagaaagaaagaaagaaagaaagaaagaaagaaagaaagaaagaaagaaagaaagaaagaaagaaagaaaaagagagaggaaagaaagagaaaaagaaaagaaatagtagcaactgttattgtaagacatctccacacaccagagaagttaattttaattttaacatgttaagaacagagagaagccaacatgtccaccttaggctgacggtttgtttatttgtgttgttgctggtagtcgggtttgttatttttaaagtagcttatccaatacttcattaacaatttcagtaagttatttcatctttcaacataaatacgcacaaggatttcttctggtcaagaccaaactaatattagtccatagtaggagctaatactatcacatttactaagtattctatttgcaatttgactgtagcccatagccttttgtcggctaaagtgagcttaatgctgatcaggtaaattaaaaattatagttaattaaaagggcataaatgttacctgactcaataagtcatttcaattaggtctgttatcacaagttcttgacacatgtaattaagaaagctaagctacaggtcactctttgatgatgtttaagctgcagttctgattatcttcaaactgcgattccaatccagagttgtaactagcagttatttctctcatggaccaaaagatcagaattttccctggaagtttatcagaaatgctttcaagtttcaaaatacttgcctgaagtatcctatagtggccttgaaaacgatctgtccaaatacccagtttaacccatggtttaagaaataaagaaagttgacttcatttatttgtcttttttccctcctaaatggcagtttgatttgtaaagcacggcaatggaatgaaaatcttattttcaaggtcagctttaacaagcattcaatatctcaaatgccattacacattttacttactcaaaacaccaaaaagtcatcaacacgaccctcccaaaatctactaatgacttctgtgaaaggcactgaatctttgtaattagacaaagtaagatcatgtatgtcaaaatataggccctggttcacagaaaatgcttaataaatagcagtaaatatatatagatatatatatcataatagcacaagttgaatgtgcagggtccatgtaagctaaatttattatcccattttagctgaacagattttagaacattcagtgattccattccattttgtaaattactgatctgtaccaattcaaaaattcttctgaaactcaattcccaggcatttggcttttgttcctgggatttccactgctttagagaatccagctttaatgggcttctttctgagaaattctccattggttctgagaagtacttctattgaatgctccatttaatttcattttgcaattaatgaaactttcaagacctatttcccctcttttgaaaaatttctagttatttttttcttgccttttgggtaattaggagcagcaaactacttccactaagaactaaaggcagtaagtatggcaacaaaaataccaaatgtcaaaacaaatgtcattttccgagttctgaaacgcccatctctcagaattaaaaacattccatgtcacctctacgggtctttggttgctagctctcaaatggattcacgttctgatttcagtaaaattcaaccaaaagcttttagggtttttaatcttccttgacaaaaatacttaaccttctccagcctgggaggtaccgtcttttcctgcctgtgaaactctaccagtttggtaataaaacaaaccactaatttagttgtttattattcttagcctaaagatgtttgcgtggctagctgagtacaaatgtactgtatctgcgcttcttctttttaaagttttaaacaaataatcactgaacaaaatcagccaggaatgatcttctgctcatgggaaccgtatcccaacccagaaccacacgcagaagagtgcagggcctcgaggtctgttatctcaccaaataactttccctatgtggtgaaaaactggttaaatcacttttccagcgatcccggaattttcagttcaattctatccctcctaagtcaccagggcctctttggtaatggatgaaaccatgaagtttggttcagaggaagcaaagacacattcaaatgtgagactcaactgctccccgaggattcttcctgcttcctagttttaggtagatcaagagcacttttaaaataaacttggcgtttgtttcctattccaatggaaaatctgactggagactccacagcgacagcaaagaacccttacttttctggacaatcaaaatccggcttttgtcactctaactgcagcaggtcagcacacagggtaccagtgtgtccctgagcgcgctgacgaatggatatggtgctggcagccttggcctgggggcacttctgaggagctttaaaaaatactaattcctgggttcccctctccagcccagatatttttattaaattggtctgagatgtggcctgggtggcaggatttataacacttcctggatgatgttaatggaagccctttgaggtagaagaaggtagacaggactgactgggagcgcatcatcaaccacctctgcctccccactaagaagtctaagaataccccaaaataggggtgcagtggttgaggagaaaagagaggaagtcacgtatacttttgcaggctttcatgcaaggacccaagtgtgtgtgctaagcacagtccccaaacaggggaccccagaagtcctattcctaagatctgaattgcaccaaaggtagagagactcttcctggggttatttgaaacaaggcagactttgcctggcatgtatgcgccagacccagcctctgcagtgcttatgtggcaatgcttaagcagctcccagcactcgacagggtactttaaacaacttcattagtttgaaattttaaatccaaaaaaagctaccttcaaatgtatgactcaagagcataaaatttcagagcagagaacaccgccaggctagtaggtgaagcatcttatttttaaatggcaagggggaaccttgagtaaatatttggttgcaatgtattccaggggtggggggtttggacggagaggaaccactggtttttattcaaaatcctcctcccgctgggcccaggtcaggcctacacagctctggctacagactgtgagaatcctggaaggctccaggggctggctcccaccatgctccactccagcaagggcagacgccaggaaaaaaatggaaagggggagtcaggcatggaaggtttcagacttgctgcaggcaaaaggctgcagagcatccccagggagcagagacctcacaaccaggctccctacctcgctgtccttcagggccgcccacagctggctcacctgcagctgcaccacccaagagacagagacaggctcacacgcagcagctggagagaaggggctggaataaggattctttctaaacggaaaaataaagatcactgggggaacttctcgcccatccagcagtttgtgtgtactcagctcccctggcagggaatgagggcccgttgttccctgctgaagaccattgccctggagatgggatgggtgggaagaaaaatgtcagtaggggctctgtccttgctaccttctctctctggctgacctctggaattctctttctggctgacctctgaaactgagttctgggaacggaaggggaccttgtgatgctcccaacatctccccaagaatgcacgcccttagttggagctgtagctaggtaaggagtcagctgcaaactgcaccctccccacaatcttgtgacaggggaacatatgcaaatatgagatgggtcactgccggggaggtactggatgggggatgtgttcaggaggcttctgccagccatggactgaacatatgtcagccatgtggtacggttcttacacaaaaacagaatcctgagtttggtttcacaaacaggctcatctctcatctctgagtgtgtagcgggagagggtgcaccgtttccatgcagggcaaatctgtctgcatggggctgggggttctgcatctcagcatgggtttggaaagtactagaagtgcatctcactcaacttgatttagcaagcatgtctttgtggtccatggcttgtgttggcaacttaaatttgacagcacacaaactatgtgatggtgatggaggggcaggtatagcaacgtccagtttcccacctccaggtagtggcattctccctgtcctttctgcaacagcagcctgggaggttttcaatgcccttacttctcctgggtatatctgaactatgtcctgctcttatacacataaaagggtcacttgaggagctttggccatatggcagctgtttggaaacaggctgcctgatgcattgacaaccacaagaaatctggaagagtaaaacctgccccatagctggcatgctacttgtacattaaaatgagagcataatgtaaaagaaatgccttaacacttccttcactaggttcaaacttgctgtgattatttaggaattcatttcatttaaccaaatatgaattgagcaccttttacacagttgggggcaggggtgtccaaacagacatgaataattatgatacaaaacctattgtatatatacacagaaaatggatgtagacacaaaatgaataaacatgaaatgaatgtagacaaaggataggttaattttcattgaaggggaggcaggagggttcaacaaaggagttgaacgtagctgggacgtaagattagggcaggagtaggggcgaggattgggagcagaaagtaaggaggacagagaactttaatgggaggtagactggaaagtgggctggtgccagccctgaaggtcagctgtacaccaaactctgtagcttggtatacaatgacctctgagccaaccttcagggctggcattctgaaggtcattgaaggggaggtaggaggatttggtttgcggcagtttccaggtgagaggcaagaagtaaggagagaaggcagagatggcacaggatggtgggaagggagtccttggtgcccaatctctgccaggcagggtcctatcttgctaccccatgatccccacatgatgattgcatggagcagatgtcattatccccattgcagatctgggtctcctgggtccctcctcaaaataagacccattcaaaagacacctcctacaacacgggtctgaactacaggtctcccgaggccactatggaaggatactggcactcattcaacagcaaaactgtcccaaaacatcttctgtagacatctgtccctctccagcgttttgcttcttgtggcagttgttctcttttctccgtctctcacttctctctctactacccccttcttggatcccttttctcacaagagctctaggccaccatttcttactcagagtgacttcctgcttctctgatctgcccatcagttgccccagttagcaagatgaagggtcctcctcaggaaccaacctccttagaaagtattagaattctgtatgctccttattttatactctggctgggtcacattctaacaaggaaactgaagcttggagaaactaagtgtttctcaaggtgctcaacagagatgttttaggaagataaatggcattgacgaagaggatggatgggctgggaacaggtgctgaaagagaaggataccaatctatgacattttggaaaatacaaaactctagggatatagaagagaagagaagttgccagggctaagggttagggggtggcgggcagtttgagtacaaactctcatcatgaaatatgtttggggggtgactgacctgttctgtatactgattagagtagtggttacctctctgttcatttatcaaaacccacaaagctacacaaaaatgatgaattttactgtaggtaaacttaagaataatttttgaaatgacaggaagactggctaggaggttacagcatatgcaagaaggaatgagaggttgaattagagcagcagcagcagcaggataaaaaaataataaaataattttaaaaacctaaaaaccagagatctagggaagagagacttttagaagcaggattcagatatgtggggagtatgagtgaagaactcagatatgcagactttcagggctggaaagaatcttaagagatgatccaggaaagctctatctcacagatgagaaaaccaagttgaaaatgatttaagagtttggggctctgtctgggtggacagtgatatcattaagcagacagaacagacatagatgagcaggcgagaggaggaagttgatgagttcattttggacattttgattttggaacatttatgtcaccaagatttctttttttagtttttaggaatttgaaaacaaaattgttgggttttggcattgagtgcaatatctttccacaaatactgtttcattacagctacaatgaaaaagaactttgaatacagatccctacatgaagatgacacattagcttcttctgagttgtttttgttttgtgactttccttcagcatcacaaagagggaatgacactgacccagcaaagattttaggcacattatccattaacatacttgccacgaacactaccatattttcatgtgtttatataacaaagcttttccttccttattaaaaacaatacaaatcaagctttgaaaagcagttgttttccattcttactgatgctaggctataattcactgctgttttgttttcgttttagaatatttagcaagcaaccaagggaagatgggcattgacttgctattagtcagtaggcacagcctagtgaaagtttccatgctgcacatagggctgaaatcaaggagtcttttgtccatatttcagagcaacttggaaaatgatttggttcagcagtcaaggggagaaaagaagtagagttttcaacaccatcacagccattgggatatgcaaccaattttaagaatcagaaactcaagttgcaaactaccaagaaagcataatgttcttggcagcaaagtttaatcacagaagaacaacataaatataaagctaatagtatttacaataactgtctactgtttctttaagagctgagtaaagtgaatgcaaagatggtgagtctaaggaagaatctagaatgctggcacatttaggcagggatcttgttttgcttgctgataaacctacatgcgtagcacagtgcctggcacataataggctctcaatatgtaattgttgaatgaatgaatgaatgaagctaggagagaagtgaacaagtaaagtaagagatagcaaagccaccatacttcattcatccattcagcaaatgttactgagctcttactaatgtgaggcctttttttaaggcatggtggtggatatacacaagcctaaaataacaacttagaaaacagccccgggcctcaacatgtttataacctggaagaggaagaaggaaaagtatagcaaacatttgtatatcaaagtaatatcaaagagcatgtgacaaggcctggaaaaatggcacaaaaaaaaagaaaaaggctgaaaaggtggtaaagatttagaaatcagcggggtcactcccaacagggatactgtcatcctgaaggtgagatcagatctgggccttaagggatggagaattctgatgggaacagaatactctgggatgtaaaaacagcaggaaaaagatccccagaacagagaaggcagggcgggttcagagcatagcaatcttgctaaggagtagcagggaatgatgaagaaaatgtcacataggttgcagtgaaagatggagagaggaatttgaacagctggataaaggaaaatgaagacttacctaggaaaagaggagccttaaaataaaaaaaagggtggctcatgcctataaccccagccctcgaggaggccaaggcaggtggatcacttgaggtcaggagttcaagaccagcctggccaacatggtgaaaccccgcctctactaaaaatacaaaaattagccaggcatggtggtgcatgcctgtaatcctagctacttgaaaggctgaggcaggagaatcacttgagcctgggaggcggaggttgcagtgagccaagatggtcccactgtactccagctgggtgacagagcgagactccacctcaagaagaaaaacaatcagggaagaattttaattaaatcatcacaaagtataagataaactggagtgcggagaaactggagcaggtgaatgaattcccctagggaagagttaagaaggtggtggcagcaagaccagtgagggaggaatggagggcagtgaaggatgctgggctcaaaaacctgagcagaagctggaagaatgcaccctaggttttgagcctgggtgatcggaatagtgatgagagcaggaagagaaactgttgagtccaaggaaggttttggagggatgacgatgagtttagtcttggattaaatattttgattatgtgtttaatttgaactgccaacaggaagtccagatagaaagggtcatcaggaaatagtatataagcagaactggaatttgcagaaatacccatttgagaatcagctgcatacagacgatacggaagctgtggggatgaaaaaggtcccgcacaagagaatcaggaaaaaaaaagtgagacaatgagtcaagacagacagtattaaaggaacttcccaaccatttgctcaatgtaaaaatggaaatgaggcgaggtttgttcccttagaacatgtttttcacagcaaaagagaattcattcctaaaactggtttttatctcgagctaaagaaaacaccttaacactccattcatagtaaggaccatcacagtaatcctgtgtgacaaagctcaggataaatgccatggcaggaatttcacttgaatgagatagcaggatggaaggaaggaaacaggagcccttgctttggagagatcacctttcatgggctcagttcaggcttcactcagcaggaaaaaaatctgcaaggcttaaataagtacttctatttggtagaaggcaatggaaaagaataacctaattcatttaatctgcagttgccacagatacaaaaacaagagaagatatgaacactgtgtgggccgaatgtttctttcctactcccaccctcatcccactcggccctctttcccaggtcattatcaacatatttcaaaagcctccgagatggtgataaagcggctcaccatctgtgaactcctcctccacagaagagtgataggtctcaagaacaaaccttcctaccttagcatggaacaaaagcctgacttcaacacccggcacccacagctgttttccacgaatagaaagaacacagccaacccaactggctctttgaaggtacgccatccttttcctgtggcctaatttatgctgcagattgaaaagtgcaaaaaagcaaaaaatggataaggttttcacaagagttacttagtagatgctgattttcttccaatatcaaatgcttgaggcgcatatgattggcttccatttctctgtatttgtcgaaagaatctctaaattgttccccaaatgaattattattttgactggggacactgaagttcacggttatttttaaaaactacattttgcaaaaagttatcactcttcttaccaaagattcacaatacagtgttgatgggaacgtgacctagttggacagctaccttcagatatgcctgatgcccttcaacaggtcatcatttgcactagaaaccaatactcatcaagtgtcaacaggtccacagccccgtcctgaatcattcagaggaagttaaatacaagagtttgcaatttaaaccaaagtgtaccatcccaatctgtaaaagactcgggaacacatgaaagagtacaaagataaagcaaatagccttgagttacttagtttagttggaactatttttgtcacactatcaaccgaggccctggagtactcatgagtatttctttttttttttttctcaataaagcgggaaaaaatgctgaaagaattttttagatgtattcctttcttgtgttggaaagataatcttactgaaacaggaatggaatctagcttatgtctctctttcctattcttagaatcctaaacaaagaaatgaatgtctacaaggtggtttggggaaacagttagaagattcccatgggaagcaagttaaattgagagtccaagaagactagaaaccactttatatcagtgctgggctcacaggagagctaggtgataggagaaagggccagtgatgtggacagatcatgatagtgacagtgaagagagtccaggtaagacctaacgaatgacttaatagatcaactggagtggttttagtggataggtttgcatgtttctaacgacacagaaacctacaaaatagttcactggttttcagaaaaatactggaaggattcatcacaaactcctagccccagccaaccccagtgcaaaaaaaaaaaaaaaaaaaaatcatgcccaatccttcaaaagattcatatgtgcagggttattactctagacatcagcttgcctgggaccatcctggcctaccctattgtcccagaataatgattaataacaagtgtctcagcttggatgagacatgttatgatcatcttagatatgaaagaatggcaatctaataggttaatgaatatcaagacaaaatacctttagaaaggctttcctttctaattgtggttccagactttatacagcgcactcacacgtaccatgctagctgggatctgcactctggtaatagaaagggggggcttgcgcacagaaggaaatgggttcatgttggcaccacccaggtgctcagcaaatggacagcaaataaaccgtcgttgaagaaaggcaatgaaagaaccctcttcaccaatgtcttgaatgaatggttcttcagccatgacacatcgtactgaggaatggcttaacagttctccttgattctgggagtgaaataagtatgggggtaaagagcatcaggaagactcccactgcaggaaaccctgtgaagaaagtgctgaagaaagcgctctcccaccacgcattagggaaggagctcaggagctctctgccaactgcagtaggcacgggcccagagacagaagatttctgtggtctgggcacccttcctgctgctgcaggtgatgagtaataatagcgacggctctcatgtcacaacctggtggccgctggaccctcactttggttggagggtgtgtccccacaggggaagttcacaagagccaagctgggctctgagcttcatgcaacgtgcaagatgtgcaccaagacgacctcacccctggctggactcagccccgggacaacactcccaccccgcagagcccagccaggttctcagtggccccaagatagcacacaagcagctgggatgggaaaacaaggtttagtaatatgaaaccaaaatactcctccagcctgactgcactgcccaggatgaaattctctctaattccactgaacatcttaaaccaaaacatattcaaaccctgaacatcagcagcactcgtacttctcttttttggggctgtgaagggagggtggagtgctgcaacagaataacaattttcagcataggaaaatccccaatatgcaggttgtcacctgcttgatctattttcctcccaaccaagttaagcaatcaccaacagttctctatgagatatcttccactgagattaaaggaacgaccagcaagaaacagtgtatgtgttgtggtagtgtgagtgtgggttttcaaatgggtacattcctagaagacgggacagcaggctctgaggaggcagctttgtggaagagactggggtgtccagaggaccttggatatctggaatactcacatatggtgcttgttctggggctggggggagacaagtacatatagaaatatcataaccagttttctccagtaaatacaccaaaacaaaggaaaatgggatcaaagtatagccagcaacgtgaaaagtcccatttcaaaatctaaagtaagattccaaaatagaacatgttttaacagagtatgtaaatttatggaaacacttcctcacccggctcctgatcttttataggtacctctcatgcaacagttcagctttaaatcttttttaggaagcagctggctaccagagatcttcactcctgtgctttttttctctttttttttttgcaaatctagcatctcctttccatgtgatgcactatgcttggagctggcagagcaaaagcctgtcattcttaaaacatgaagagaataattcagcgccttattttgtgatcacagagaatgcaattaatactttggctgccttggtatgtagaccaaaccttctgccacagtgttttgcagtgctgttgtccagggcagctctgccaatcttttcattccaacagaaacgatgccagacttctcggtgctaagcaaagtataatgaggcggaagaggtggctggaaccctcagtgagggaatgtgctcctgggatgattctctacaaaatacaaagctatctcaagatccaatagcttttgtatccctgcatttacgaaacccaattaaaataaattctttaaaaagaaaaagtaggctgggcagggtggctcacacctgtaatccctgcactttgggaggccgaggccggtagatcatttgcggtcaggaattcaagactagcctgaccaacatggtgaaaccctgtctctactaaaaatacaaaaaattagctgggtgtggtggcacacacctgtagttccagctactcaggaggctgaggcaggagaatcacttgaacccgggaggctgaggttgcagtgagccaagatcacaccactgcactccagcctgggcgacagagtgagaatccgcctcaaaagaaaagaaaaaaaaaagtagttaaattcttatgtcattcatccatggtccaaaagctttttaattcatagaaggtataagacagggaaaatccttctaaaccgagaacatgcagtgatttactaaatcatatgagcaatgttggagaattactatctgtgtaacactagactctgaagataggagataagaaataattataatttggctgagttcggtggcttacacctgtaatcccagaactttgggaggccaaggtgggtggatcacgaggtcaagaccagcctggccaagacggtgaaacccccatctctactgaaaataccaaaaaaaaaaaaaaaaattagccaggcatggtggcgagtgcctatagtcccagctactcaggaggctggggcagagaactgcttgaacctgggaggcagaggttgcagtgagccgagattgtgccactgcattccagcctgggagacagagcgagactccatctcaaaaaaagataataatagtaataattattattattattataattcatagaaagtgtagggacaaggagaacagagagaaccaagaaagacaagtaggtataaatgtttttagatattatactacaatatgtatgtattggctatagttgcaaagaaatcctagacccaacttgtgtctgtcaagggccaagtgaatggtccaggccaatgatctcatttgccatagacctcagtgcccccagcacatcagacagcagaaagagcagcagtgagaagcaaaacctttataccatcattgatagcttattaatacaattcttgctgattctctggccttcgaaactcatagaatcacaaaatgttagtgagggaccctgtaactcaacttccccatttgcagatgaagaaatgaaagctcagaagagtatatgacatgcccaaacagcaagtgcctggcgggtcagaagaatacaacccaaggcccgttgccctaaatgtcctcaacaactacacagctctcacccatatccacctcctcttcttgatcaattctctcttcttccttagaactgcacctccccaacctttttcctaagccatccccaatgctgggtgactacctgggttggatcccttgcctctttggtccagggtacctgccttgtccttccatccctcaaggactaaacccagtctcaggattttctgacaggtgggatccaccaaccttgctccacgctgccaggaattttccctaacagtagttgactcccaacagaagaaaacgccccctggttgtgaccacatgcttgtctcaccctgaccctgcccttccccaatgggcctcaaaattcagcaagtcttacctttacactgaatatccactataggctttgattactgtgttttattagccagctgcagagcatgtttgtgtgtatttacatacacatgcacacagaaatacttctaagtgggctgtgttctatcatctttggtacagaaataaaagtaaatatttccatgcataaattttagtgtatttttaatagacactagaatagaagtcgaaagttctatttccaaccttcccaacccagctgtaatggtccagcctggcaagagttagaaactactgaagtccttttttttgagacaaggtctcactctgtcatccaggctggagtggagtggcacaatcatggctcactgcagcctcaacctcccatctcagcctcaagggatcctcccatctcagcctcccaagcagctgaaactacaggcacacgccaccatgattggcttaattgttttgtgttttgtagaggcagggttttgctaagttgctcaagctagtcttgaacacctgggctcaagtgatcctccagcctcggtctcccacagtgcggggattacaggcatgagccaccacgtccacccagaaactactgaagttttattcttggcttaactcttagggcaggctggcaacagtgacctcttacacttcagtatgctcacctgtaaaagtatggtgaggccttccctgcccagctcagcagactgacaatgggagccacaagaacatgaatatgaatgaactttaaaaagggctacacaactgtagctcattgaagaaaaaaggaaaggtctttctatcctcctatatagtaatatccaactatgggaataaaaaggtgaccacattgtgcaataaatggttagcagtctagaccagtgctgtccaatagaaatataatgggaaccggccccgcacggtggctcacgcctgtaatcccagcactttgggaggccgaggcgggcggaccacgagttcaggagattgagaccatcttggttaacacggtgaaaccctgtctctactaaaaatacaaaaaatttagctggggatggtggcgggcgcctgtagtcccagctgcttgggaggctgaggcaggagaatggcatgaaccctggaggcggaggttgcagtgagccaagatcacgccactgcactccagcctgggcgacacagcgaaactctgtctcaaaaaaaaaagaaagaaagaaatataatgggaaccacatatgtaattttaaatttttagtggtcacgtttagtatattttattaaactaatacatccaaaatactatcacttcaacacaaaattcttataaaaattattgataaaatattttgcattcatttattcatactacatctttgaaatccagtaaacctggtgtgtattttacactccaatcgcatctcaattcagattggccacattacgtgagcctggtagccacagccacggcactggagagggcaggagtagattttagacacaatgttatggtgtcacaccttggtggcacagagcagccttttctcagtgcctagcacagtgccttttagtgactaaatgcccaatcaagatgtgtaggatgagtaaatgtttggatatatactgtgatcgcagaaaatctgtagaataagaggaagaataaaggactttttgaaaaagcattagtctgtgttgaccttttcctgttcccaaaacacagaagtcttggctcgcagactgccaaagggaaagccgctgctcataatgaaattccaggcgtggcatcggctgatggggtgagccattccttcgcaagccacctttaacctgcctctctgtggacttgcctggcctctcaagtggctgcttctaaaagcccaggaacactgctgaaaacagatgagcacgtgtccctgggatccgtattcctgtgaaatcatttgcattctattaggcaaatttgcataaaattggagccaagagagcttggctgggtttccaggccggcactctctctctgtgctgctatggccaccagtatttatcaccatttaccagggtggtcgagcaagacagacccccaattagaatcggcagacaaatggaatctcttccctatgctgacatgaaaatcagtgtcctctggggtaaatgagtgaaggaactccgagctgcaatctggctgccgcatcctttgttatgacaagagtttattttacacgactctgacctatggcttgaaaacacagctcagtcgtggttgtaatgatccagaacggcacacacacctgaatgccaaggagctcagattctggcccatgggccatctgggaaaccaaactcaccacccttcattccagaaagccaagggcttcgactcctaaagcaaggtttaccctcaagggcctctcctccttttagctagctatgttgatggcaagctccaggcaaggtgcaaatagctacctctaaatgcacacactcatccctttctttgggacaaaggacaaaagtcaaatcacagtgatgcccaacctacccatggccaagggaacaaggtaaattacacaacagagaaggacaaaggtggaaggaaaaatacacagaaaacaatgcaatgctattttatattttgttatttttatctcaactacctatctctttctaggactattccccagagaaattccattttcattacaaaactagtttcttatgccagggaaaaggctgcggagctgttatcattgccattgttatttctactaaggtcatctcagatggcatgtctacgtgagataaatggtttcctaaacaggcttctctgcatcctgccaccacttaggtttgccccgagtcatcacttctggggccttgaaagcagcagcttcctggaaggctcaaaagctgggcggcagcagagcaacagaattaagggctccaagtactccaaaaccgcctgggttcaaattccagcccagccacccaaacagctgtaatgggtccccctctgcaagcctcagtgttctcatctgcaagacaaggataaaaacaccaccacctcccagtactgttgtaagaaagaaatacacgaatagtgatagaacgtttagaaagagttgggcaaagtacaggccatgtgaacctctgctttatcactgttgtgagtatagctggggtgtcactttaacacttgcttgtactgcttgtcatgtgtacccagctgcctgtgcattcattcatttagtcaatattactgagcatctattatgtgcttgccttgcgctaagcactgagtgttcagcgatgatcaactgtgcacaatcttgttgattctaccttagaacaccttttcaggtagtcccatcctgggagttcctactgcccatgccttggggcagctgcccagcaccttcacttgggcacctgaccccaccttcccatctggcctccttgctgccctcagtgccaccaacacactgctaccagcagtattttcatcaacaaaaaaatccagccatgtcacttagtatcctgctagaaaccttttactggcattccactgcaggaaaggtctaatcaaactccttagtggggcacatagagccttggagagcgagcctccactatcttcccgcttcatccccttccattccatccccaactgcctctcttctggtcactctggcctttttgccattcccaagcttggcaggcccttcaattactctgcttatttgcatatggtaccctttcacattctccagagagcaagatctcttgctttttttttttctttttctttttttttttgaacaaactcttatgtatccttcaagcccaggccaaacggcaccttctctgtgaaaccatccttaactttcccaggaaaaaactcactggactgtaatagatctgtttgtgtgtctgtttccccaggagactgtcccccccaaggccagagatcatgtccagaaacccagtaggcacaaagaatgtggaacaaacaaatgaccacgttttattgtacagtggtttcaaaatgaagtcaggaggcagagttgaggctgcaaagcagctcctcacaaaaaccactctatgcatcctgcagtgggggaggtggctcttctaaatatgtgtacaacttaatttatgcacagacagaataatttagatgcagtaagacagcaaaaactccccctagaaattacatccccgtccacttgagtcaagttcctactaattctctactctagaaagggaggtaggagatgaaaaagaatgaaagaagtcagcaaacgcccctgaaggtctctctgcctatttaacacacacacattcacagagaaggtgccatttggcctgggcttgaaggatatgtaagagtttgttcaaaaaaaaagagaaaaaaacaaaaaagaaagagatcttgtgctccttctctctctctctctgtgtgtgtgtgtgtgtgtgtgtgtgtattttactttgatattgctgggattcctctctttcactacagtctggactgaatcatttcacacaagtaaatttttcagatgactgaagcctaaacttttaaaaaattttaaccatttggaatggagatatttctgtaacttactactcactttccctgaactctttgactcttcctacagaaaataactctgtcttgatgactcagtggcatcattaggaatcactaagattgtcctgtgctacgatccagcgagaactccaggagccgtagagatctttgtgactgcctgccccacgcagaagagcctcagagactcctgagctggttttaagagcatttttgtcttcttccttgctgtcagactctaaaataattctttgaataatttacaggcctccattacctcctctgtcaggtcaattctaatttaatatatttgctgtttctattggctgggtggggagtggaaatgacaaccaattttttgagaaaatggacttttaaaaaagcaaatggtatggaatattattcagccttaaaaaggaatgaaattctgatgcatgccatgacatgggtgaactctgaaaatatgttagataaaacaagctagacacaaaaggacaaatattgtctgattccacttatgggaagaatcaaattcttcctcgaagagtcaaatttatagagacagaaaatagaatagtggctacctaggactggggagaaaaagaaacagggagttatagtttaatgggtagagtttccatttggaatgatgaacaagttctggaaacagatgtcagtaatggcttacataataatggtttatgtaacaaagtaaatgtgctgaaagccactgaactatacatttaaaattggtggaaaacgtaaattttatgtatatcttaactcacacacacaccacatacatacatacgtatgcatatttatacagatatatttttacatgaactggttgagaaggttggctgagctcttatgagcaatgggtatgaactttagcatatgtacttcatgacatccctctgcacagaaggggctgaaatgacttcctagttcctagttgtgattcacaccgtcatcaagaaacaatgatctccgaaggcgctaatgtattttgcaatcataaagatcttttactcacaaattacagtactggcgacaaacaggcactccgagcttcttggagaacattatgaataatcccaaagagaactgagctccagaaggggcggggctttgtccttttcacacgggaaaccagtgcgcctgtccacggcacagaatccaaatctactcttcccttctcctgagatcaaactctagaactaagaggtcacatgtaaagctgttaaaagaacaaaaatactgattatctgaattcattaggatcttaaggatatgtaaaaactacataatgcagtcttttaaatattacaatgttgggttatgtcttataaatgaaatattttaggtaatattggacgaatatttttaaagtagtctggtctataaaagagaggaggccaggtgtggtggctcacgcctgtaatcccagcactttgggagggaggccgaggcaggtggatcatctgaggtcaggagttcgagaccagcctggccaacatgatgaaaaccagtctctactaaaaaaaatacaaaaaaatgagctaggcgtgctggcaggcgcctgtaatcccagctactcgggaggctgaggttgcagtgagccgggactgcaccactgcactccagcctgggcaacaagagcaaaactccttctcaaaaaaaaaaaaaagagagagaaagagagaaagagagagaggaaatagttggtggcttgttcagttcaactaacacagagcctggggtttggggagcctgatggtgaactctgtcttgcttaatgaaaggtcactattgtccctctgcccgaataataatttcccttcctttttggcttccttatgaaataccacgaagctctactctaaaaagtcataacatgttgtgcccagggaagatgttgaattgaaattttttaatatgtgctttattaaacaaaccacttaaaacattatttttgtccttctgaagagtgacttattctgcacatgaattcagagtgagttaaatattcaacctatatatgtttcataacacaagagatatataaataaatgagaaagtaggggggaaaaagaggtttagtaaggatgcagtaagagtttcctatcttgtcagaatttcgcgtttaagtttcttttaagaaagtagtttcctggcccatgctgaaactcccttagccctgcaaataacacaagggcatcctgttcaaatgttattatggaaacactgtgctgttctgggccaaatgtatccaaattaaactgagggggatggaaataactctcccttgatacgccctggttgctgaaggtgggtttgtttttaagtagaataaaatgtacagctgaatataaaaacagatacatcctcatcttgtaaacctgagtgacatgtcattccacctctggactctagaagaaaaaaaacactaaggtcatgcctaaaataaaaagagtgaagggaaaaggatcataccagaggtaaaaccgcagactttccccacctttttattaaggtattaggcaggttacaatttgacagtgagatcatttctctggaaccaggaaggcactgtgggtttgtttttccaacgcacactctgacccctgtaagagcttctgaatcaggtgtctggtcttggtaggaaccagtgattagtacttatttttcaaaggctatttaaacagactctaggagtcaaaagggagacagaaaaaaaaagttgtttcatttattttttaactatgagagaacttaaaattacatgttgtaggaaagatttcaccttctagttattaaaataaagatgactaactggcttcctaaagaacccaaaaggtcacatgcataaagttgttcttttgtaatatgtttctgtttaaatttttgttttaaaaatttaagttccagaggacatgaacatcacttggattgcctaaataaaggatgctggttttgcctcttaccaggcaaagtcaattgactttgcagaacctctgtttccgcatctataaatccacttcctgccctcagggagaggttattgaggttaaataatctcctatccctaaaagtgttaaatccagggtctggcacatattggggttcaataaatattcatttccttccttcctcctgactttcggtgactgaggccaatgaccaatgttgtcataaatggaaatggggaaatgagaaggatgagtaggtaaggaaaagattgcgctaaacattttagccaaaaatagtaaaagtctctttaagttcatattgttcatggtaactcattttaaactgatgtaagggctatattatactaatacatttattatttttaaggtacaacactgttttcaactattaatgaagaaaaacccattaaatctcctctgtgtaaacttgtagtactgcttgaaaaatctcaaagaccaaggaagaagttaatattgtcccatcagcacccttgcactgcattgccctgttttcattactttgtggcccttatgttatattgttaatttttaagttgtttacttttctgacttcctcacaatgtgggattcacaagagatgggagagttcttaacctgtcatgttttctgttatagctccagcccctagaacaatgattggcccagagtaggctctttacagtaaacaaatatttataaatatttgttgattgaatgaacttgcagtaacatgccctttactactgcggaaaccctactgatgaaggctccaccattttcaacattcaaaaaacatgtaccaaatatttttggtcacctaaaaagaggagcccagtgttatttttttaattttatttagttactaaaggagatagtgtctcagtcaatgctctatgagcaaatttaaagactctgaaggacttcttcatatttattagtgtttgttcttttaatttttttgtttcacatcctttttaaattttttaaacttttaagttcaggggcacatgtacaggtttgtcacataggtaaacttgttggatgttgttatacagattatttcatccacccacgtatcaagcctagtacccattagttatttttcctgatggtccaatgcggcattttcttgggaaaagaaaaaagaaagatggaagagcaacatttacaggactacacttacgggcacttccgattaaagctaattacaacctttgaaaataataaataaggactctgaggaattcaaagaaataaaggcagcaaacagcatgctaacataacaccgttgctagtcaggtgtcaacaagcaaaaacagtcacacatgttcatctaattccaattggcccctgttgaaaggggctgttttacagggccttcaagtgttagagacctcgcacgtcaatcctactactgtcccttcagctcatgtccaagcccgcctggctcataagcgcatcctcacagggtcttgagctgatggtaggcaccaaatggaagcagctagatccccctctgctgcaagcatgagaaacgctgcaaaggctgaatcgaagaagggaaagtaaccagaaacaaaagactgcattccaatttccctgaacatttttgacacagaaagcagtagagtatactagttttcaaaatgcaatatatttcagtctctactaagcaatcttgtgtctttatgaacacatatccagagaagcagcacaggataaagaaatatctacgggattcccaacccagggaatgaatatcagctcttcctgtgcttattggctcgtacacacctttgttgggcgaactttcttctttacatgggcataaacaaataactaacagtgtgtgtggggaggaaagtagggagaagttggaatacaatatctgccttgcttagggttgttgtgaagatcaaatgggccaacagatatggaatttttttttagaaactttaaaatcctacgtaaaggcaagaaaccactgtcatttttttcacccggaaaaaaattctatgaaaactgcctttcataattgaattctttcctcaaatatacttttattaactgatagttaataaagatttatcacacggtgaattctaacaaaaatagtttttaaccagacaattttttaaaagtgaaataagaaaaaatatatatttgtataaggtcaggtgaggtgacccatgcctgtaatcccagtactttgggaggcggaggcaggaggattgcttgaagccaggagtttgtgaccagcctgggcaacaaagtgagatcctgtcgcaaaaaaagataagacagacattatctaggtgtggtggcatgcacctgtagtcccagctactcaggagactgaggtgggaggatcacttgagccccggagttcgaggcagcagtgaaccgatatggtgccactgcactccagcctgggcaacagagcaagaccttatctccaaaaacaaacaaataaacaaacaaacaaaaaacacaaaaaagcatttatatataaccagaacaatgaccacattctttccaagttgtacagaaagaccagcaaagctgaggaagaactgagccatgttctaaagcattcagtcaatcattacctcttccaaaaaatctctccactctagtcctaatcattgtgcaaagctagcaatttcttgccgttcccactaccattcctctaggtcaggcacttgatctcttgcccgtttgctgaaagagccttctatctggtcactgatttctcccccgtctcattaacggtctggagtggagtcagggtgacgtatctgaaacaaactcttccagggtgggccacctctagcatcatctttctgacccacccacttgcactctccactccagccaggctgaactcctcagctcctgcagtccaccatgtggccgcttgcctctggcctttgttcctgaagttctgcctggggccacacttggttcctcccacccacttcactacattgattcctgctcatccttcaggcttcagtccccttcctgggaagacttccttgactccaataaatgccaccactattgctgcatctcttctcatagctttaaacatgctctcctgcagctgatgttgaatggtcttcactcccccagaccaagcttgtccaatccatggcaggctttgaatacagcccaacacacatttgtaaactttcttaaaatattatgaggtttttttgtgctttttttttttttttagctcatcagctatcattcgtgttagcgtattttacgtgtggcccaagacaattcttcttcttccaatgtggcccagggaagccaaaagattggatagcactgccctagactatcagccacgccgctctggctctcacttcccacttccccagggcctggctcaatatttttttaaaagtatggtataaatgaataactgatctcttgttctgtctgctttaatcatgtgactgagtgcaaaaaaacaattacccacttaaaaacacagagatgcaagtgaatcctttgccataacaatgagcccactctttatcaataccctgttgtgccaaacaggtagagaggttttaaaaaagagtcaagtatcccaactcatattaaatttccccatattctccatattttaaaagcactggtttagtcatgggtgatgccctttaagtattccgtacaaaaggtattttcaaattccaatgacatgtactttcatcggttaatttttaattgagccaaatattaaatgttcacattaaccagacaaagcatttttagctactgatttgcagtgacagcttgtgttattctcacacacaggccaagcatgaaatagaaaactaataaccccttaactgtattctcaaagtatcatttatgggaaagaaaactacattcaaaggaaacttgtgcaatggctgtcatttttttccctgagccacaagctgttacaaagcaggagagctcattttctcacagatacggacaagctcaagaatcccactgtcactggatgtattcattaagaaggaatctggcagcagcacaggggacagatactttggagaacaggccaattatctgggtgtcctttataatttgaagtttctgaattcactcatagataagctgcttgaagagggcctggcaatgggaacataatgcacagatggccactgaagaaacaagagggaggaagggaggctggaagagagaagagaatttgcttgtggtttcattcatggggacaaatctacaagctgacacattcatctttttaaaaagcccctggagaagtatggtcaagcttcactacaagtaaacaaatcaaaatctttctcaaacagatgacaactgatgagcaacaatgctttgagtttgcttcatgctaacggatgagggttctcaaaatacaaattccatcagttgttaaaaccacagataggctgtgatgctggcttgaaccagaatagagaactcagccaaaagctgccaggccaatggttttatgtaagacatcccaggtggtcttcttgttgagcagtgtctttagaaatggaatcttaggttctgtcgcctctgggaatgccgcactgtactgacttccaccttcaattggctgcttatttttatgggagaagaacgaggggatcatttatccttgtgacttttgtgctgcagttctttttatatttgagctacaacactgatcagagttaaaatccaccttgctcccactgtgagaaccttgggccagccctgctttctataatgatggggtgatgaataatctcagccttcaaaaccttttcagtctgggttaggcttgagatgtgaaacaaaaggaatgagagcaactaggcatatgtacatacactgtgtgtctacaaccttcgtataaacagatagaatgtgacaaccagcaggctggtatctatattagcattaaggaccaataaatgtcaaatgtttaatatagagcaaaatctagatttctcttcaggaataaatgatatactttttcaattcaatgaaaaggatgaaatcaaaacacttaataggtatttttcttctttcatttctattaaatattaatgaacctgtaggatgggacatttcagacacacacacacacacacacaaacacacactataataaaagaagtaggagaaaattagctgcttaggatgaattgctcagaatgccctaacataatcattttattcattcattcaataaacagtcattgtgtgtgcctattacctactatgcttggtgccaggttgaatttaatagaagaaatattttattaataaggaagtctcaatgagaaaggacaccttgattttgtaagacctagagtcacacatagaggatactattaggatatttggaacaatactaatttgactcaagttgaagtactcattaagttggcaaactggtagtgggaagccaagctttgaacagcaaagctgcaggttaaccaccttaacccaatccatgcaagtctacagattacctttgggaaaaggtggggtgcaaacaacagtcgcaaactaagacagcatcagcagtagcatttaggaccacttagggcaatgaaagaaggcaaaagagaaacctacatgattcgaggggaaagacatattatggttcaacctcaatttttctcttgagatccagatccttatgtctaaggcttactgggcatttccacttggatatcctactggaatgtccaaaatgaaattcatcacatgtacgccacaaagcagtaactgttgttatctttcctttccctctggaagacagtatcattttttgaggcagccaggatggcacttgagtcctgattctttccctccctcattcctcacattcgacctgctgtcagtcctttgattctacacgtgcagtgtgcccacatctgtcctgtcctttctgttccaggtgcttcagacctcatacctggtctcccccgtccaggctcagtcactgtcaatcttcctcccacgcacacatcctgccttgtctgagaacctttgcaacatcctttcaacatccctggtacagttaaacgcagccatccttcagtaacctcaggggattggctctaggaacccccagtggataccaaaatctgaagatgctcaagtccctgatattaaatgagtagtacttgcatatgcacatcctcctatatactttattttatttatttgtttgtttatttatttattttttgagacagagtctcgctctgtcccctaggctggagtgcagtgacacgatctcggctcactgcaacctccgcctcctgggttcaagcaattctcctgcctcagcctcccgagtagctgggattacaggcgcccaccaccacacctggctaatttttctatttttagtagagaaagggtttcaccatgttggccaggctggacttgaactcctgacttcaagtgatccacccaccttgagctcccacagtgctgggattacaggcctaagccactgtgcctgccctaccccatatatttttgatccaaagttggttgaatccatggatgtggaacccaaagatagggagggctgtctatacaagtttcacaacttagtatgcagtggtaagttctcaaaactatggatttatctcaggagagttctccatgccccagtcaaatcagactctccacaattccccaaacacacctcccgcattcatgcctgctttgacgcctccagtttccactacctgaaagaccctctccccgtatcgcctgcctgttctctaaaacttgtctcaacattatctccggcatgaaactcttcagataccactgtagctgggttgggcctctctgtctactacacattgtccaggattacagtgatttgtatccttgtcttggtctcctactgattggtaagttccttgaaggcaaaagttatcttagacattttttcgcttaactaaaacacctagcatagagctttgcatggtgtagggcctcaataaatgtttttttcaatgaaacaagttagtgtgcatgttttcctaaataaccagattctaaaacccctctccatgaccatcactaccccggttcctgggaacccagggttaagttttgtggacaattgctcatttccctcaattaggacttcttcaaatcattttcttcttatactatcactttaatgtttagtaagtggctttgtctccctgttcttataattttgttataaaatacctcaaaacctctctgtgtgtcttcagtgtgtgtgtttttaaagatgctggcaggaatccataaaggatatggctaggagatagccctgaaattttacatccagaaatgccaatgctgccatcctttatggactcgctttttttttttcaagaagataaatcaatatttaaagctgatgatataatttgtacttaattttattcctattttaattgtaaatcagatatcaatatatctgagatatagcattgaactaagaagactaagtttatgtgtctcatgttcttttagaaaattctaatgcagctgagaggaatatttggctgcaattcaatttcagagttaatatagagatatagcattcatcatgttgtaaagcagaaaaaatatcatcctggttatctgctaaggagagctggaaaaagtcaagaagagacagcctgcaacactgatcctttgtttggtgcttcaagtattaaaattggtaaactcaccatactctgttgcagcttaactgtcttttcgacagttaaaaataaggaaatatggtaactggatctgtcacaagaaaagatgtattggtctcaatggagaaaacctcccctgaaaaattaaagcttcacttgacacagtgggttctcgggttgtttttgggagacatgataatgagcagagtggagtcagtcatcagtttctgactcattacatggaagccccagagagctgattattaactaaaaatggaatacgcttctatccctgaagttgtgaaggcaaaacaagaagcagaatggaaacacaaatttccccattgacgcatgtggcccaaacgcgatgctcaagggcaggtgtcttccacagttaacctgctcatggaatgtggttgatcgccccagaaaatcacccaagtcactctcagtatattgctacaaatggccataccagtatgtcagggagattccctttctcacatgtttaaaagggcgtttggggaagtagtccttaccctaagctattttagtttagttagtcaaacatttattgaagtctcaggtataaccccactataatcttgcactagaggaatcaaagtaagtacaaattttgccagcagatactatcttttctctgcacaggttaaagtttataatcactagaggaaaaggatagtgtctggtcacagaattttgacctgcccagctgcctgcagcaagtttggggtgagggttatcctctcactttgattagactccccacttctgctcccttttgctagtatctaagcgcattacggttttcttcaggtaaatcctacccatcactaattggaagttaacaaggagctacacctgagaggtccctcaccggtggaatgataaggcaggtaggggatggtcacaggggtggtggcacctatgagaaagtcccatggcttggaagagagaggaataatcattcaatccttattcacactgaaggacagatgggtgtatcttttgtctggcaaatggagggcagagaaatagtgctatagcatatacagaattgggcatatataagaacaacaagtgacaatctataaaaatatgtttttaagtgaaaacagctttgttggcattttgaaagttttacagtctccatttaaacgaacagaccacaagcccaaaaaagtccgaaggcaaatgccagtgttacaatggactgtgaatttctgtaactagcatcgtagaagtgtcttgataaatagaacagtaatataacctcaaaccaaaacaaaacagaagcttttttttcccctgctcaaaggaagagcccccgctctggttcaaaacctacttgtattttttggcatacaagagttatttaagaaagatagttcttcaaattaccctgttccagtcagtctaatcggagccttgattgtcttttacttaaaaagaattaatgaaatgctttagaaattgtagactggtgtttattaagtcttcttagtatgcataaatagtgcttagtgggttaatatttaacaagggaactccccctgcctttcagttctcttaagcatatgtctacgttacacagtattttttaaagtatctacattttggccctgtttaaattaggcctaatgcacacatgaacagccatatggtcagaaataacgttcttagaccaaggctgaagtacatgcaaaataacttatagttatttgcttttttcctctaagtctctgagtctaggatcatgcttatcaggctgtatgataactacgagtttattaagatgcctgcaacactagcctgtgagtttatccagggcagaagcaaagctctccttgccgtgcctccaacctaacccaaggcaggactcatgtaagactggcaatcacatctgtggaataactgtcagtccttggatgattttcatcattaatcctgcttagacatcaaacattaaggttgattaagccaaaccaagagggatgaaagagaaaattcacagtggagtaaattcactgagtggtctcctacatgtggttgacagaaaggatgaccagattgacaagttactgttatacctgaataaggtgatattagattaccttaaaaaggttgaacagaacctttgaatctcaaatacaatatatctctgggggaaaaagaaaacgttctacttgtacactacaaagacagtgttgttttctagcacaaatgcacttctgctgagatactgctttgctaaactactgctaagacacaatgagtgaccttagaaaagggtgcggaggtatgttgggtgggaagaaccactgttaacatgcagcacccacacactcgctcatgagtgggcgtatcatccctccaaatagcgcaataggactgggaacagagataagaaaaaacaacaagaattttgcttgccttttttttatttttaatttatggctttctgttacctggtatgctgtgtggcctgatgacatttaagtaatctgaaatgtaccagttcaatcaaagattgctaaaaagggcaatccattcttattagaaagtacagctgaaagtaacagaatgcgcaaaagaaagccatgttttcaatggacgttaaatagcaacaaaacagaaaagagaattcagttaactataaaattttatgaatgtccagaaacaatcacaccacagcacatgactgaaaactctatgagaaatagtgtgtttttctctactacataaattattgaaaggggtcatgtgattcttgtaggcagaaagatgcactttcccaaggaaagttcatcatgaaatatattatttaagactagatcatcttcaagctatttttaatcctatcgtcttgctgccaaaattggccataagcagccaatcctcagacactagaaaaatgatgctctttcatgtaatttgtacactggcatgagaatggtattgctttccagttaatcaaatgttttgctggatgtggactgccttgagaaaggaaaaactgcttgctgactaatgaaaaggcagctgaactctaccgggtgtggagaagttcctgtcttcctaaaccaccaacaccaaaaaaccaaaaaataagtcggattaccatcttgtcaacagaataaagccaatctcctacaatctcttgtctgaatcatctcattcttctagtggctcctatctcactctctcctaagacatgaagctgaatgtcgtcacagttcccagtttagagggtcactctccatcacctgcccaaaactcaatcccttgcctgcaagagtccctttgtcttaaagaagctgcaaggtcactaaagtcatttacagaatttaaactgtgttatgaggggataaaataataactaacagagctattaaaagagctaattctcttgcctttaattgaagaaaagctatcttactttttaatgggaccagtgatgccaatataaactatataactactacgaaaaatattcatgagaagactgggcttatagttgatctacctgcttgctatctctccttcatccaatttatgtcttcctaaagtcagatcacaatagtggacacctgggaaatactcggtattccaagtaacactatagatctttaaggccactggaaggggacaatgcagaatccatcccaggtagcaactcttcctaaaagatgccaccaggaaccaaggatggtagccagcatcgctaactttaacgtgcacacaaaccacatattctgactcagtagctctggggtgggagctgagctttagcatctctacaaagctccgggggatgcatgtgctactgtctataagccacactgagcagcaaggtatccacattttctagaattgcttctctctcactgcttcctctgtcctgcctctctctggatgccacacaatgccttattcagacctaggaataaatccacactccactctacagccaattacttctttagtctttatttaatttgtagtcttctgggacaatctatcagaggctgatcattccaaggacctgatttatccatgttatggaacacaaaagtcaaacagatttcctcagcctcacaaggttccaattttctacgagcagcagcaaagaaaaagaaatgacttgcagtctaaagcctggagtattcagtgtagtattcaggagatgggctaatccacggagccctggggacagtgcagattattgtcacatgccaagaaaatatgctagctctcttctgaagctttaccattaagactaccttacactataaaatacaacatattattagagatgtaaccccaattggtgtaaatgtgaagaaaatctgtctgtatgccaaatgcctaaaatgacttttagattaataatgcacatttgaaatgataggcaaatcattcatcattctcaaacactaccacttttattccaaagtgtcctatgagtgcatttcctggtatatatatatattttttctctaaattcctttgttttcctatatagtcaccatctatgcattgttctgaaagctattacatattttaccatcaaccatctgtgcttctacatgatttatttttactagaagcagttttgtcaaaaaatttttatcatgttctatggtatgtcattgtggtttggcatcataaaatgtagcctctacatttatcaacctcagatacctgttgaccacaaagataggtctactatgaaaactctgtttcacaaaaagaaaaaagtgagcctttacttaaaaagaaacttcagttacatgagagggtaacacactgaaattcagcaacaaatatcaaggttgtatcttaatttctgtcataaacatgtgtctctgtttcccacatttttattaacttatttgatagacagataccagttaccaccttggatttatttcaagtagaaagaaaatttgtaagtgtgaatttttcacaaaaatgtgaaatagtaaaactattaaatcagttttactttggtttaaaaggatcctttgggaatctggaagtcccaacccctttagttatagtgattaaaaatcaaaccacctacttaaccaaatatttaacaaaaatattcttttcaccctttagcaaattcttccagaattactaaagatctgataatgtgagatctcaacaaacaaacaattcaagaagaggatttaaattttagaaatttaaattggggcattttagttaatcttacttttaaacaccaaacagtggcatcaatattttgtcaactttggtcaaataagatcagatgttcacatcaatcatctacttttcttggccttttctctatttggcctcctagtatgagcacactttgtaaaatgtaataaaaacatgtggtgtgcttcttgacatctaatccacttgcagtaatttctaggctttttgctcctgttaggtcctataaaataatgacattagtcattctcccaagaggctataaaaggaagcactgaattgcatcctgtttttcaaagataactcttcagattaaaacaaaaagtgtaaaaaaaaaaaaaacttcacacaagaattactttttcataaattcatcattttagatatgagatatagatctccattacaatccttgactcttaggaactaaaccccctccaacaaagaatctcagaaaagtacaattgtatggtataatgatgaaagctctatctagcacagtacgagaaaaagatcatctcacaaatgttcttcaaagccacaggtatcaatcacttcaactaaagtaagggtaagataatccacagctaagaatcaattcttctacactttacatagatacctagatgcaaatttttttcagccgaccacaaaattaggtccactctgagtggtgaaaaacaaaagattctaacattctagcaaactggtaaaccatacacaaattatagaatacaaagaatgcagccgatgcaaattctgtcactgacaaggtagcaaagccatagcctgatactcctcaggacacctcatcacgcccactgggaacatggcacacactggagattccagtccaaggactttggaatgtcaacttagctctttacaaacacaactaagtttttcagggaaaaagacttacattggttttcctcttttggaaaattttaccgattgatgatgcccttggtcttctgtggagtctattcttctaatcgggttgttctccaattttagtgtacaacgggcttgtttcaggggagcttgtttgggatgcagactgtcaagacccaacctggtatctggttcataagcagtccctgaaacctccctccggttccaacaagctgctcaagccaggaaacggtggtcctggggactcctggaccttcagcttgagaaacactgaaggggtaccatttaccaccacatcctactggattacaaacgctagatctttggatctccacgactagcaagcaagttaaagacttttagatggcaggcgttatcggtcaggttgggagtgaacgctttgtccagaggaggaggtagggacgccgggaagcaacaactctgattttatttcgccggctccacagcctcccattgccccaggagcccacccgcactccaacccccgcatctcggacctgtggcctcagcccagactcacatcaccaagtgcacctacccagcctccgttatcctggatccaggtgtgcaggtgccggttcaggtactcagtcatccacagggcgatgttgtccaccaggggcgacatctcccggttgacgctctccacacacatgaccccaccgaactcaaagaaggccacaatcctcccccagttcaccccgtccctgaagagctcctccaccaccgtggcaaagcgtccccgcgcggtgaagggcgtcaggtgcagctggctggacatctcggcgaagtcgcggcggtagcggcgggagaagtcgtcgccggcctggcggagggtcaggtggaccacaggtggcaccgggctgagcgcaggccccgcggcggcgccgggggcagccggggtctgcagcggcgaggtcctggcgaccgggtcccgggatgcggctggatggggcgtgtgcccgggctgggaggagaagatgcccggtgcgggggcggcccccgggggcgcggcgcccacatctcccgcatcccactcgtagcccctctgcgacagcttataatggatgtacttcatcactatctcccggttatcgtaccctgttctcccagcgtgcgccatccttcccagaggaaaagcaacgggggccaacggcacctctcgccccagctcccaccccacggcccccagagaaagaagaggagttataatccagctattttattggatgtgctttgcattcttggacgagggggtgtcttcaatcacgcggaacacttgattctggtgtttcccccttggcatgagatgcaggaaatttttattccaattcctttcggatctttatttcatgaggcacgttattattagtaagtattgttaatatcagtctacttcctctgtgatgctgaaaggttaaagaaaaaacaaactaataagtaaaaaatcaggtgcgtttccctgtacacactgagtgaaagcagggcatacacactacaagtaacacggctaaaaagaatgtattaagctgcctggaaattaaatttactcgaatgcactttaagtaaaaaatctcaaaggtttccattgaaagttacattaaaccaatttcctgtgcagagaacttacttgtattttttaagtacagcatgatcctctgtcaagtttcctttttgtaaaaccaaaacaaatgcataaggcaacgatcccatcaatcttcagcactctccagttatagctgatttgaaacttcccaatgaatcaggagtcgcggggagagggagtaaaaattaggaggatttccagatcgattcccagacttctgcttcacagaaatgtcaatccgcaggaatcccaaccggagatctcaagagctcgagaaaaaaaaaaggcagcggcggcggcagatgaattacaattttcagtccggtattcgcagaagtcctgtgatgttttccccttctcggcaatttacacgcgcgcacacacgcgcgggcacaggcatgaatctctatccacgggaccgcttcacgcctccccaggagagagacaggggagaggggacgatgaaggagccggggacggaggcaggaatcctcttctgattaaactccgaacagcaaatgcattttccgaaaagctgctggataaatgaaggcaggacgcgcctggcccgccggtgccgagcgctagaagcccgcgctgtgtgtggtgcggcgaggggtggggagaaggaggtggtgggggagggttttattttttccctcttttcctaaaaaggatgactgctacgaagttctcccccctggaccccctcttccgctgcaccccaccggcgcaccccgcctccgggctgcgcaccctttctcctcctcctggtcctgcgcggcggcgctggctacggccgcctcccggagctcccgccgcgcagcccgctccgagcgctgacggccgccggcagggagggcccggagccccggcaccttcgctggcagcggcggcggcggcagcgcggcggggccacggagagcggcgggcgggagcgcggcgggcgggcgggcaggcggcgcggaggggcgggcgcgggaggaagggggcgggagcggggctgtggtgcctgtcctcttacttcattctctgcacagcccgaccggtttcctgtgcgtaacgtcacacggttcattcaaaaaaagaagaaagaaagagccctcctctgagccacccgaccgccccctccgccccgctccctggcccgggttaaaggcgccgcggcaggcccgggagtggcgcgtcccgccgggggcacatggcgcgcggggccgcggccggggagggcgcgtccgggccggccacccgcccgctccgctgcgcccgcggggcccggccagtgggtggcgcgggcggcacaggcctcccgcgcggccgcggcgcggtgggtgtgcgcggggccttctgctcaggcctgcggcaggccgcgtgcggacttggtggtcgctggggtccgcgacggggtgggggctcccggggaaccgcacgcggccgggccgggcggacgacggagtgcggaggggggcggctggcgggagggtgcgccatgaaaacaagggctggaaaagcgccgggaaccgcctggaccctttctggccgtgtgagtgtgtgtggagtgtgtgtgtgtgtgtgtgtgtgtgtgtgtgtctcgcctggaccttttctagccgtgtatgtgggagtgtgtgtgtcgcctggaccctttctagccgtgtatgagagtgtgtacacgcgcctacacacacacacgttgtgttaccggcgctcggccgccgggggaagacccaggccaatgccgccccccaccgcccccagcagtgggacctcagcgctgccctgctgtgaagacaggtgactctgcacgttttaagcaatgtctagggacgccccgagcgtggtgtttactttcaagtagcttcctaggtgtccgcgcactacacacgcacgcgcatccccgcccgtgtccacctgaacacctagtccgtggcccaggccatgcagaactcagcgctccagggaaggggtttatcaagggctttacgacagtttaagtcaatgttttccctctgtccctaacaccttttacactggtttagtgctacacgatgaggacttccatatagtaactttcaggcccaccgtcctaacgctggggtgggtgggctcctaaaggtctccacctttgcctcgtagccaatcctagttggccgcactttctcaaatgaggtacatagatacacacatacacattcacactcgcagacgtgtgtacgcgcaagcagacagttttaaattaatcagcatgaatagcccctagcaaaaaaggacaagaggacaaacaagttgcacgtgtgtatttttatctccaagagtctttgacaaagcaccaagaaaagaaaaaggtcttctagaagcacagcggcttacttaatagggctcgagtgcaaatatatagggacactggattattggggtcaagaaagatgacaaatgagtactacaatgtgtacaaatatgctatgactttttttttttttttgagacagagtcttgctctgttgtatcttggaggctggtgtgcagtggtgcgatctcagctcactgcaacctctgcctcccaggctcaagcaattctgcctcagcctcctgagtagctgggattacacgtgcacgccactacgctctgctaatttttgtatttttagtagagacggggtttcgccatactggccaggctggtctcgaactcctgacctcgttatccgcctgcctcagcctcccaaagtgctgggattacagacatgagccactgtgccctgcctgacatctttattttgtctcattcctactctaaaatcaaaacattctttaaaaagccagaaaagcacaccaaattatgatttttttaatttttacttagttggccttttttttttttttttaagagatggcttttgctatgttgcccaggctggactcgaacttctgggctcgaaggattctcccacctcagcctcatgaatagctgggactatacgcactgccatctctcttgggtgtttttattttatttcttcatttattgtatcccatcagcccaacaagccaacttctctcacataggaatgggggcctgggtacaaatttcttatccaggcaagaggggatgaaaggagatcctccttcttgcccttctgatggttgggacagagtcccttttatgcgcgtgggaggtgttttggtctggatagacactgggtatagattgacctagaataaatgttctcacataaattcataccaattgcacaacagtatggtttagaaatcttgaaagcgtattttaaagccccaaaattacctaagaggaattgaaaggcttcaagctcctaatactcagcatatgagtgaggaaatgataggacaaacctgcaaaagaaactgtacttctgcaaagggggcagccagaaggaaacggatcccctacttccagagaaagaaaagctgactgattttcgtcttcctttgctcccacagagcctcactctatggattttcccagactgattccttatgtggcatcttggctataatcagtcttgagacaggtctgtattgcagtctttggctaggggttatattttccctgggaatgttctagatactctttcaaatgaaagagtgaaaccattcctgcgttcagattccatgtttattagattccattttaaagcataagggcaagtattcccaggaagtatgtgacattgactactcgtctttgggcaatgctgaggtgggggagggaacaccagcctgaggcaggagtaactggatttgaatcctagatctatgcctgagaccttccaacaaccttacaaacatatgcacagtggacttttcactttccaagatgttttctacttgtaagagccaatggatgacccttttggcagctttacctggttggattctacaagtagcgtggcaccaggaagagaaaaaaaacaagatgcagggaatggagattgtatcaagagtctgaatggcctgtgttttctttccgtcttcattccccaggccaccaaacaaaaagcttttgattgccagttttcgccacctgctggttgtttcacagcgttactctcttcatccatccaagaaagttctttcatccatcatcaatataaatattctccaagtttatgaaattcaaaaggtacattattctaacatgaacatactaatgtttaatataggtatgtatcggccaggtgtggttgctcatgcctgtaatctcagcactttgggaggctgcggtgggtgtattgcttgaggccaagagtttgagaccagcctgcacaacatgacaaaactctatctccacaaaaaatacaaaaattagcggggcatggtggtgtgtgcctgtagtcccatctactctgaaggctgagataggacgatcacttgagcccaggaggtggaggctgtagtgagctgtgatcacaccactgcactgcagcctgggtgacagactgataccctgtctcaaaaaaaaaaagaaaagaaaagaaaaaaaaaatcatgtgtgtgtatcaaatcttcccagctagtaaactttttattgaaaatgtgggtagaatgagactattaactgaggatattgataactaataggtcagatggaagagtaaaccatggccccaacctgaaatggaaattaatccataaataaaatgagctgactagagagaataaaaacaagtagtccatatagtttgcataaaagaaaaatgaggccgagcgcagtggctcacggctgtaatcccagcactttgggaggcagaggtgggcagatcacctgaggtcaggaattcaagaccaggctgaccaatatggtggaaccccgtctctactaaaaatacaaaaattagccaggcgtggtggcggggacctgtagtcccagctactcaggaggctgaaacaggagaattgcttgaacccgggaggcagagattgcagtgagccaagatcatgccactgcactccagcatgggtgagagagtgagactccatctcaaaaaaaagaaagaaagaaagaaagaaagaaaactgcttaaaaaataacttctcagccgggtgcagtggctcatgcctgtaatcccagcactttgggaggccgaggtggatggatcacgaggtcaggagatcgagaccatcctggccaacatggtgaaaccctgtctttactaaaactacaaaaattagctgggcatggtggcaagtgcctgtaatcccagctactcgagaggctaggcaggagaatcacttgaaccaggaagtcagaggttgcagggagccaagatcgcgccactgcactccagcctggaaacagagcaagactctgtctcacaaaaataataataataataataataataataataataataacttctcataggcttagattagcaatccaaaatgccagtttccaatttcaagaatcttatacattataaatttgtgtggtaggtagtgccatgctctttcaaatggtttgcatacattgccagcaagcattatataagccccagtcatgctttttttttttcccaatcacttttgcttcagagcctgtcttctgccttaagtgatcacatccaagtcatccactctgtgcctgaaagtcattcttgtcataaccaggaaactctcttggtttctaagttaagccttggtttaacttagaaatccacctaacttaactcacctaacttaagtggaacctaaacctaaaaacaagacaaaaaaaatcggaataattaagcaataatatttgaagctaggcaatgagctacaaataaatcattctgctgtacaagtttaatagtgggcaaataatatttacttttggtttacaatggaaagcatagcaaattaacttgtgatttttttttccatttctaatcaataacttggtgtttaaagtgaaataagctaagggtaggaacttgtccatttttcagatgcctactgctctcgttggactgaaactgcagtgatagaaccaaacaaggtataataccatagtaccgggagggctgggtgaataatttacattcttacgtgtaataactaacttttattctcttatgctatttagcacacagcacgtctccaaggtattaattgatagtgaacacaattctaaactttaaggttaatatgtttcctagaactgccatgacaaaataccacaaattaggtagcgtaaaacaacagaaatttattctctcacagctctgtgggctggaagtcaaaaagcaaggcgaaagcaggcccacgctttctctgaagctcgggtacagtctgttcttgcctctccctagcttctggtggtggccggcaatccttaatgttccttgccttgcagcctaatcactccagtctctgcttccgccatgacctgtggggttctgttttctcccattcttctgaggtctccagtcataatactggattcaggcccatcacagtcacctcatcttaacttgatcgcatctgtacagaccttatttccaaataaggtcatattcacaggtgctggggactgaatttaaatatgttttggggtgacacaattcaatccatcacaatatgtatctaatatgacatttttaaaactaatgaggatcattgaccccaaggcctaaagactcagcaatattagaactgagtttcaagggctaccgtgacctctctaaagctaaaatctggctatttcatatttccactcaaagttcttgaaaacctaaaaatcttaactcttcacatggcatgatctggcccaatcctttgccacccccctccctacccctcatctcttccttttcccttcttgcaactatatccactttttgtggtttctggaatatgccaaggtctctcacgtctttcgcttttgcacatctgccggtctccctgaatggtacccagctttttcacctgacaaattcatttctttagttttggctgaagaatttcttcctctgtaaagccatccctgctgtttctgggccgtcttaacattccttctgtgctgctagaagacatttagtacggggctagatgcctaaaaatcagaatcaagattctcatcctggcttcaccattgagtagctgtgaccttgagccaagtatttaagctttcagtgcctgttccctcatttataacatggaaatataagtagtactattcttggggttagcttgtgatttcattgagttaatacatgtaaagcactcacaagtgactggtacctgttttcagtgttggttatggtatcttaatcaccgctattctcagatcagtgtaatctctggcatatatccttctcactagattataaactattcgagggcagggatcctatttttccttggagtctttccagcttagaacagtgcttagcatacaaagatttgaagcctaaaattcagaggctccaagccaaagaagaaaatggggaatggttcctctttgtctaagagacttgtaaggatatagcagagccatctgagggatgaaggatgggagaaggtgaagaaacaagaaaagtaattgccatgaggaaggaacaagttgttgatatataattgtatccccagcacctgataccaagctcatcattagtacccaacaaatatatgatggatgaggcaaaatggaggttataaaatcaggagtgtaacagaaatcaaaacataatttggggttgggcgtggtggctcacgcctgtaatcccagcactttgagaggccaaggcgggcagatcaccaggtcaggagttcaagaccagcctggccaacatggtgaaaccccgtctctactaaaaatacaaaaattagctgggcgtgggggcgcgtgcctgtaatcccagctactcaggaggctgaggcaggacaattgcttgaaccagggagtcggaggttgcagtgagccaagatcatgccactacgctccagcctggcgacagggcaagactccatcacaaacaaacaaacaaacaaaacacataattttgtcctttaaatatccaaacaaaaattacagatataatatcacatgccatttatgtatataaattgctcacatgtaaagaaagattaagcttgcaaaccacgatgtccaagaaatctcttctcaatgttccaaaacctttctgtttacgaactgataaatatcgaggcatgttcttttccatatcagtcttgtataatttgctgcccatcaggatctgggagatattacatggttggaatatcaggttttcgtttaaagtatgagaaatatatttgtatagaaaacgtacttgtttaagaaattttgctaaattcacatttcttaaacttttactcgtatatcccacatcatagtgatacgaacagaacctacttgacacaagagctcagaataccaagtatttactccacaaatattacttcctaaaaaatgataaaaatcaggcctggtgaaatgcttaggatgcaaagtcaggataacattatagaaaacatttatgttttgcccaaatggtctcttaaaaaacacaaacttctagataaataagtttgcaaatctgtaagtcttgttccccatttatttttttgttgtgattcagaaatacaaggtatgaaaattagattacaattctgccacaaaagcttctaaagtagcaaacacaactttgtgtatcaaaatagccatgtgcgcttttatcagttaaaaagtctttagagttatcacatcaagcaagtgtaaaatataatagctactatctccccttcaaaattgcaaatccacagttactgcactgaagtataatccgaagagcaagatttagtccagaatatggaaggttctggttggcaggtactttttaaagctgacttactaagaactaaaagaaatgagaaatatacaaagcatcttatgtcaaagagtatgaatatttaaaagtggcctcaagtgagtaatacatgtttaaattagaacctgatgtaattaaatgtttatgtaatttagcaaaaatatatatataattgctttcttctagaaagataaagacataaaattctttgaaccaaagcaatattaccaaatgttttcatcacctaaatactagaaacaatctctcaaaatttcacttgcaatgatcaataatatatggtttaacagatccagataaagattttttttctttttttttttttttgagacagagtctcgcactgtcacctaggctggagtgcagtggcgcaatcttggctcactgcaacctctgcctcctgggttcaagcgattctcctgcctcagcctcctgagtagctggcgcccgccacacacaggcgcctgccaccgtgtccagctaattttttgtattttcagtagagacggggtttcaccatgttggccaggctggtctcgaactcctgacctcgtgattcgcctgtctcagcctcccaaagtgctgggattactggcgtgagccaccacgcccggcccagagaaagatttataactaaatatatagaaaagaataattcccatgattttgtttttgtaaaaagaagtaaggattgttttctatatatttttcaattatgaagtccttgaacatatttggggatttttatggctcaatgttaattttttaatatacttgcaaatacattataataaaataatacaaccaaatcaaaaagcagccacttaaaaactgaaattcacaaaatgagctgttcttggctacatacagaaggccaacatttaaactgaatgataattaaacgtttactaccataggtaatatttacgcacttctgggtccaatagaaggtgttgaatcaatgtgatcctttaaaaacaaagtcattagtttccgtaacaatcacactcagggttggttctttttttcttcccccagcagaaaaacaagttgttcaagcattgaaccaaaaaatataaaaaatagaatttgccttgtaatattttcatgttttggatgaagtcagcccattatgtgaggctgcttaaatgcctacaaccccttatccaaaacccgctgggctggatgtgtttcagaattcataatctttggggttttaaaaaggcaatatgggcatattttgaatattacaaaacacctccacagcatctaagggaaaacctataatcaaatccatggatatttcttcagggaaaattaagtcacaatgaagtagc

SEQ ID NO: 325 - DNA, 51618 bp, Homo sapiens
agacgttgtgtcctttggccccactcaagtggatatagtcaaagaagtttaggaacccctgagttaaggactcctagactgccctacctcttacagcttgaggctgcagatccaccctgaccgtgctcaaaatcctaagccaatgcagagtcagaagcagctcagaagcttccccggaggtccttgctgagaattccctaaccggcaggcagttcctcccgccctaggaagattttgtgtatagcctcctttgcatagtgtccgctatgaattctcttctctggctccattgcatgacaggaaggcaggagaggaggacagaaagctgctgcttattttcaagcttatctccagctgtcagaactctcattaggggctttttgctttggacttaatttaccttagtcctcacagcaatgctgtgatgtatgactgactctactttgtagatctggaacccggctgccctgacctggctcacctcgagccctggtctcccctccatgctccctcagcccctgaagtcccaaggaacccaggactccactcacctgaacaaaggtcacttgaaaactgggaaagggacagaagctttaaaaagcccaaacgaacaaacaagaggttgacaatttaaaaataaagccaacacaaactcagcctggaatggaagctcctgatggagtcatccttagaattcaccacccgcaatttaccccaaatcctgggtgacccctcctccactgctcagactgttcttaggtacagctgcttcacactgcatcgtggccctgtcatagatgactaagccatcagtgggaggcatctttccctacataccatctctttttcccggctcagagtgtcttttctaaaccatgtccttgctttacatttccagggggtcgtccttaacagtgggtaggtaaccctgtggtgacctgattcctgctcagctgtgagctttttctgtcctctggtgggggacagacactcagcattccagacagggttagtggtgggacttctatttatttaactactaatcctacttatgtgaaattaatttgctctcctattataactcaccttgcttcctgccctgaccgtctcctgtaattgacacctggctgctccattgtgctcctgcttcctgggctaaggggcagcggttggaagccaagtcttggagtgactcacattaggaggctgctctatacagaagagaggtttgctcattatagactgaggagggttactgtaaaaacagcggtggttttttttttctcctaataaccagttcccctttaggctagccctttccaaggaagtttgtgtactattattaaacttcttcctaactccaaatatgggctgctccagtttctgcagcgtgcagatgagtctctggcttctgtagtagaaatccaggcccaggtccccatctgcctcggtccttgatgagatgcaggtcatccacagtctcaaagcaggtagaggggtccatgctgccccaggggacaatacctacaaggtgttacaaacacctccagccaaaaacaggtgctgccactaaagcttcccagatccaggttccacagccaggatccgtcttctgtctgtggcagaggtgaatgaggagctgtttgcattgaggctgcagagaacatggctgtattatggagatgagaaggagccacgctggcctctgttcatggccctccactgagcacctgggcttggcagacagaggggtgtagtagtctgaagatctggctctagcctccaagtgagaagctcccactcccaactcatgtccatatctcaactgctcatttgagtccttgggagagggcgaggggaggtggggaggaggaagcccaagagtttgtcccctggcctctgccaacactgcaaatgtggccactttaacaggctaacagactggacgtcctcccatgtgtgtaaaatccccatacctcctccagcaaactccatgttggctgtagaatgaaggccaccttctgcccggcatggcatctgcagcttgaccctcttatccggccttattctcgcctttgctcttcacaatcctcatcccgtccgactgtggctctgaactctctgcccatccctccatcccaccgttgtcacatggtgcccagaagaccctgaatgcccaccttattcttttcactcatcatgtctagtgcatccttgaccccactctagctcagtcccctctgctgtgagaaatacttcctgaccctaccaattaacaggcagcttgtctctccaaattccactagtgtgctcacacagattcatgcagctagagttgttaataattcttatatgagtgttctttgtcgtcctccactagactgtaaatgctttgcaacaaggaaccattccttaacattcatgtatagccctacacaggtggccaacaattgatggaacttgatgaccctacaaccagttgtccactaggtgtgtccagagtgttgtttcttgcttagagcatgatttttgctgtcagaaggacctcagttcaaatcttgactgtgtcaactaccagctctgtgacctcaggaaactatttaacctaactgtgtttgtttcctcttctgtaaaagcagagatgtacagtaatcggcccccaggtttattgtagatttaaagcatgggaaattcttgcttggtgcagtacctggcatgaaatcaaggctcactaaatagcagccattattattatcgggttagtttggggctggtgcctctgctacagtgagtcttaacaagcatcaaattaatggagatagatcctggttttaggggaggcatcctggagagaatgttgaagtgagttttggaaatccgacaaggagagaaatcagaagttaacccaattgcatttctcccaacttttcaacagccttcaggcatactcatttttagctgattctccagatattgctagaacttttcccagaggcagatgcagagtgactgtgcagactctgaaaaacagtgcttgtcacctgaccttaaatgtaacaaacaacccctgaggaaggtagctccaattacagtcatgaagttggaggagccctttcaaggcagattgatttactggaccagaaatacagctcaacatcccacacacagatttctgcctttggcaaactgccctgcctgcttccttctctcttgccctggcgtattgatctgcatgtgtgagttggtgtagtttattgtatagggttgtgtgtgtgtgtttgtgtgtgctgtggtcccaggatggaagctcctagattgggagccctctaattgagtgatgtccaaagccttaatcgagggaaatcttgctccatttctttttgtggtggctttaatttcatccctctgcttcaggttggcatagaatgttccagaaggcctctcactctgtctgattcctgtgcttctgagtatatgtagtaacatgttgttgtataaggaaggaaaaaaactagtttttgttgtgtgccttgtgccagacaaaaaaaaattaccatctccatgagtcacataagaaattgagacttggaagcattaggaacatgcctaaaatccaatgctggtagagccaggatccaaacacaggtgtgtctgacttgatgccctctgtcatagtgactccaggcttggccctgctgggagatggacgcccagccactatgggagtgaagtccaactcatagggtcattttgaatgggaaaactttgaaatctaggggcataatttcaattcatatcatcgtattttgcacccatcatgtgcatggctatgtggccttctcccttgtattagttattgattgctgtgtgaaaaattagtacaaacttggtggctttgaacaacacacatttattatctcacagtttccactgttcaggaatctaggcacagctggactccctgttcagggtgtcacaaggctatactcacagtgccggccaggctgtgttctcatctggaagctcaactggggaagcatccatttccttgctcacatgtgttggcagcatccattctctgaggtagtaggtctgagagcttcagtcagctggaggctactgcagttacttgccacatggggttttcaacagggctacctgcctcctcacggccagccaggaactgaaattcctgcacgattatgctgtgtgtgatataatcacatacctcctttcacctttgtcatattctgttggttagaagcaattcatagacctcacccacccttgaggggaggggagcacacaaggccatgggcaccagtaagcaggggtcctgggtagggggcaccctacaggtctgtccaccacatccctctttccctttctcctcttctccttccttaccctctttcttcatttcccctttcaagtctagcctcagacatagggctttgccaataaatattagctttagagtaatgatgttaataagtgacatcactatattccaggcactagtttttttaactttctattgaagtataatatacatacagaaaactgcaacaccctaagtatagaaaccaatgaattcttcagaaactgaacatgcctatgtaaccatcacatagatcaaacaggaagatacactgctagcaccctgaagcccttctcaggcttccttctaggccttaacaccctcaatggtgaactttttttttcaatacagcgtctcattctgttgcccaggctggaatgcagtggtatgagcatagctcactgtagcctccaacccctgggctcaagtgatcctccctcctcagcctcccaagtagctaggactacatgcatgcactaccatgcctggctattttttttttttagaaatgaggtcttgctacattgcccaagctggtcttgaactccttgccttaagcaatcctcccacctcagcctcccaaagtgctgggattacaagtgtgagccactgtgcccaaccaaaggtgaacttttaacagtataggaactattaatttagactgtttctgtataaattataagcagaatcctacaacatgtattatttcatttctggtttctttgactcaaaatagttttgttgcatgtggttctagattgttcattctcattgctgaatagtagcccatcatgcgaaggtgccgcaatttacttatccgttctactttcaatgggcattggggtagctttctggttggaggtattacaagtagtgctgctaggagcagcctagtatgtatcttttggtgaacaccagtaagcatttctgctgggtatatctgggagtgggtgtgctgagtcacacagtgtgcatattttttgagctgtgtttatgtatatacaatcctcacatccctctatgggaggcaacatcatcctctttatacacaacagccttctgggtcagacctacactttctccatgggtcctgaaagatcagacaggaaggaaggccgacaggtgcagtgcagaaagtgtaggtttcacctatcttttcactattgacaaccttcttttttttttttcttaagagacacattgttttgaagacttctgcataccaatcaaatgtcctttggttagtctcatttaattcctctagtgattctcttattactcaaagacacatatagccagctgcagagctgctggtctgacaacctacataacagcattgcctagtttcagataaaaccagacaaaatccaggttcaggtccaccttggtcacctccttacaagaacacaggatttctgttgggctgtgtaaacactagaagatgccgccctttccctttgtgatgctgcagggaccttagatgaccaaagacgccacgtctccactgaggatctcttagaccgagaccaggtctgaagcgctctgacttatgccaatcgatatatatcaatgcataagccattcacacaccattttgaccaggcacaagccatcatttttaaacaaaaattcaaagtcccatccatttactttgggctggttcttatgctatgataggttccatgaaggtagtgaggaacattttccaagctgctgccaagtggtcagaaagacttcaggctactgctagcagactgtactttggggtatactttgttctttcccatttgtctctctgtttctatctctccatctctgtctttctctctgtctctgtctttctctgtgtgggtaagtatgttttttatagttagtatatgtaatgtatatttacatatatatgagagatctgtctacccatctatcaactatcaacaaaattcaggtcccattatatcttactttttattagcatattttttccatgtgataaaagaaaagtacattcaaaaatgtaacttttaaagttattgtttgatattctatcacgtgccgttaccatgattaatttaactaattctctattttgggacatttaggctgtttccagtattttgccattgcaaataatactgcatgaatatccttctacctaaatcctcagggacatttctgatattttccttaggctaagtgataagatgcagaataacccacaaagcacacggatgttggcttttgagtctcatgatcaaatacaaatttatgccgctgtcaacagcatagaagagtgtcttttttgcccacaccagtaattttctatacaaatattttttctcaattttataggtaaagcatgattgtttggttttcattgcatttaacggattccttgtgagtttaaatatttttttcaggtttgctgtccatttgcgtttctccttgctttgcattttgcattcctttttctcatttcatgtgtctccactcgctcacagaatgacatcctgtgctcagcaggtctcttttcccctcattccagacatcagggcaggagtattacgaaggtcccacagaataacttggtaattgtcacctgccttgcaaattgaacatatgttagaaagatgcacgctcacaagcccacagccggcttggtcagccacatctgtcattcctcccaccaggaaggccaaattcctcccagagctgtaaacctcacatctcactgagtctctggacaccatcacccaggggctgtgagatcaggagggcctgctggtaactacttaagcagctgaggttccagtgcacttcagggttttacaggactatgcctcgaaggaagtgttccctgctgctctggggaaacaggcaattgtaaatcaggtaacaatgaggccctgacttatttatccttctaaaagttttacatattagggccagcaagggacacatttgtccagttcatggctgatttgcagagtcagcactttggtaagaccagcccgccttgctcagcagggtcggcatgtgctgggggcttggaggaaccaaggcaccctgtagtgctgaggccttatcttgtctctcggtctggactaaatgttatctttcagagacatgagacacaggatgggaagtcaccaaacagtgggaaattcttcctcttggtgctaaaggtgctttttcccctctctccctggcctcctccaagttcctcctcctttacagggaacatttgcctggagaacagctgcacccttgtgatcccagaaatgacagggaaccattaaaacaggaacagcagtgataaaagaagttttcgggcctttggcttatactaattagcaatcaaggccaaagctgaacccaatgtcccataataaattatgacacatccttacaagagaatattaggcagctattaaaaataatgttttcaaagaatttttatggcactgaaaactgcttatgacatgaagtgaaatgaaggaaagatgtaaagcccacatacagaacacggaataccaatgacctgaaagactacctggaaatattgtaaaatgggaactgcaattatctctgcaggaaaaattatgtgtgcattttatgtttctctcttattatatttttaaaatttcctacattaggcatttgtaacctttgtttaccaaaataaataaataaagtttttttgtttgttttttattttttgtttttttgagacagagtctctttttgttgcccaggctggagtgcagtggcgcgatctcagcttactgcaacctccacctcccgggttcaagcaattctcctgcctcagcctccagagcagctgagattacaggcgtgtgccaccatacccggctaattttttttttttttgtatttttagtagagacagggtttcaccgtgtgagccaggatggtcttgatcccctgacctcataatccgcccaccccagcctcccaaagtgctgggattactgacgtgagccactgcgcccggctaaaaatcgttattatttttaaagaccaagtctgatgtgagctgccccaggcctttgaagattttctatgttcatttctccctccctccctccctcccttcctttctccttccttccctcactttctttgttccttcttctctttttcctctttcttcctccctccctccctttttttctctcattcttcctccctctctccctgtcttccttctttccttccagaaaaccagcaatattgaccaaaaacaaattttcaacaagatcaagaagttgatggtcctgatgctgaatgagggagggggcttggctactttcgaaaaagcttggggatccaaacattgttctgcactgtcctggtcacaatgcttctagggggctagtttcaattctgggtgccaggttaaaaagtatatagaaaagatcaccttctgcagaatacaaaaatgacaaaaacgacaaaaacgatttcatcaataaaagccacagcagcagctccaccatgtactgaatgcttatcatgtgctagatactggatggaaacatgatctattgtttgatgtgagctttaaaacaactcttttacagctgagaaatctgagtttaccaacattaagtaatgaggtggatctatttgatcctgtataaatttgcccaggaaatggaggaagggaagctttcccagggaagatcctgccttatctgcagatgggacggcttggactgtggccttggctgctggaactggagaagctggctgggagggctgcattaccacgggaactctggatggattttcctggacaagggtgacaattcaactctctttagaattctagaggtttatattgaaaggtgttggtgatgcaacagacttagctcatgggaggcagaagcctgaatgctctggaatcaggaagaccgggctcccagacggcctcagtggaatccactttgcagtcacccttggctgctttttgcctgactggaggattctgtggcttgagatgcccagcattgttcaggaccgtggcctttgagggtgactctgtggatcatggggaaattgggtccattcttatagcttgccaggaatgtgacagcggttgactgggccccacctgggcagtcctccaattgttggtagtgggggtcccaggcaaggacaggggatgcttggatcagactcttccactggttagatggactgttttttgttttgttttgttttgagatggagtctctgtcgcccaggctggagtgcagtggcacaatctcggctcactgcaacctctacctcctgggttcaagtgattctcttgcctcagcctcccaagcagctgggattacaggcgcccgccaccatgcctgtctaatttttgtacttttagtagagatgaggtttcaccatgttggccaggctggtcttgaattcctgacctcaaagtgatttgcctgcctgaacttcccgaagtcctgggattacaggcatgagtcaccatgcctggcctttaaatggactgcttcttagctgatgtaagaattatgagtaccccagagaagtctatcccaccaactaacacagagaaaaaatacaagcaaaataatctgtatgaaatattagttttaataaaacagaaccagtccatgtatggaggcatgggcataaggtcaacttgcactaaatgtaactcgtacgttttttctaaaataatttcttgagcattgtggtggccttatgtactaacccgaagctgaacttcctgggaagctgatccaatggagcacttggaattcaggggtggagtcttcttcctgggtcagagctggttcagggtcacatgctcttgaggtccctaaaggccacatgtgctgcatttcgcccagcagctcccatcacacctcctcctggaagggaatctcctatgaaccaaagctccgctcaaaaacctgccagggtgggggtggggacagggcttacagagatccagcaacaaagcagagtggggctggttagaggggtccgggggcatgggcactggaatcacctaagacagccgctcaatagattctggctccctccaggcttcctgcaccaaaggtctggggaggggccaggtccacagcccacagtctcaacggctgagggtggacgtgctggatgggcacacgcttagtaagtgaagttaaaatttcagaataaggggctggggggagggggaagatgtgtaagcccagactctttccagggtaccaagtctacacagctgagagaaagtgtgcatagcaaatagcctcagccagctccgttaggcttggaatgcgcacaagaaagaattgtaaagttgaagaagttaactttatccatccttcctggtctaaaatatggatggaggcctctaatcccagcactttgggaagctgagtggagaggatcacttcagcgcgggagttcgagaccagcccgggcaacctaacaaaacccatctccacaaaagaataaaaaattagccaggcatggtggcacacacctgtagtcccacctactccagaggccgaggcaggaggatcacttgagcccaggaggttgaggctgcagtgagctgtgatcataccactgcacctccagcctaggcgatagcgtgaagccctgtctaaatatatatacggatggggaatttagggacatgggtctctcacaaccccacattggaatgtggtgagatgcctccaccaggatgcatccccaggcctcctgaaggggaggtgtgagctcaactgtgggctgtggtcagcctggtggaggcagcggctgtgtgctcacctgtgcatggataattctgaacacagggcagcttatgttgggagttccctgctcccctccctctctgccaccttcattgcttaacttcctccttctccaagtctctggcctccagtgagccctcccagtccccacagggtagtgggactccaggtcactcaccaggatgagccccacttccacagagatacaggccctggagagggcagcggtagccagaatgcaggggcacggggcgggcgaagtagagctggtccagggacatggcgcagtggaatatgttctgcagaggcagggccacagtcatcagcacaggagagttacagcctttcctgctctggctgggtttcttcccctcccctgttcttcagcaaatgttcttctccttccaggatattttcttgggttttaaaatgcagaaagggaaggagatgagacggaatgggcacatgccctggggctgggagtgaagttttccagaggctttttgaggaagaaagcagggtggggaacacgaactgaacgggaaggaaaagagggttttgctctctactctgcatccctctccctctgttggaaaaacagaattgtctgacttattgtggctgttggcatgcgtctctgcgagaactcccttctctggccaaggcatccacctgagcccggaccccggtgtccaagctccagcaggatcactgtgaatggcagacaaggggcaacggagcccgagcacggttctgcccccctggcttgggtgagaccagccccaggctgagaagggaggcagcatgggacaagcgaaggtcagactcagggggcaggtctggacaagaagcctgacgtctgttgggcatcctcacaggagtgctcccccactgccctcttcacctttccccaaactgaggccatcctcttccctcgagtctgctcctccccatcctcctgcataagtgaatgacaccaccttcctccccctggcctctgtgcctacccttcacatcacctccaccctgactcctatgtgcacactgtcaccaaggcttctcaagtctgcccgccccatgcctgctgtacccagccattcccttccttcccgctgcctggccttctttcctctatacctggaccagtgctgttcagtgaacatgtaatgggagctacatatgtagtttttgatttattagtagctacatttaaaaagtaaaagcagagccggttgtggtggcccatgcctgcaatcccagcactttgggaggccaaggtgggaggatcacttgagccccagagtttgagaccagcctagacaacacagggagactcatctctacaaaaaaaaaaaaaaattagccaggtgtggtggtgcatgcctgtaggcccagctactcaggaggctgaggtgggaggatggatggcttcagccccagaggtcgaggctgcagtgagccgtgattgcactactgcactccagcctgggtgatagaacaggacctatctctagaaggaagagagggagggagggagggaggaaacaaggaagggagggaggaaggaaggaaggaaggaaggaaggaaggaaggaagggcaagctgatgaaactaatgtcaataatatattttatttagcccaatatatccaaaatattataatttcaacatgtaatcaatatataacttattgatgagatattttacatttttttctatactgtgtgcattctacacttgcagcacatctcactttggcctcagatctttcttttgctttttttttaaattttctttctagagatagggtctcattctgttgcccaggctgaagtgtaatgacgcatcacagctcactgcagtctcaaactcctgggctcaagcgatcatcctgtttcagcttcctgggtagctggaaccacaggtacgcaccaccacacctggcggggtttttgtttttgtagagatggggtctcactacgttgcctagggtggtctctgatctttcaagtgctcagtagctgcaatgaggcgattgaacctggcctcctatctggtctccctgtctccaatctctagtttttgataaattgacaagtctgaggatgtgctgctgccttgagaagggggtgctctctctcaagaaagtcagatggcagagccagcatagttgtcaaggcagagggccacaatcctggtgaccttctcagtgggggctgtcctgcctgtgtttctgagcccccactagggatcccccattccctcggtttgaccgcttctctgccctctctcagccggggtccctgccactgtcctcccttcctgatgaaagctgagtatggagggacaagataaagcagagaggtcatagccaggaagtgagggtgcagagggaaggctatggtgagagaccccctaggcttatacatacccctccaggaagcccgaagattctctccaaatctggtggtgtgaggatgtctctgccaaccacagagtccttgaagccaggggcatagacctcgatgcaatcaaacactggggtgccaaaaacagagaaatgagatggtgttaggaagaagaggaggcactatgggtgtacaacttggcaaatttactaacagtcattaaattacacacagaaatgggcttattttatcatatgcaaattatacctcaataggtgaaaaacaaaaatcagtccacaagcaaatgattaattcatcccaaagatgcatgggtaggccagtccagtccccagttttccccacttccctaccccaaccttaaacacgaagctgctgatctccttttgcatatgcagcttttttcacctcttcacttttctcaagctgttttttttttttttttttttttttttgagacggagtctcactctgtcacccaggctggagtgcagtggcgcaatctcagctcactgcaacctccgcctctgggttcaaacgattctcctgcctcagcctcctgagcagctaagattacaggcatgtgccaccacaccctgctaatttttttatgtttttagtagctacggggtttcaccatgttggtcaggctggtcttgaactcctgacctcgggtgatccgcctgcctcggcctcccgaagtgctggaattacaggcatgagcccccacgcctggcctgatcaagctgtttctcttgcttggaatgccctttgctgcctggccagctcctagtcatccttggaaacccagcttgaccatcccttcctttgaaagccttccttgtctctctggctcatgcgtctcctttggttcgtgcagtcagctgtgctgtaataaaaggtttcttaattagtctcctccatcccttgctagactgtgagcaactggagggcaggaactgtgtcttcttgactttcttagcccagttcctgacccctgcagtcaactatgttgacttgaggttcccttgactatttcctccctttggaatggcacctgcagttgtcaatcctgaatggggcagtgaggaggagcaggcccagttgggtcgcatgcccggctgtggctctggaggcagaacgtgcagctgtctttacctctgtctgcataagcgtctctctcctgctcgtcccaggccttgcctccagccagcgtatagggcatgtactgagtgaagagggagactacatggcagccagggggagccagggtggggtccagcgaggaagggatgcagagctcaatcacaggcctgtgcgggcagggaggagacggcaggtctaaagagcagcagtgcggagggtagggcatccgagatgacttgggacacagtggaggccctgagatgacaccaattctgggcgattgtcgctctacagccacagtggttgtccacctgcacgggcttagcggctgctagcgtggtccagagcacctgtgaggagctcgcctgaccccagacccccgaatgcatggcctgtccttgcctgccttcatcacacgctgtgctctaaccacagctcccaaacgcaaatgtctcgaaggtccacacagacagtgggagtgtggaaaggggccaggcctaagacagcaggcgcccaagcagccagatttcagccaggctttagtggcctgactgtcttttccagagcagaccaatggaagacagagctgctagggctgccccgagccccagcagagctgtgacctgcttcccaccccaccacctttgcctgccacaccttttctacctggagcatgttctccctctgatctccaaatatgagtctccttcaaggccacgggaaatgccccttctccctgcgtccctcagctgcaatgttctcgctgaactcggatgtccaccagggatctcaaacatcccctgttcaaaccccaatgcctgattagcctctaaaatctgctccacccccaccgcctcttcctcttttcagtaaatggaggcatcatttcacagtcgctcctttttttgacccacatcccactccctatccaacagaaagtcctgttggcttcaccttcaaaacatacccagtcttccaacacttctcatcacttcccctgcccccacccttgtccaagccactgtcctctctcccttggattctgcaacagtaacccattgcaacagatgccttaactttttctgcatacagtgtccaggttggtctttttaaagcataaggcaggctctgcacaaactttcctggagtaagagccagggcacttgacaagacccagcaccatccgagacccttcattcccaggtgctctctctccagccactctggcctcgtccctgtgcctcctatacagcagcacactcctgccccagggcctttgcacctgaccttccctctgtctggacgttttttccccagatacccataagatctgtattctcacttccttccggtctccgctcaagtgccacgttattagagaagcctttcctccccttccctgcctatttttctccacagtgctcatcatcagtgcttacttgttgattgtcttcctctcatggatagagagtcaacgacctgagactttcttggctttgcttgctgatctgtgcccactcactgaaccaagcctggcacagaatagagaccccagaatatttataaatggatgaatgaactttgccctatacccttctttccaggcgcacatcttctttaccacatgctataaatatttgtgtacctgtcctatcataagctttgtgtcagtttcatgcccctgccccgctaattctcccagcccatacccagtacagagtccagcactgagtaggttttcaacagtgtgtgctggacagcggacaggatggaaaggcacttgctcctatagcgcccctgcctgttccagaagaatggaaatacagctgcagtgggaggtgggaaatgcttttagaagttttgcaagaaggcagattatcagaaaaagaaaggctacggagcaggggactcggtgagtgcgtgctctctgacgggctctgaatgagagaacttcctttgctctcccagaacacattttctcctcttcttccccagccccagcactttcctgggcagtgctctgcccctctgccccttctgctaacctgagccgctcttcaccccttacctgccctcatcctcagatttttcacctgggatgcacttcctgtccttaggagtatggattttggcagatcctaagtcactgtgaaggttgaacaccaggcctgatccctgctgtgggtggcatggacagccccgcctcccaggcccatgtggaagaacatcagggaacataaagtccagggcccctacctgtgggaaggcaggccatccatggcatcttcaaaggcctgatgaaggaggagggtgtcttcacagttcaggtggatggagcattggtgatggggcagcggctggcccctgggagcattgggggccgccaggaagctgggcagcctgtctacggccactgagggaccaaagaggagggtcaggtcttagccccacaaggtcctccctctacagccagcaccctgctaccctcagtggcggacgggagtaggaaagtatgagcaagtgtttcaccttctgaccaggctgcagggggacacaggctggaggtccgggaatggagatgatgactgagttcagctgcccccagcctggaggtttctcactcagatgggtcaaaggagacagtgctgcaatgtggtgtgcctcttaccattgatcttggtgacaggcgaccgggtgtccagctgagagattctctccaggaactcctcaggaagccactcctggaaggagaaggctccatgaaaggcctcagatgtccaaggccccaaggaagctgccttctttctttgctcaggaagatccctcagtcgctccctccggaaatcctcttcatccttcaaagctcagccaaaaccacctcccctgtgaagccttcctagatcccctcccactcagctctaaccacttcctcctccgcgcttggccagcagttctgactgtgaaatagtccgcacctctccctgcttgcaaaggggtcagtggtttgcaggcctcttttcactactggtctgtaagctcttggaagcctcgacgatctcagaattgccttaacaagtttctttttactgatgtttgttgaattttagtaatggaatcactcagaaaaagtagtgctttgcccctaagaattgcccccaagaatggctaggagcttcatgtgcgtatacatgttatcatatcttttgagcacagggtaagtcaattgcaaaaactgcccccaaagctcacccctccctgtttgcacacccacttccgtgtaaccttgcagtgctctcacactctgactctaggcttggccatgagacttggtctggccaatgctagcaaacaggatgcaaagagatcaaaccatgtgatgcttgcatgcatgcttgagcttgcctgcttttgccctttgccagaccttgagaacatgcctggactaccgtgctggaggaggacagacacatggagcatagccgagtcccccacccggtcatcccagcagaaacggtcctggaccagccaccaccagccagctcccaggcacatgaaggagtcccgccaagatcagcagccggcaagctgacccacagccaactgcagacgcatgagcaagccttaagcagctgaaatccaccaagatcaactgaagtctccagttctgggtgccagtatttcttgttgtatgcccagaagtattgtggctctttgttaattgattaattaataatcatggataatataacagatcattgacaaagacaatggaattagagcggtgagaggggagaaatcaggaaagtaggaaagttgtggaaataactctagattgaaagtcagacctgggttctagctctggctctgccaatggccggaatcttggtcacttcacctctctggccccttctccccacctgtgaggcttcttccccgtttgctacctgcccttacccccctgtttcccaaatgcagagacttggcttttgcatctcacaccctgatgcaatcctggctccctcaatccccacgatttctaacccctgttttggcagacatctaagctccaccctcctgcccacagcctcacctgtggcgtcagcttcaggaaggtgatctgcggtgatgtgttggacagcaccattttgcttctcacctctgtgccatcttccagcacaactccttgaacacagccttcactgttcacctgcaccttcgccactgtctagagcccaccagaacaaggccccagaaaccgcaggaagggaaatccatgttagatcttccgggatttccatggtctgtgctgctcctaggcattcacaacttcttcatcccaaacccatcccaccaagttctgcagcttctccatgaagcctcagcttctccatgaaacactcagtctcagttcagtgaccagggaattccaagggggtggttagccactaacagactgcatgaccttaatctcttgattctgcaacccatcccctcatggcccctctgttcattggtaaaacaagggaccttccaaatctgagactttgttctgtcctgggatccttactaataattggggtggggtagaggggccgttcaccttttcagtgaagatgcttgctccatgtgtggtggctgagcttgcgatcgcatcagagagggcacccatgcccccctggacgtagccccaggccccctgcattccctccaggccccccatcacatggtgcagcagcacatacctgtggacagaccatccgactcagatcctggaggtgggatctcatctccccagagttccaggtgcaactattcctttccatcttgatcttcagcccttccctgccaccatccagccctctcccagcagccttcaatgagctcaagttcttgtaagagccctttgccttctctacaccctctccctaacaagtgtgtctatgtgcatagcttattaccacaaagaaggcaacgatgcccaaacctgcagctccagccctctcctgagctccagctccggtgtccagctacccacagatatctccctttggaccctttcttggcagcatcttaaacccaccaccttttccccattctccagctgcttccccttcaatctttcccatcccagtgaacggcacctttcaacaggaggttctgtttccgacagaaatccaggtgtcagccttgaccgctaccatccttccccatctacatccacaaagcaacaccaactcagcctccaaagggctttcaaggtcatcccacctctcagcctctcttctcttccttatgctgctgcagtagtgcccctcattggaccccctctcccacactttctctcctgcaggtcttgtccacatatatcctggagccctatcttaaagcccagctctgctcctgccactcacttatcaccattccaagcctccccggcttggcactgctcttaggataatggccagtcttctagcaggcactccagcctcatccctcatcctgtccccctatccatatcccatcctcctaactaacagaacctctcgatttcctgggtggatcacacgttctctcaaccccagcatttcccctgctgttctgtcggcctgaagcccctccctccctcatcttatgttttgttaactcctctttgtcctttgggtctcagatcaaacacctcttccatgtagaggcttctctgaccctagaccaggctgtgtcccggctgctcctcctagcatcacactcacgccacttcatcatcatcactcgctctgtgtctctcacccatcaggacatctgctccgctcactaccgtatccccagcacctagcacaggcaagcgctcatccatatttgttggaagaattaatgatggaacagattacttaaagatcacaaacggagcactggttaagcctcccagggatccgaagagaaaagggcaggaggccccagctggaagatccagattggctggtagatcacagcttggccaatgtgtggcaactgctgccaagcccccatctccatcgccctgggggaatttggggccggcttaatatgtgttgaaaaaccacttccgagggtgtgctcatcccttgagagaaaagccacgtcgacgccttctagcttctagcttctagctgtatcttctggtgcactggaaacggcccaacccttggctgcattctccatcccaacacacacacacacacacacacacacacacacacacagccttccattcctgcttctgcgggggctcattaagtcagaccacactgcaggctttgctgtgtctgactgccacctctcggattgggctgtcagcacaaaccctcactcataaagaaaaaggcagcttcctgtccatcctgaggtgtctgtgtgagtgtgtaccagagcccaggggaaggaacagtgagagagaagggagaatgggcgtttgcgggagtggagaggtagaagagggaagggaagaggagagaaaagaagatattaattttgagctatcaagcgggaggtgggagagaggcttttcttagtgaagcagtagggcacagtcactaaaaaggaagattttggggagtcagacacctcaagctggaaatcagccttgccacttaccagctgagtggctttgggcaagacactcccttctctgaaccgcagttctcagatgttgctctgagggttaagtggatcgtgtgtgatgtgcctggctcggttcctggctcactgggtgagctctgttaagtggcagctgttgttgctgccactgccactgttgtcctcactcctgttggggaacatgccccactcctgtgtcccacctcacccccctcactcacccactccccggagtgtggggacttgtcatggctccaatcactgcatctgtggctagagtggcttttaaaggctcagactcgaaccactgatccagcacctggacagcacaacagcagagagaagggcttaggagcctggatgggaggagggccctctcactgcctggtcgggcctgaggctggggaaccactcaccttggtaatgggagctgtgaggacctcataatatcggggaagctgggctcccaggatgcggcctacaagagaagatccacaaaacagaagttgaaacaggtgacagggaaaccctccgacctggcctgggggataaaagcatggaggatgctgagacttcctgccaggaggtggtatagcacagccaatgcagggacagatccagcttgagtcctggccacacctctcactagctgcagtgcctgggacacatttttaacatctctgaacctgcttctttacctgtaaaatgggaatcctattttacaccccaagggctacggtgaggattaaatgagctaggtaaagcatttgcaagttcatgggtacttaatacatttaagcagttagcattatttttggaaaattttaaacttgtaccttattcccttatttcgaactctggaaggcccatatcctgggagaaggctggcatggctgatccattcctatgaccctgattcagaccatttcagaaagaaactaggctttaaggccttcagggtagaaatcatggtctctagccttacagcccctgggcctagcttagtgtctgacacatagtagttgctcaataaatgttttttgcctgtttttcacacagagctccttggactggttatctgagagagaggcagtgtctactttttgcatttgtaatagattccactggctccatactctttgcaatgtataagtctgcagtgcctctcaacccaccacaacttggttaacctgcctggctccttggctctgggctcatccatgtgatttggtcagccagtggaatgtttgccgatgtgacacaaacccagaactgaaacaggcctgtacattggggcatgccctctgtgcttgtgccactgatgtgaaaagtccacacccaggtcagcatgtgcttctacaaggaggacgagaggtacctggagcagagctgcctccactgagctgctgcagacacaaacacatgcctgagaccaaaccagatcagctgagccagctggaatcagctgaaccacgaagacatgtgggaaacaaatgattttttttctaggatatagaggttaaactggtctgtataccctcaaggagggtagaaaataatagcacacttaatgagccttccattcgcatactcatggcagacattactaattgatcacagaacttctccttgctgagcccaaatctagcattcttcctgtatgggggcagctcttcaaatctcttggcccctatatcttattctagccacagccatgatgctgagctccaagcaggctttgatcagcttcacacaggcaactccacagcaactcacttcagtcctgaaaagtgagcctctctacttcttccctagggcttctctggcaccagggcagggcactcatgggaacctacttggcacccacagatgcacagcccagaagtgtgggagtcaatgccctgtgaggcaacccttggccaatgggagatagaacccaatggataaatatttccctttccatctcccgagaaggttcctcaaatgcttttcataaggcttcccagagggcccacacaggtccagcatcttgtcacccacagtgctggctagtgcgatcacacactctggtattgactctttctctgtccactttcaccccaactttctgctatttttgtgtcttggggtcacccttccaaatgaactacccacgcataagccttggtctcaggctctattttaaaggcatatcagcctaagatgctctcaacaaagtgctccaggctgcccctaattgatcgcagcatgttaactgatcccagctggcaggctgccatggaggttcaggcttgtgtctaggcatcgagacaatgggctcacctccttgaaggtcactcatcatgccctggtgcctgcacttggacttacctgccttcagcaggggcttgagggtggagagcgacctcatcctttgcagcaaggagccatgctggaaggccgccatgtccacgggggccgcatccagcagagggtcaatggctaatgccaagcgatgcatgaactcctcatatttgggaaagacctggaacagagctctgcattaaggccccactgtccacatccctgccctccatgctgtccccagatggcctgtcacccccccacagcttgacggttcctcaggcctcattccccgctgtggcccagcttggctctgttgagctcccccagttccaggtctctgggttaacatcaacaccaggaagagtgcatggggtggggtggtggtggtcaggagaccctgggcaataggagaatcactgggagtggtgacagggacaaggagctaatgctggctaacacgaagtgtcacccacagaaaactggcaacaatcctagggtgtggtctctgcgataaatcatgaaaccacttagaagtttcttccttctgtcctttcttctttttttttttttttttttttttgagatggagtcttgctctgtgacccaggctggagggcagtggtgcgatgtcggctcactgcaacctctgcctcccaggttcaagtgattctcctgcctcagcctcctgagtagctgggattataggcacctgccaccacgcccggctaatttttgtatttttagtagagacggagtttcaccatgttggccaggctggtcaagaacttctgacctcaagtgatccgcctgcctcggcctctcaaagtgctgggattacaggcgtgagccgccacgctggcctgtccttctgtcctttcctatattattggtagaagttagacctctttgcctgtattcttttccggtctgtaggtcgtctcccatgccgtctcatcacctgcagtcacagaagcctgcctcctctcaccccacaagctcccatgtcagaatccactttcgaaagcctggtttctgacacccaccctcctttccctggagggcacaggagcagtgatagaagcctgtgctactggaggccctacctgactcttcttagccctggactttgaattttggtccatctctacccatggatatacccatggcattttaataagtgttacataaagaaaagttccatgttaaaatacattcgagaagtcttattaaaaatgaagttaaacagctttctctaagcaggcctttaatatgacagcatggaaagacaaaaccagaaatcaagctcctcactttccacgatgggaaatgggcacttgcctccagcgtgtgtggtcgctggcatgtagggccacagctagtgtcctgcaggcccggggacctggccttgtgcagaatcccctcaagtgcctctgagatgggtaggatttggacgagaggatgcaggtggtggtctccaatctgctgcacaaaagaaccaccaaagaagcacttttaaaaaagctaagctcctcaggccgggtgtggtggttcatgcctgtaatcctagcaccttgggaggtggaggtgggaggattgcttgagctcaagagttccagaccagcctgggcaacatagtgagacttttgtctctacaaaaaaattaaaaataacatagccgggcatggtggtgaatgcctgtaatcccagctactcaggtggctgaggcaggaggattgcttgaacccgggaggcagaggttacagtgagccaagatcgcaccactgcactctagcctgggcaacagagtgagaccctgtctcaaaaacaaataaaataaaataacaaaataaaaggctaagctcctcaggtgattctgatcatcagccaggtttgaaaactgctggtggaagagacatgtaggctgtgtgtctgtggttctctaagttttacccagcaatagattaacacaacaaaagcaatgtacatgggttctattaacctaggttcttcttataaaaatgtctccactgagatatgatttaatgctacatctcagctaatatccaggcttggtacaaaatggccattcaaataatctttctatatccacagaaccaactgtggcagggcccttacggaactcagtggctcatctagacaaggccacccagcaggttcctagaatgcagttccaagggaaaaaagtgcattctccatccgacatgtgttcatcctgtcaccagacctgcacaccatcatggacactttgttgccttgggcagccaggagggagccttgggatgccacactgaataaatatttagaactctcctgtcctaagttcctgattcagtttatttatccttaattttctctgatcttccctcatcctcctttttggctttcatgtgctttaatgtggacaaacacctggaactctgcctgaaagctggaggggcatgaagcacacgccagtgtaagaacgtgccagtgcatttcctcttgaactcagcaggcacagcccctctgacagtggccccatactgaacacacgcaggtgagcaggcctcccagtccactggtcttaatcagcatcctccacccgcttctcttcgcagtgcctgagatcaagagctgccaccaactggagccctcctaggaacgtggggtggcctggcgcagtgtccatggcctttgaacaattgttctaggacaatccaaccaggcccatctctaggctgctgagggagcaggagctcagtcactggtcgccttccctacctgggcatccttctgggagaactgggcgatctgcttctggttttctgccatgtctgtgcccagcagaaggcacctgggcaccttgctgcctgcaccctcttccagcatgggggtgaaggagtaggggtttcgaagatgaagcctcagcccatgtttctgcaaaacacaaatagcatgggccacatattaatggctctgtggtctctgcccatcatctttctccgattgtgtttgtgtgaccatttaggtacctgtgtgtaggttcccaagtgtatggtcctggtgtctgttttttaaatataagtttataaaaagccctcttgcccaagtaccctatggtagacgatactgtatcacatcgcagtacactataccattctacaccataccatacataccacacataccatgccatacaccacgccatgccatgccacatcataccataccacactacatcacatcacaccacacacaccatgtcataccacaccctaccacaccatgtgataccataccatgccatatcacaccacactatgccatgccatgtcataccacatcacagcatgacacactcattccatgccagggactgtactagggtttacaatggttacctcacaataactttgtaagtacagtcttgcatcacttaacgatggggatatgttctgagaaatgcattgctagacaatttcatcacagtttgagcatcacagagtgtacctacacaaaactagatctgatagcctaccacacataggctgtggggtgtagcctgttgctgcaaacctgcacagaatgttactgcactgaatactggaggcaactgtaatccaatggtatttgggtatctaaacatgtctaggctgggcacagtggctcgtgactgtaatcccagcactttgggagtccaaggcgggcagatcagcgaggtcaggagttcgagaccagcctggccaatatggtgaaaccccgtctctagtaagaatacaaaaattagccgggcatggtggcacgcacctgtagtcccaactactcggaaggctgaggcaggagaattgctcgaacctggaaggcagaggttgcagtgaggcaagattgccgccactgcactccagcctgggtgacaaagcaagactctgtctcaaaaaaaaaaaaacaaaaaaaaacaaacatagaaaaggtacattaagaatatggcataaaaggtaagaaaaatgatactgtatagagccctcatgatgaatggagcctacaggactggaagttgctctgggcgagtgagtggtgagtgactgaaggcccagcacattgctgtacactactgcacactttataaatatagtacacgtaggctacactacatttattaaaaaattttcttcagtaggttagcttactgcaaacttttaaactttataaacattttaatttttaaaacctttttgattctcttaaaaagacacttggcttaaaacacaaacattgtacagctatataaaatattttctttatatcctcattctataagcttttttctgtttttaaaattttttatttttattttttactttataaccttttttcgctaaaaagtaaaatgcaaacacacacatcagcctaggcctacacggggtcaggatcatcaatgtcactgacttccacctctacatcctgccccactgcagggtcttcagggacagtaacacgtggcactgtcatctcctagagagcaatgccttttgctggatacctcctgacagacctgcctgaggctgtttgacagtgaattttttaaataaggaaaaggaatactctctaaaataataataaaagtatagtataataaatacattagccagtgacaaagtcatttactatcaagtattatgtactgtatataattatatgtactagactttttgacaactggccacacagtaggcttatcaccacaaacacatgaataatatgttgcagtgcaactatggcatcgctaggggacgggaattttttcagctccattgtaagcttatgggaccaccactgtatatagtctatcgttgaccaacatggtggcacatggctgtcttattatcctcattgtacaaaagcaacacgagaggctcataggagttaaataatttgtcccaggtcactttaggaggtaggtctgggtttcaaaaccacagctctgtaactgcaaagccccagctctcagcaccggtctgtaactgccccacttcagaaataaataattaaatttagaaagacacaatcaagcaatggttatgtgaaaatctatacttacaaggtagataaattattcacatcagaacattttatttactttgcagactcatttactccagggtcactttaaatggaagtttctttgatgcatttaaaatatgatttgatttacaaatatttgattagcacacagaattttccaagagcacatccacttcttcaaagcaggcacagataaaacaaaaggggcctgtgccgcctccagtttctgctgtcgagaggcttccttctccagatccgtggcctgcaacctcacgactcgaggtcttggctggaatgccaccttatcagccaggcctcccccgcactccctgccccctcaccctgcaatatttttctccaaagcacttgtcagcacatggctaatcacatatttagtgttttcattgtctccccaagtagaatgtaagccctgtgaagtcaggggcattgtctgttttgttcaccgctgtaccctccgcgtgtagacacagtgtagttaataagcattccgtcgactctgaataaatgaatgctaggttgcagacaaggtatggccccagaggagagaaatgagatcggagagtagacgttttagaaaagcacgaggaaaccaaaaacaggcttttccaacaattaccgctggagttgctccacactggagatgctccaggcgggcaggctcgccgcagctctggacactctgtggaggagatttccgatgctggcgggggccggggccaggagacggctggggtccctcctatccctaagatggagacattctttattctaagctagagaaacttccagcttcgttcttcttaatgtagtaaactcactcatacccaggaggcatccttagtctctctcctggtcatccttgacatcccatccgctgcctccagaatctgtgcgcgtctctccaagccgccattttgggaaccgctgcagcggcggcctagtgctccacatgcgaccccctcctgtttcctccgagtcctcaccagccagcaggtgggctgacctttgtaaagtcacaaatcctagcagtgaacttcctgatcacacacctcactggcttctcgctgcacttggataaaatgcagtcctgcccctcccacccccatctggtgctctctgcctgtctgctctgtccacactgacctgccctctgctcacgcctgcctgggtgggtccttctcttcttccctctgactggagactgcttagatgtccacatggctgctgctggtgacctcttggtacctgaataccagctcaaatgtcacctccttgaggaagatgtccttcctggtcaccatctaggctggaatctccactctctttctctaatgctgccttcttttcttttcttcttggcactctccctgaagttctctgcctaagagcagtgtccttgccttcctagttcactgccgtacacccaagggcttctctcagtgcctggcacatagcaggtgctcagaaacatggactgaatgaacgaataaaccctccaaatcagggacctaagaggaatccaaaagttattttaagtataactaattgactatgaatcacttttcatttgattcataatgaaacctaaatggaggctcttctaaatggaggctctgtcattcttaatggtgttaaatcaaatttagcttaaagctgcctccttaaatactttaagctcaacctaaaggtttctctgttcctagtgaactataacctagaaggaggcgtaaacagactgtaacctacttctgtgtcaatcgccgagttttggccaatcaaaggggaccaactgtttaaactgcgttcaaataaggcaaacactgagctgtaaccaatccagctgtttctgtacctcaattccattttctgtacatcacttttcactttctgtctataaatcttcttctaccatggagctgtgctggagactgtgagcatactccagctcgggagcctgattcatttatgaatcattctttgcccaattaaactctattaaatttaatttagtgaaggtttttcttttaacaataggtttaattatgtggagtctgaatgagaaggggaatgttaaataaccatcagattatatccacaagatttgttcggattatgaagcttttttcttaaaaaacagaaaaaaaacccaaaaaaacaaaatgaaagcaaacccttcttttatttaccccatgagagttctcagcatgcacagtcatcctgggtggaaattgttggaaagggtgtgtgtgtgtgaagggtgtatctgtgtgtgtgtctaaaggaccagagatacaagagatttaaagggtgtggttctcaaagttatgttctgggggcctcctctttcagaatgacctgagaatgccataaaaacgaccgtttctgggccccaccactgccacagaatcagactcgtgagcaagaacccctggggtttccccagcagtttccccagcagtttcccaggtcatactttgtggccctgcaaattagagccctaccttagagagatttccaggagaaaagcaagagcaaaatgaataaggctgagtgagacccagaaggtcagtgagggaggggagggaggatgggattgcctctggcagtgaggtcaaggctggcccagggggagatggggaaggtggcttatggctgaaggggatgaaaagcccccctccacacccccttctccaccagtgcaaaggctctgcccttccagcctggattccatcatccagcgcagggccgctgcaaaagcaaactcatttactaggtggatggaaccgggaggtgatccaagtcagtgctcgcattgacagctgtggaaactaacacccaggaaggggaggcaggccctggtggggaccacagcgggtcagtggagggtgctttggctcaaggaggggaggaggggcagtggtgccaaagccaagcctctcactttagttgagggctcactctaattggatacagccttataagtggcagggtgggtgagtagtctccagccatgggtctttctggagcctcagttttctcaagtgccaaatgggggtaataataatagcgacaagtactgagccctctgtgcaccaggcactgtgctgatgtggccttaggaggcagctgctgttactattccctcttacagatgaggaaaagaaggcaccacgtggtgaaatcacgcagctggtgagctgtggagcagggaggcagacgcagccggccggtttccagcagctccagtctcagcctctgtgcacactgcgctggagctgccaggggcactctatcaccacgttcaccgcaaagtaccaagagccagagacgtgtgagtctgggcggtattggtaccaagaggcctgagcgcatcatagctcaagaacaaggagtaggagacagtcaggccttggcttgaattctccatcactttctagctgtgtgaatttaacccctgaactttagttccctgattataacatggctcttgacttacaggtaaggatcaattgagatagaacattaaggtcatagcccaagatgtgatgctggtaaaataaacgctctccattatagttttggaaagacaatattcctggaaggagtttagttgtcctcctgtcaatgccctccaggctgtcaatgtcctgttaaaacaaggtgctccagatggggtgagtcctgcgtatcacacaacaggactgctttctccctgctctgagctccatactcctattactgcagcccaaggcagaggttaaagcatctactcagttcacttgggagcttctagttcaaggaacactatgacaaataccatttcaaataagtaacgttttttaaagaaagagaataatcaagtgaaaatgtccattctgtgattcttagtctcttaaatcaggtttgccaaaaggagggtccctgctccccaacatctgccactatgaataagtggtgcatttataaactgcctgctgctatggtctgctctggactggagaccagcgacccatccccaggcctggctagatttcatccagtcctggtaccaggatgcacatactctgtttcagtggcttgaagaactctctacatgaaccagttagagcagccaaagagctgtgaacaacagctggacatcttactagtttaaaattttgaatttagagcaaagatggcaccaacgtggccgggtgcggtggctcacgcctgttaatcccagcactttgagaggctgaggcaggtggatcacgagatcaggagatcaagaccatcccggctaacacggtgaaagcccttctctactaaaaacacaaaaaatttgcctggcgtggtggtagcgcctatagtcccagctactcaggaggctgaggcaggagaatggcatgaacccgggaggaggagcttgcagtgagctgagatcgcgccaccgtactccagcctgggcgacagagccagactccgtcccaaaaaaaaaaaaaaaaaaaaagatggcaccaacgtgagtggcagctgcagatagcaccaagaacccttttctctgagtggtgagtgacagtggcactaagcaggtagaagccaatcagcctcaagaatgtggtgacgcggtttataagacagtgggggtgaaggaaggtgaaagggtggggggcagggttgggccaggttgtggacaaaggtcagcagactaagagaggcaaacagcgccagatgagactcccaggaaccttccaaaaagcccgggagccagaaaagtccccaggccccacttcctgctccagctgccaagagagggaagcagctctcaagttcaatgagggcagaaatcgggctcatgtcccaaggcagctgtaagctcaggcgcccaaggcttcagataggtgtcccacgtgggcctgagggtgaaaaagctcattcttcaaaagaagtctgatttttggatgaaatttcccacttttcaagacactacatggacgagacaaaacccatctgtgggaatgcagcagggagaccacgtgggatacacaagacttgggtggaagagggagccctcaggggcgggcatcacctcgggcacagaacagggaccccccacacaggttgggaagatggaactgcctcctccctccgtgcaatcgggccggcgggggggccctaccttcagctccagatcagtgtaaatctgcggcctcagcaggctgagcaggtaggacgcgcgggagaacttaaaccctgaaaccgaatccgatgaagactgtcaccaggggtcaccagggatgaggaccgtcaccaggggtcagcagggatggagaccgtcaccaggggtcagcagggatggagaccgtcacccggggtcagcagggatggagaccgtcacccggggtcagcagggatggagaccgtcacccggggtcagcagggatggagactgtcaccctgagtcactgccctccactcccccatgccacatcagagctcacctgggatgatctcctcagtgacagctgcacccccgatcacatggcgcctctcgaagacggcggtgttcacccccagtctctgcaggtacgctgcctgggaagtggggcagcacacagggccctccctttatccctctgaaatgtcagggctccctcgggctgacccgcagactaaggtcctcactataggccagtatgggccacaccccatggcctccctgccccgctcatgctgttcctgcctctgggaatgcccttccctgtgcttccctttccaccctcgccttttctagatgtcctctaagatccgacaggcctgctcccgcccctccacttcccagctgaaagtggtcttccctccttagaggcctggtgcctcggggactcacgctgcttcctgccaccctgccctgggatgtcgctctcctccaggcagggagccagcctcatttctcctacaagcgcagcacagtgaggtggaacttgtgaatgctgacccttccacccaggttcagtccctcgttctctctctgctgctgcagcctcagtacctgatccgtctggcctcagtttgttcacatgcaaaagtggggctgatgaaagtagtcccggctttacccacttcataaggctgctgtgaagattaactgagctggttcctagacagggtttaagtggtccctggcacagagaatgtactcagtaaatgaagcggttcatagcagagctttattttgggagaacaaatgatgcaaggatttctattaatttttttctagcacttagtggaaaaatcaataaatatttgttgaaccaaactggtcatgaatctaccgatctaaaatgctggccctgtgaccacaggaatggtgccatgcaaaagtcggacttttcaaaaagctcacttggcagctattatgtgccagaagcagtgagtacattgtcttgtttaatttttcccaccagccaagaggtaggtactatgattctcccattttacagatgagaagactgaggcccaatgaggttaacagcttgcctcaggctcacagagctgatgagtagaggtgttgggaattgaaaccagacagcgtgaaaccagcatctatcctcctaacataacctcctatcataacctactgagaaagaaacagcagctgtcactcagtggctgaggcctggcacgcaaggtgagctgcgtcattctcctattacacaggaacgatctcacagattgacaacctcaaataaggtttctatgagactatgataaaatgaggcaagcacaaacaaaagcaatgtctctgtgccatccagaaaataccgaacacccctcttggctgaaatgagtgactgctacttctttatcaattactgctctctgcacactcgtctctcctccctacagatcagatttcttgagctgcccagttgcagggctgtccctccttcctgacagtatctaatctgtggcaacccctattttcgtaggccttccctcaaatcaccaaagctcaaatcctgtgctaggttctttctaacaccttcctactgaggcaacccgaggttcccctgatgtgagttccctcgctgcaaagagcaagaaaccaaactagactaactacaagtgtgttcctggtgggctttgggtgaagggctgtggatgccagccttccttggcctggaaacttccagtaataacagccaccatttgggcaaggctgcatgtgccaggtcctagcagcaaatgatctattaccttcacagcagctctgtgagggcaggtgccattgttccattttaccgtgactcggagaggctaagtgacaccttaaccttcacaaagtggcagagctgggagatgaatctttgtttatattaatataaaatcaggccgggcgtggtggttcacgcctgtaatctcagcactttcagaggctgaggcaggcgggtcacctgagatcaggagttcgagatcagcctggccaacatggcgaaaccccgtctctactaaaaatacaaaagttagccaggcatgatggcggctgcctgcaatcccagctactcaggagattgaggcaggagaattgcttgaacccgggaagtagaggttgcagcgagccgagatcatgccattgcactccagcctgggtgacaagagcaaaactccgtctcaaaaaaaattaaaataaaataaaataaaataaatgttttaaattactgatccattgagttacaaaatgccgcacgtaaaatgttcaagtaaaacttagacatcaggcaaagtattaaggtttaacatcagtccgttagcacagccacagtttccccctatattgatgttctagagctgctgctgcttcaagaagatgttccacatttgttttgtggccttgaatgccttctgtggcctcctggaggtatctggactcaggttacagaagcataagctaaggatagctctgggatatccagctcagtttgggatcttgaagtcagttgtgttggggacagggcacaggcccttctgctagactgagctcctcaatgtctccagggcacactttggccacatagcagctatgtactccaaggtggtacctggcctggacctggctgggaacacagggctctagacacaagggctgcctatgatctggagtcaagggcccccaccccgccccaggtgcccaatcccctggttcccacctgctctcatgctgtgttggttacatgcttccccaccttgtcagcttgtttctggaagctccctgactccctcacaggccatggggaaaccacctttccccattaggggaaggggaggaaaggagcctgtgatgtccacagctggctgcagatgagcattcgacccagcccccagtcagcactggagagcagagagcatcgactaggctgccttttccttctctctcaaggcccttatcccacctgcttcttcacactccttcccaggctgctgagagccacacgcccagggccagtgaagtgggatcaagtggggaggtactcacagccaccagtccgttgtgtcctgcaacaaaacgggacagggaaggaaaacatcactggtcagcgggcgggcagacagacagtccttgaggaatgtgctccccgctgcccgtccccatgccatgaagatccttggtgaccctcccctccccttcccgcactcagatgttggaacagcatctagttcaactccatgaaacaccagatcttcaaggagtcagaaaaccctggttcttgccttggctggaaaagtcctgctcccctggcttggtcaggggctctgctggagtgaggggctcatgagagcatcgccagggcttccattgcttgggaggcgcaagtgatggtgtctgagggagcagcacggttgagttggcaagcaggagaagcaatgggtggctggcatgctgctgcgccaacgtcccgtctcgcatggcagcatcagcatccaggggagtgctggtcatgtaggtagttgctatcaagcgcggcttgttttgtccacgtgtggttcacaatcggcacagtggtgccctagaaggctttattcacatgggttttttttttttttgccaatccccagtgttccaaaaataaaacatgaacagttcaacatgaagtaaacatgcacagcttcaacatgtgctggagtgactagctgtgcttcagggtgccttgagctgagaggcctgaatttggctttggcatctcacgttccacaccaagcccctgggtagcaagtgcctctccagctctgataagctcagaatcacctggaaggttgtataaatgtcgactcccacagacccccttcccaggagtctgttcagcaggtgtttcacagaaccaaaagtttcatgagctaaaattaactcttaccatatgagaagcatgtgagaagctagttggttacagttcatcttaaaaagtgctggttgacatactctttatttgtatgggcttttgaaaatgttcataagaaagtttaaacaatccgccagtgggactcatgaacagatggaatctgtctctcaaagacatgcagcaaactaaaggcagacagtcctgggctcagcccagcctctgctatttgccagggcatgacctcagagagtcatcagctgccctgagccttgagtttcttcacatggggaacagagggtgccagggaccctgcagtgtggcaaggatgagataaatgggagctatttgtcttttaattggtgctgatgatcgatcttggaaaactcatagtcttccaggcaactgggtccagttcaatcatggcagacctcaaatgagtaaggtcaaggatccaaagcacaagaccccctcccagtgaccaccctcaagtcctggctgagccctccttggcttctggtgacacctctgttcccttgaagaggacttcagctgcgggctctgctaatccccagacctgcctcaggggccccatagcaggcgcctgggcccttgaggagctgctctgggcgtgggctctgcagctgcctgcatcaggcagtgttggttgggtggatgtgctgacctctgggagacacctcccgccctcagaatgctcgtcaccaggtatggggccaggaatctccattttaacaagccccctcagtcactctcaggcacatttagtcaaatgactaaatgagattcatcttcaaggtggcggccaggtgccagtgtgccttcagggactcagaggtaacccttgtctcagaagatgccgttctgttcctcactgaggcccaagatgcctttaaaccaggctttatggtatgtttagcaactaaagaaatcatgtcaaggaaaagctcacacactgagactcactcgcacttgtaggcaagtcaccaaggcagctggtgacctaaagtcaaccttccccattaggagacagcagggtgagctgtggctgagcacggaaggaggcagggggcttctctgaggctaagtgaggtgctggagatggctcccaccagcccggggagtttgtgagccggctgtcaaacagccattgatataaactaaattatataagcttacaattaaataaattaaaaacaaaggtaataaatactcaaaacacactacctcctatttgttttactacatttgactgttgcccatgccctggcagtcactggcctctatgtacatatctgcatggtggacacactatacaatgatgtgctactgggtatctctcctaaatcacattgagcaacctcatcttggtaacagaaaaggctatggtgggagtatttacaccactgtcatcagcaaatattacacagaagggctgaatttattttttgtggtcaggcttaagaaagtgatgggaaaatgctaataatgcagattaaacctaacagtgttagctgttatagcatgaataaatagcacaaaaattgaaggaaatattctagtattagaacaatattatcttatttgagtaacatcattcctgtcatttaaagaaggaggccgggcgcagtggctcacacctgtaatcccagccctttgggaggctgaggcaggtggatcacaaggccaggagtttgagatcagcctcgccaacatggtgaaaccccgtctctactaaaaatacaaaaattagccgggcgtggtggtgggcgcctgtagtcccagctactcgggaggctgaggcaagagaatcgcttgaacccaggaggcggaggttgcagtgagccgagattgcgccgctgcactccagcctgggcaacagagcaagactccatctcaataaatgaataaataaataaaataaaaataaattttaaaaaataaaggagtaaggttgggacataaatctttgttgtttcatttgtttcacgatcatcctactctttacagaaaatatggagcaccgttctctttggagctaccctcatttgtcatttgcaactataggttggctactgagtttggcaaaaatcaaagaaagcctttggtaagaatcactcgggtagactgcatttaaattgagagtattgtatctttatttgtaaaattgtgtgcagtgtatcttttatttcaatatttaaaataagcatgtgtatatgtgtatatatatgtacgtaacacatatacatatatatacacatatatgtgtgtatatatacatatatatacatgtacacacacacatacatcacacatttttccctggagaggtgagtgttgagtatctaccagctcgcaactgctctagtacatatgaaaatgaaggcatgccctcaaagctgcatgttgagtgccgtctgctttcggtcccgtcattatctctgtatagacccagttggcaatcatgcatttggggccctctgcaagtgtgaaaggaaggcactaaggaaagaccacctggtcctgggcctgcctcttcccctagcacccagtagactgtgatactctgagcccaggggttggcaaagtgtggcagatcactgcagatccccaaatgtcccagagctgcaaggcaatggggtccatctccctctgcagacacgcagtaggaactctgggactcagttctgttttatcctaactggcctttatgaaatgactgcagtttcttgtgacgaggggtggcctcagtggtaaggtagtggtgaccagaactcagggcactgagggggcggggtgctggatttcacttgtctgttggcccagggctctttccaacccttacaaaccataggctgagaatgtggtggaaactaggtcactttgcaagagatatagggaaacccctgagctcacctagtcttcctgtcattctccatgggaagatccaagcccagagaaggcaagcatttgccccaggccacacagcagagccagcaccggaatcccaggtgcctgcctgccagatggaagggctttccattgcagcccctgctagcgtataaacttctggctgggttatgccagaggagagagcagtggggcttggctccccctccccctccccaccaagctctgagcagggctgtcttcccgcccctcagctctggcccggcctgctttaccactttacctgctcctatcaccaccgcatcatactcaggcttcagacctcccctggcttccgtgttatctcgtctccacgccgggaagggagaggcggccacagccttgcagagacctcggccacttgcagccatttctgccccaggctgggccttgctaggcagggagtttgctagcgattggcttttgtgctgccctaggcacggggtggagcagggaggaagcaggaagaggaggagctgcagtccccctccaggccccctccaccatgcattcttggccacaggccagcctcctgctgccctggggctgtgctgggccgtcgggagtgttgcctattaaccaggcggtgtcacctccaggatgcaggggataatggcaaaactgacaatccactggggttcctatgtcaggctggcattgtgctgaaccctgtaggcaaaactccccattttacagatgagggcgctgaggctgcggggttagggaatgagtggtggaggcagagtggagctcgaaagggccctctcctcccctgtgcatctaccttctcagtcagaactgaaacgcctgggatggcaagtgctcgtgtcagactctgctccaactccatgctgagtctgccagtgcagagtggtgatgcctctacgcccacaggaggcgcccagggcggccatctagcgtcaccacgaccagggccttcagacaccgcagaggcagctgtgtctgtcgctgaggagcactggagtcctctcctaaatgctcaaacacaaacccacaacgagggcttaggggcaagttcgctgtctgtaattctctggtgttttagttttgaaggcctggccagttctcctcttttggcaccttgcccattttccaagaatccccaaggattcgaggtcacatctgtaaatacctccagctaaagttctttctgaccctcccttaggcctgccttgaattaggagcccctttgttctctgcccattacttagcagagtgttcccctaggaggaaaaaaccccttggagcggagagttcctgcactgctctgatatcgcagtgtgacggaaacctgctattggtaacgaatctcagaactgggagagtatgtggagatgatcctaagagggggttccgaggacccctccacacaccatggacagttaccccgcatgtgagcatctctgctaagatctgattcaggatgttcactcctgtgttatttattatatagaaagatcaaggggactggttaaactagacatatcacatccagccgctgctaaaaactaaagggaaatagtaggtgacaaaagcaggggtcctgaacagtggtgggctcaggggattggagttttttcctttatgtttttctgtattttccacaatccacgcttttcattgccattccatcagatgatgttaaggaggaacacagatccagtcacctgaggggatacttcctcactgccaccttctcagggtttagaccaacatgtgggttctagttcccccagccccaaagctgttccctgcaaggaagagatcagtctttgagcaaattttggctcaagactaaagacacagaaggcgaggctcctgcatgcacagcacacggccatctgatcctgtgctgcagtggacgctgactttcgccacgccgtcctctctggcccagcaccggcctcctggcctcagaggagcagacactcccagtcccagggctctcagggtctcttgtccctgggtccattctgggacaggaacttctcggttggaagagaggggctgtacccctcgggtggtggttctcaatccagggcgcaccacagaagctttgaaagacatcaaaggctgggctccacggccgccaagggaatccaaatctctgggccagggccaggggcttgagaaccccagccctagggcagacgccagccaagcatgaaggggctgggacttagcaagggcttatcagcactgacagaagggtctagaagcactagcatgttgggcttcagtgataacaatgaccaacatttattgagcacctaccacactgggtaatcctcacaccaccctgggacggaggtgccatcgctttaaacgtggggaatagaagaaacttgccaggaggtgcagagaggaagtggcagcgctggaattcaaacccaggcaaaggagcaccttttacctggggtaggagagagcttgctgggtgggcttcctccacgcagggaacagcagagatggggcttcctccccatctcccaggataaaggcagaggcagctctggaagaggagctgttgccaccgttgttttacaaacaggacccctgggcttccctcttcctccagagagaaggatctggggccttgctcagtacctgacatggagggtggtctaggtggggttttagaagccctggggccaccctgggcactctgccctatcctcaggatggccactgcagacaggaggctctcgtcatggggaacagtggcaagcaagggtggctggaggacaggatgcaaaggcagactgcggccaccttggcctagagcagggggatacgggaggcctcccagaggcgccgggccagctggccggcctgctgcaccagcaggtcagtggggatgacagacaggtgcagggccagcagctcgtagcacctgacagcctcggttgggcggttcttgctgtagtagcgcaggagcttcctggggaggaaggggaggatgggattcaggagtgaggctgtggcactcctccagcgccagaggcctctctgggccctcgcaagcaaatgcccatgccctcggtcatctcactaggcccctgcatgtgggccttgacaaccgctccggttcctcactgacctaacagtggcatcctggctacgaggtagcagtggggatgttctgggccgggcacagacgttccccgtgctgccaagaccatgccagcaggaaggtggtaggaacacagatgtaccctccacacccgtcctccctcgctgcacacagggccagccgggaaggtgttcccagcgtggatttctgggtctgaggtagggcactgctgaagcagaagctgctcccggcagaggcgagcacttatcacccaaatgggggcatctgtccccagtggctcccaacgcagcgtcacctgtagtagtctcctcccagcatgccgataggcactgagtcgtcggagaggacgggcacctcgatcatctggagtttgtacccctgaggagggaggacagggaggcagtgggtgtgggggtagtgcaagggcctgagtcagacgcaccgggcttgcggcctggcttggctctgtcatgtgcgctgggtgcttgggaaaatgcctggaccttgttttttcatctttgaagtcagaatgacaacagtcaccttatgaacattagagaaaaagtatacaaagcttcaagggccggcagggtagctctcattaccgtcaatacctggacctgtacaggccacaaacacacgctcaggagggcaccctgcagggctgtcatacaggtcttgaagagcagagcattcacaaaaggcccaagcctctgctctgaaagaattgggaattcccagggtgggataaggtggggaagggaattaagatctgctggacgtgccgtgtgtgccaggcatgaacatggcacttagctgatgcttgcctgggcaccgtggcctgccctgcagggggagtggactccctagtgtgcagggctgcccccacggcaccggctgggctgtgtggctggcattcaaacctggcctctccagcccacagctctgcctcactttatcaccccacggggccacccaagcacacagactcctgtccctccctagaagtgaaggtaaaggtcacaggaattttctagcacttctgttgtacacacgtcctgggcacttctgagggcacggaggaaagctgggagcctgcaggccgggggagcagagcttgggctccggcttcctcacttacagcctcggtggccctggccatggcgtctgatctccggatcattgtgtctccatccgtacaacggggtcaggaatccctgccccagccactttacagggctgtgagggggtaactgagagaacagtggtggagagccccagtaaccgccctgccctatggaaagggatggctgtcaccctcagtgaacaaagagtgcagggtgggggcaggggaaggcacaggagtgcagggacccagagaccaagggctgcgagggaggaggaacactcctgagagctggaacaaccactcctgagagctggaacaaccacttatggtgacaagcgagatgcaaataaaagagaaacaggaggaaagcgaagaaagggaaaagacagagaggagggagagacaggaggagaggagtcccagccactgcacccctcacagccctgtgcagtggctggggcagggatccctgaccccgttgtatggatggagacacaatgatagtaagctccccccactggaccctactctgcagtaacagtgaggcccagaagaagcagtgcagggcctggaggccagggccccgagccacaccaccagtgtctcctcaggcagcctggctcactgcttcaagcaggggcctatgctcttgagttcaggggcctatgccacagggatgaccatgtgccacacttggcatgtgacgctggcgacatggaagcactagcgacaaagtgtgtggtctgagtcgcatttctcacagtggggcatgtgcctttctgctcacatgtgtgcctggatgccacgtggacaatggcaagagtttgccagacagctgggcagagggatcacaaagcagttaaacgcccatgtgaaaatgtgacctctgaactctggctcccaacctgctgggcttaccagcaacaagaagagaagatgagacagacagacaacaattcagaagaaaggaatccaagagttacagagcgggaagtgtgtgtggcccgtcctggcccagggactcagcctcacctaccatgtcattctcgaaccacaggaagtaggagcagtagaaatccccctcctggaacagcagcgtggtgtagcccttctgcaggtatctgcgcgccagctggatcagagaccagacctggggaaaagacagcaagcatcaccactctcccagccttggtctgcctgggcagctctcacctccgaaggaaggaaagggcacagccgagaagctccgtgagtgccaggggcctctcctagtacccgggcactgccttggctcagagcaggaggctcaacaataaatcattattggatggatggactaccctccagttagcgtgggggcaaaatatatgtaaaaaagctttgtgtaactttactatacacatatgccataaattagtgaactgggctagtgtggtggcttacgcctgtaatcctagcactttgggaggctgaggtaggtggattgcttgagctcaggagttcgagaccatcctgggcaacatagcaaaaccctgtctctacaaaatatacaaaataattagccgggtgtggtagcacacacctgtagtcccagctatttggggggctgagatgagaggatcgcttgagcccaggaggtcgaggctgcagtgagctgtgcttgtgccgctgcactctagcctgggtgacaaagtgagaccctgtctcaaaaaataataatattaaaaaaaaaataaattagtgaaatgatcattcaggccagagaatagccagggacatcattaatgaacacaggagaacaaggtgtggtctcctgaatcccctcctctgcctggggtcgcccactcacctagtgcccttcaggctgggaactgatggcacaggtgagtgaccctgtaggatgtgctgagccaggggggaagtccaaatcagagttcaccaaggggtcagatggaaacacagggcctgagaaaccacgtgccttagctcccctgggaatgtcctcctgcctgacgcagggactgtcaccagtgctgccggtgaagtgccccagggaaggcagcagggacagtgggctctctgccacctctcagggctgggaagagactcgaggagccctctcctctacccttaacgggagggacaggcgatctgctccaaactgcatcgccgtgtgattactcattaaatctgccatggattgactgtacttttcaggaaagtaatttgacaacatccatcaataatcttaaaaacattcctcccatctgacttaataattccatttctaggaatccatattggggacataatcagagatggggacccagatgtatgcaaggtgtatactgcagaattatttataacagcaaaagcctagaaataatctgtatgtctaaacatcagggaaatggttcaataaattatgttacattcacatgatggactattatggagctgctaaaaatcatgtctataaagagttaatggcatgagggaaagcatctgatataatgtgaaatgaaaacatggtagcaaagttgcacatacagagtgatctcaactacaacaaactgcacagaaaaccaacagaaagaaacgtaccaagataaccccaactgtctccagaatgaggggcaaggatgaagatggtgatgatgatgccaccagtaagtactgaatgaactgtatctgtattttgtgctacgtgctatgctaaatatttgatacgtatcctctcatgtactcttcataactctgtgatgtaaatagcactattatttccttctacagatgaggaaactgacccttgggctaagtactgcccaaagccacataactggtgggagacggggctgggcttccaacacatgcctccaccacccatcttcccatcttgttttaaacattagaatacactttacttgcctcccccaccaaaacaaagaaagaaaagaacacacacacacagacacacacacacacacacacacacacacacacacacgtatagtttttttggagagtggcaggggtcctccccctatcaaaaatacaactttgtcatgaaaaacagtcagttaaataaggagaataaaagaatttccagggaatgcttccttaacagaaatcaccttgttttaaattctgatgcccaactgatggaccttgccgttctctccattctagctcattcaacaaatacttgtcgagcatttatttatgccggcactggccactgcctccttgggcctgctgcccagcgcactctgctagccccaggcatgtggatcacaccaggaagggctacccaatattggctgaggcccacccatccccgccctgggtccaaatggttaccttagttttgacaaaggcagccagcggccccttgcccaactccgacgaggtcttttgactgcagttgagggaaggcgccaccatctgcccagtggtgcggtccacatagatgaagtgcaccaagcctgggaagtcttctaggtaggtgaaggtctgagttaaggtgcttacaagccaggagctagggacggcctgcctctgtcctgggcttctagctgtgcccagtcatggtggcaggagggccaggactgcctctttccagcagcttccatttcagctaagccccctgtatccttgcttcctcagatcccccactacctccaagctccccaggccttgaaaagctgtaagatcctcaacacttgcacatttgacacgggcagttctggccctacaggaacatggtatgcatcattttcatgagggatgaatttaagtcagacacacgtgaggctggagtgtgagcacagccacttggttcatgagtgagcctagctgactgcccagcctatgcacctcactgtgatcttgctaaacccttacacttcatcatgagagtttggaaggctcccatttgggaggggaagagacatccatagaagggcagcagctggtggctaaagaggccctctggcatcctttcacctgcccactgaggacctgcctcaggagactgggggctggacatttcagagatgatatgggaaaagctgctttacatgaattttcatggaaaatcagtattcgataaaattagtgttccataataaaagggtcaaatagtcttaggaatggcttctgaaacagggataaacatttgccgtaggccttctagagcttttacatgccactgtgcactgtcatgatctaagaaggacaacggccctttcaaccaaactagaccacaggaaccccccccccggtccccacccctcgtggaatacctactaccattttgccagctgggcaacactgacataaagggtctttatggcttttgtgaattaactttgggacaggaggaattcctgaaatttcagcttgaagtattcctatagacaaggcacatgggccactatgtcccattattttccttcagagaggtggtgagcagctgatggggtggaacatatatcccccttccctggggcccatagtccctccagggagcaggtgtagaggcagcagatccaagaggcttgttgggctggctggggccccggcgtcaggatatgacaccatggtgatgttcctcctgctcttcaccagcaagaagtccttccagtccgtcagcttctccctgccgagggaagctcgggctgcgtgaaggaagtacgggccccagaccctgccctggccacccagggggccgcactgcacttaccgcatgagcctctgcacttggtcctgcaggtgctggggcaggtgtgggcctcccctgctgggggctgtggtcagaaagttcagccggtagatggcgcagagctgccgcttcagcttcccacatgcctggagcagcctgagcacgagagaggagggcattacagcagaagggacctaggggagcccctcgccctgtgtggaccaccttgttcctgcacccaggacagacagacctggggagcccttcccccttgtggaccaccccactcttgtacccaggacagaccaacctggggagcccctcactcccaggtggaccaccctgctcctgcacccaggacagacagatggaaagacctaagggggcagccacagctgatcaggcaatgggaaggagcttcccagcttctccacgcggtgctccacgtatgtgggaagaaatctcctttcttgaaattattttgctgataaatgaagggcagtggtggaggagatgtggcctcccagggaacagtcccctgggcacacgacccaccccttgtcctgaggcccaccactcactcccaggaggatccgggctcacttttggagaaagccttggccttaaactccagccaggtgctctggaaggaagacagggggcaggtttgcatcccgaccatatttccagtgaggtccaggccaaagtccttctcagatcaggctctgagagggcacagggcccccagacaaatctgcccttctggccaatgcaggctaccctggcaggccccaccagccccctgcagacttcagtgtgccatgttctagtcactcagcagcgtttatttaaagggcagtttccaggggctcgctgtctgacgggcacaggcacacatagtagcaccgtcacagcaaccaggccagcccctcggggtggggggcacacacagggcagcggctggggtgtgcggaggaggtgctgctgcagaagctgggagggtatggggtgggcatggggtagccatgcagggggcggcctcacgggatctctataaagcagaagaacttggtgttctagtgaaagtgctccttaggacaccctgaggcactgcgggatgtggcactgcctcctccagccaatcctgcagccttcagactgacaggcactccagccacaatgggtcccagctcctcaaacaccaggcgcctccactgcttaaatccagagtcaagccccaccagccccactgccgtccaggccctgatctgggctttgtcagagcacggggtgatggactgtttctactgcctgcacattctcacctgtctcctggtctcagctccccacctgggccctaagctcactgggggtggggtggagccgtgacctgcacatccctgtgttgccctgtgagcccggggacacagccccgctgcagagaggaagcccg

SEQ ID NO: 326 - DNA, 179417 bp, Homo sapiens
caggaaaaatgtaactgatcttcaatgcaatttgagcttttctctgtttccaagtagatattttttatttgccatcattatgccccatttatgggtctcatcatctcaaatgtgaaatttcccactgctgggcatctgatctcattttaaccttctctcttaccttctctggcctttgaagagtgactaatgtactaggactccaaaataaccaacctcggagagtagctatcaagttatttttctgaggctcgcaggatcatttaacattactattactgtgtttctggaagacatttataattatgttatactgtttataaaatggttagcattctgggaaacaaagcttttagctttccataatgaaagcagctctattgaataagcattgcaaagtggcagagagcaccgttcataaatgaagttactctgcttctttatttgtctgtgaaatgacagaagaaataacctcaccagttgactgtaaggaccacaggacacgtttagagcccttctggaaatgtgggaggtactaagtgttagccgtggttcccagccctggaattcatctctctaaggcagctgtgtggggtagagagaatactgcacttctgaacacagcatgtgagtttcagtgcaaatcctgggtcttcgccactgttttggtaagaatttatttcagtgtctttgaatgcaagtgtggattaacatcacctgccttagctatacagcagggtagctgtgagaatcataacacaataatgtaatatgaggccgggcgtggtggctcacgtggtggcttacgctggggctgtaatcccagcactttgggaggccgaggctggcagatcacctggggccaggagattgagaccagcccggccaacgtggtgaaactctgtctctactaaaaatacaaaaattagccaggcatggtggcacacgcctgtagtctcagctacttgggaggctgaggcaggagaatcacttgaacgtgggaggttgcagtgagccgagattgtgccactgcccaccagcctgggtgacagagcaagactgtgtctcaacaaaaaaggaatgtattatgaaagtggtgtgtaaaatgaaactctttagggagttattattatactttgtcttttacagttggttccctggttttgaacctgccttggcaaaaactataacaggaaatgatgacagtgaaagagatctgatccaaccaacccccattttgcttttagcttccaagctgcccatagttattcctgggtttgggccaagctaactttgggagagacttagtttacagtttcaatgataacagccctttccccaaactaaagcacctttgtaaagctaatgaaagacaatcaggttaggagactgataggaagctgagttctgctagggtgtagacagaaatggttaccagccattgttccggaggccacaagatgtacaacttccccaatcactcctgcaaatagcatcgtatcatagaatttaagattgcccttttgagatgcctttttcaggtttttgcatttctgatgactgaccaatggcttcacctggacccaccaaccagtcctggggccacacccagaagcagactcagtgctcacaatgaccattccccacacccctatgattgcacccccaaccaatcagcagcacccgttcccttgattgccaaactatccttgaaaaatcctagcctccaaattttcagggaggctgatatgaataatgataaaaccctggtttcccattcagccagctctatgtgggtaaaactcttcctccattacaattcccctgccttgataaattggctgcatctgggcagcaggcaagaagaacccactgagaggttacagtttcattcctcaggtctattaatcaggttttccagagaaacagaaccaattggtgtgtatataaaagaagattaggaggaatgggcttacaagatgatggtgtttgtgaagtcccacgatctgccatttgcaaactgagacccaagaaagctggtggtgtaactcaggctgaaggcctgagaaccagggggccaatggggctaagtcccagtccaagggcaaaaaaagatgagatgagatcacccagctcaacagtgaggcagaaaaacaaaaggaggcgaactcctgtctctctgttttgttccattcgggccctcaatggatagcatttaaaagacagaaacccctaaattatgaatttcagagattatataggaactacatcatagctgcccccatcccttctagagacttggagagaaaccctaaaccttaacgtttttttttttttttttttttttgagatgcagtcttgctctgtcacccaggctggagtgcaatggcacgatctcagctcactgcaacctctgcctcccaggttcaagtgattctcctgcctcagtctcccgagtagatgggattacaggcatgtgccacaacatctggctaaccttttttgtatttttagtagagaacggggtttcaccatgttggccaggctggtctcaaactcctgacctcaggtgatcaacccgccttggcctccgaaagtgttgggattacaggcatgagccactgcgcccagccagaaatcctaactttctaatggaaacaaattgtcatagggaagagaatgggaaggccctatgtgttacagcaaatgccagtgcagatcaatgaatgcaaaggcacagctccaagagagataaacccgcaaatctctccagagtaattcacgatctgttttccaaaatgattaatattccctcatcctttaatccagtgttaaattaagtttagcctaaagcggcctccttgtaaatttggcctaaaggtttctcccacatagggaactataacgggatgtacaaacagactggtaactgcccttaccaatcaccgagttctggccaatcaaaggggccaactgtttaaactgccttcaagtgagagaaatggtaagcagtaggcaatttggctatctctggacctcacgtcactttcctttgcctctgacatggtggcagtgccggagtctccctcagcctattctggttcaggcagtagggtaggagcacctggcactgataacttgaccgtactctgagaatgaccctgtagggcgggcacacctgaatgtgtattcagagttccatgctagggaatctgggagtagcccaccccgagatccattccttttctatgaaaaacatttgatcccccaccctggcccatggaacacaggtcgtacaggggattgagaccctttgttttgggttaaatgaaggttgccaggtggaatttgttagagggagggtgtaaaatgaaaatgctatctaaactgcatgcattttgcaaggatttgcagttttcctgcttggcccactgccactggactctctcccctgtatgtaagcccccaataaaacccacgtctccttcgctggtgcgggatctcgtctttggcctcttgtacctggtgccatccctactgagattaataggggtctggcatgacaaagggggctgcccgattcgagaattgttctttgctcaattaaactgttacatttgtctagagtttttaatactaggttgccagtaacttttgctcaggaaactgagctacacagaaacatgaaaacattcatgttgttggccaggcgcggtggctcacacctgtaatcccagcactttgggaggccgaggcgggcggatcacgaggtcaggagttcaagaccagcctggccaacatggtgaaaccccatctctactaaaaatacaaaaattagacgggcatggtggcgtgtgcctgtaatcccagctacttgggaggctgaggcagaagaacctcttgaacccaggaggcggaggatgcagtgagccaggagcgcgccactgtactccagcctggcgacagagcgagactgcgtctcaaaaaaaaaaaaaaaaaaattcatattgtttcctgacagcaagtggagtcaaaagaacttgcctggatttgggggtgaggttgacagatgtttgtagggtgaccctgaggtttctggccaaggaaactatatggtgaggccatttattgggatagtacataggcaaaaactaggagaactggtttccctgatttgcggaggagtagggaattcacgggacaacatgaagataataaatagagttttaggtgcttgaggatgctcagtctgcagtttgaactcagtggcaggcctgggatgcagatacggacgtgggagtcccaaacaggcagtgatgtgaaattgctcgggcaagatggcaggaataacctggaccttgggaagaggacggacggtagagccaagacatgttgacacagtgtgtccaccttcggtttttcaacaggccattgtgaacaggaagagagaaatctgttaggcactgctgcccaacttgacatgctatttcacataaatgcttccccaactgcaaatctggggtatagctgttaatcgaccccagaaacaaagagaaaagtgaataattccctgaggtacccaatggaaggtgctaccaggctgtaaagtagcttcaatgtttctaaagcagtggtctacaagcctgtgtatgagaatcagctagggagagtttttgtttgtttgttttgtttttaaaccagtttcacctacagagatcctaattcaatcagtctgtggtggggcccaaatgctttaatattttttttccagctcccaggggatgctaacatgtatccatggtttggatccatgtccccgccaaatctcatgttgaaatgtgatccccagtgttggaggtgggcctggtgggaggggcttggatcacaggggtacctctcatgaatggcttggtgctgttcccttgctgatgagtgagtccacgtgagatctggtttaaaactatggcacctctcttgctcccactctggccatgtgtgatgcctgctcctgctctgccttctgccatgattgtaaactccctgaggcctccccaagtagatgctggtgccatgcttcctgtacagcctgcagaaccatagccagttaaacctgttttctttataaatcacccagcctcaggtattcctttacagcaacacaggaatggcctaacaccccaggtttgagcaacactgttctatagttacatgcacattatcttattaccatagagcaactcaattcaagaattcaagaacggctgccatgttttacagaggtattgctttcagtagcaaattatggtgattggggacttaccctaacattattgccttgtagacagtgtcctaacacatgtttccagacaaatctttaagaaggctgcaccttcacagagctcactggctatcttcagacaccaggcaaaacatcccctttgagcaaaggagatattactcagctgaagcttgcagaaagcagtacgatggggccgggcaccatggctcacgcctgtaatcccagcactttgggagaccgaggtgggcagattacttgaggccaggagttcgagacttgcctggccaacatggttgtattagggttctctagagggatataactaatggaatatatatattatatataataatatatatatatacacacacacacatgcacatacatatatacacacatatgtatatataaaggggagtttattattaactcacatgatcataaggtcccacaataggccgtctgcagtctgaggagcaaggagagccagtccgagttccaaaactgaagaacttggagcctgatgttcgagggcaggaagcatccagcacgggagaaagatggaggctgggaggctaggacagtctctgttttcacatttttctgcctgctttgtattctagctgtgctggcagctgattaggtggtgaccacccagattaagagtgggtctgcctctcccagcccactgactcaaatgttaatctcctttggcaacaccctcacagacacgcccaggatcaatactttgtatccttcaatccaatcaaattgacattcagtagtaactatcaaaatggtgaaaccccatctctactaaaaacacaaaagttagccatggtagtacatgcctgtagtcccagttactagggaggcagaggcaggagaacttcttgaacccaggaggcagaggtttcagtgagccaaggtagcgccactgcactccagcctgggtgaaagagtaagactctgtctcaaaaaaacaaacaaacaaaagtaatagaatggggaaaaagagatgccactgttttgtctaccattttccttaaaaagtagctgagaagcagctgatatagccccaaaatgaccattgtcacactagagcaacaagattagggaactgtaagatactagtaatagttcagagaaataaactgtttttgtaatttacaacttacaaaaactttgatatgtattgtctcacttgaattcaactcacccagaggtgaggagagcaaatacccccaacctcttgctaaagcatcagaagtgagtcacctgtctgttggtcagagccaggcctgacacccagagcttcttctccaaatcctagattttaataattagcatggtttacttatgccttagaccctcattatggagtgctgaatgcatactgtagacagatagcagagggtgccagtgaggtgagatggggcagcagcatgcagaggtggctgcacactgggccgagtgtcaggagatgaggcccacctctgtgtggtcacccattgcatatgtggaaaggtcaacacaacacttgtgacttcagccttcaatttcctctgctgtgagaccaccaagcctctttcaggttcttctattcctgcccatcctgttaaggtgcaaaagcctagcaatgcgagaattatgagccactttgaaggtaccaaaataccaacctgaaacaactcacaatggctgcgaagaatggaaaaaacatttgccaggtattttagtgtatatttacaattacagctttgaaaatcattttttttttttggcggggaggagaagacttgcaatttctatttcgcctggagtttagctggctttctccctgatctatgagagcaactgcctttctccttgtcactgccttctcctgtttgaaggaccatgacaaccatcatgcccttttcaagttctctgtgatgtcataaaagtccccaagacataattgcaacttgctttaactatggtgtcaatgcagcaaacaagaaatcgtggaatatcaatatggttgaaaaatcaccccccatttctaactttactcatttttatgaggtcctctaggtctaaacacctgcataagcgatgtctgtgagagggtgaacacaagaaatcacactgagtttgtcatgcttgtggcctacgtaccattctgtggctttctggtttccttcctttttggttttggtttcattttcttgggtgcgatgcctctttgtttttgcatttgtctgtgctagtttatcctaaataaagttccaaatgcacagggtcactatcacttaaatgatgttgtgtatcccctggcagagcttagggcacacactttcttttcttttcttttcttttttttttttttgagacggagcttcgctcttgttgcccaggctggagtgcagtggcgtgatctcggctcaccgcaacctctgcctcccgggctcaagcaattctcctgcctcagcctcccgagtagctaggattacaggcacccaccaccacacccagctaatttttgtatttttagtggagacagggtttcaccatgttgcccaggctggtcttgaactcctgaccttaagagatccactcacctcagcctcccaaagtgctgggattacaggcctgagctgccacgcccagccttatgtatttcattatacagattattatgtattccatttgtaagttctgtcctatgcatcctttatcagggacatttataatttaagtgcattcatttccagagagctggctgtttaagccgtgcaccactgtttctagctgggtgacctcaattacttaaccactaagcctcaacttcagtgcaaaacaaagaagaataaacattccttccttgaaagattttgaggattgaatgcaatgattgtttccaatacattgtttccaggtagagactccaggaacctcagtccccttctctccacccacctcaccttggggagagacccagtggcagattcacccctgtgcacgcccacccctactttcccagagtggccctgtgtgtctggactaaaccgttacaggtggggaaaactcaccactagggggcgggagcaagatgcctttgatggctgtcgtccttcagaccacgtaactgatttggaatactgtgacatattcacccttccaccctccgtggggagagagaggataaatgtgtaaagtctgtggccacggtgctgcattcagagaatcccactctagtgatcagcgttggcatcctgagaaaatgagaaccactgagccccagttaggacaactgttaaaatgtgataaaaatcttcagccgacccagttgcccttctgcaaacccacctgcttgttgtcctcggcacacggcatgctgtgactgctgctggctgcttaatacatcggggcccatccaggtgagtctcacctaaggaggagtcagcaaagcagtcttctccacccccatcttcctgccagatctctcaggatcagcgcttacagttaatgtgctacccgactttcccaggtaacatgcattaaatgaggctcttctagaaactgacgttttaaggaggtgattccattggcggcaaccttagagccgcaaaggactggggtcaatgacagcagagaggtcttccgggacttcctccctcgtccctcctcatctaggtctggccctggattttcctggaggagcaacttccttattcttttcaggggagctgaccaacgccttctccctggagtcttagccaggtctgcaaggatgcccctgccacttactggtgagatgtccactcccgcgcaaagggcgtctcactccttaggcccccaggctcccatctggctagctgtcccactgtcaaggacttgctcaactattttcccccttaaaagccaaacaggcaacaccaccacttgagaatgaaaatcatcaaaaccactgtgattagttctttgcctgcatggaattcacaaatactgattttgttgactgtaaacatagctggcttaatttatttctgccagttatgtcccaacacctccattaatgattttattttgatgaatagttttatacatctgggaggattctggtcattctaatgatatcttcttgaagctcttccaagatggatcaatactgaccataaaacatcagattcttgttaagtgcagacatccctctttacctgaaacacatcaaaatgttatttggtgttcttgaacaaaactacagacaaaggtggatttttatagattttaaccctagaggaaattcctaggtgtctaggtggtgggtctccaaatacaagtctgacaactgcgttgcagactgccaccaaggaaacaatgacaaagactttttttttttttttttttttttttttttttttttttgagacaggatctgctctcttacccaggttggagtgcagcagtaccatcctcccacctcagcctctcaagtagtggggactacaggcatgagccactataaccaggtaattaaaaaaatttttttcacagagatgggctgaagtgatcctgagctcaagtgatcctcctcctttggcctcccaaagtgctgggattacaggtgtgagtcaccatgcttggcctgacaaagtcttaataacaactttgaaacagataatgactcagaatgaattcaaatgaccacaaagacagttttccttttcttcagagtttattttgaattttcatttttggataaccaagcagctctttaagaagaatgcacagaagagtcattctggcacttttggatagtacataagattttcttttttttttttaaattttttttaatagtcacattcagctcgcttgctcaaaccagactcccacattgggtgagcaagatgagcccataggattccagagttaatacgtaaccgtatatacaaacagccaaaaaaccataatggtgccacagggatggagcagggaagggcatctctaacgtgtcctctagtctatcttcgctaaacagaacccacgttacacatgataactagagagcacactgtgttgaaacgaggatgctgaccccaaatggcacttggcagcatgcagtttaaagcaaaagagacatcctttaataactgtataaaatccaggcagttccattaaaggggttaagaaaaccaacaacaacaaaaagcgagggactgtctgttgtcactgtcaaaaaggcacttggagttaatgggaccaggattggaggactcttagctgatacagatttcagtacgatttcattaaaaggcttggatgttaagagaggacactcagcggttcctgaagggagacgctgagatggaccgctgagaagcggaacagatgaacacaaaggaatcaaatctttacaaccaaattgcatttaagcgacaacaaaaaaaggcaaaccccaaaacgcaacctaaccaaagcaaaatctaagcaaaatcagacaacgaagcagcgatgcatagctttcctttgagagaacgcataccttgagacgctacgtgccaacctaagttctcaacgacagcttcacagtaggattattgtgataaaaatgactcaagcgatgcaaaaagtttcatctgttcccagaatccgagggagaactgaggtgatcgttagagcatagcgacatcacgtgcggtttcttaatgtccctggtggcggatacgccgagtcctcggaaggacatctggacaccactttcagccacctccttgcaggggcgacatccgccaaagtcatcctttattccgagtaataactttaattcctttctaacatttacacggcaaacaggaatgcagtaaacgtccacgtccgtcccacggctgggctgccgttccgtttcctccacgaacgggtacgcgcttccatgagaaaggatatttggcaattttatattccacagtcaggtgggtctgcgatagctcatttaatgttaaacgccatcaggggcctctcctcccgtttctgccaggggcttttcttgtcttctccttggtcatcatcatcatcgtcttcctcttcctcgtgggcagatcttctctggtgggggctggctgctggctccgagggggcatccgcagtccgtctggtcgtctcctcctgcaggctgggcagctggccaccacttctccgactcgacccctccaacaagcatcgcagggcactgtcctcgggggtacagaccgtggtcccacattcgctaccactctgttccacgtcatccaggtacacgagctgcgtgtaggccgtgctgtctggggctcgaggctctttctgctggtgctcttggacgggcgggtagttctgctgcagagacaaagcatctccccttcccttccgggctgattttggttcattcatatctacgccagagtccaaactggcatcattacttccgttccttccagctctttggagatcaatgtatgaatgtctaacgtgagcgttggacctgccatccaaggagacgaaccacgcccgggggtgcggaagcggcttcccacccccaagctccatcagggccttttcagtcaggagctgcacctcactgttcatctgagccaaagccgcgtcgttcagggaagctgggatggagagagactccgacatggatgcgttctgagggctccactcccgggtgcccgcatcctgcaggtgctgctgagagatggcctgggaagacaggggctggggctggatctgtgaggacgggtgtgggaagatcccggcatggggattggacagctcagcctgtagtctttctatctcaagctgctgatcagccgggacgacgaggggctggctgacataggagtggtccccggggagtttcatataatgagccgggatgaccaaggcaggcagtactttcctgtaaacgctgtcattgacctggtcgacagaactgcagcagattaactggccgggccgtgggaaggacgtaggtctctcgaggtgatctactgatcgcgacatcatacattcagtgggtctgcggtccagcagctgttctttctcaggtgatgaaggcgcggggtacagatgttcctgaatggtgagtttgcttcccgtggaggctggaccttctctgtcctgcttttcaaataaaggctgtgagagcacggtgttgtaactacccctgtagtcatcattgcccgaggactcgtagccttctctttccatagattttcttgcctttaagggaaaaacctccactgacttatggtagtctttccccagcgtcccacttggagtgaggttatcaaaggagatctggcttttatcctcttccttgcaagagaggagctcctcccgggagctaaattcctgggaggtgctgtaggagagcttgagcatgggggtgtgcaggtccccttcgccgcccggagacatcatttccaaatggactccactcatcagttccttcgtgccgggggcctcggggcggccgtggctggtgacggacagcgggccagggaattctgacgctcggcgtgaaaacagcaagttaatgtgtgacatggacgtggactggtctcttttggaactctccagtcctgcagggagctgcagttttctgtggtgctgacgaggtttcaagcacttcctcctgcgcccaaagacacaatccaaagccaaagattagtgattctcacaatgaaaaagtttcaagtttcaggtaaaatcctaattctcaatttccatggggagagacaaaacaaaacaagtcaggagcagccaaaagccttctcaccccacgccctgtcttttttttttttttttgagacagcatcttgcttgctctgtcgcccacgttggagtgcagtgctatgatcatagctcactgcaggcttgacctcatgggctcaagtgatcctcccacctcagcctcccgagcagctggcaccgcaggcacatgccaccatgcccagctaatttttgacttttagtttttttgtagagatggcctgtgttgcccaggctggtcttaaactcctggcctcaagcaatcctcccccttcagcctcccaaagtgctaggcctccatgcctggcccttatccttattttatccttattagagtaggataatcgagagatttcatcttttactgtctggagagccctttgcctaaatgaattaaatgtatgacattcatttttctatgacttaaaaaagtcaacaacttattaaagagtctcaaacgtgactaaaatgctttgcatttttaaaaataaaatttttcctctataatgcctttttaaaacagctaaacttaaaggcttttataagccaagttacttatttcaaaggggttactcaagagttgacaataaatattcttgcaaactaaacagacacggcatctaaataagaataatttttttttttgagatggagtcttgctctgttgcccaggctggagtacagtggtgcaatcttggctcactgcaacctccaccttctgggtccaagcaattctcctgcctcagcctcccaagtagctgggattataggcgtgtgccaccatgcccagctaatttttgtatttttggtagaaacggagtttcaccacgttggctaggctggtctcgaacttctgacctcaagtgatccgcccacctcggcctcctaaagtgctgggattacaggtgtgagccaacgtccctggcccaaataagaagagttctgctttgcccttcagagtatcatctcttaatcagcgttcaggaatactctgaataaatcagatgactattgttaaactctttttcataactccccttctaagcaatgttatccacgcagcatgctttacacatactatttgttaagttgcaacttagatcacaaatgtgagttcttactttttcatgggaagaaaaagtacttcaatttagaaaaattaaaaaaaaaacccacctccatattaatgcttctaagtatcaattgcccaagaaactgtgaattaaaaaagatattgccaaaatggtaacactttacctgcaataatataaaaggagacacagcaaaaccaaaagtatgaaagccattcctcctaaaatggccaaaagaaacaccgtgtgatacgtggtaatgtcctgtgttacaacgggacctagaaggtcagaaaatggcatttagagttttgaacacctttaactcaaaagagggatcattcattgagaacgcagtgtcttgtgcttactcttcttagctggggcatagagcagtggccagaggaaaacgcccttggatcatgcacttggggtaccaccagcattgcattagtgattagcatgactattatggaagctcccacagccaggagaactttgaatactcaaagacaagatgtggttacgtcaagggcccctcctaagcggagaagtgcgcctcacttggtagcatgtgccgcatttgaaatacatgatctttttaattttttttttttttgagacagggtctcattctgtcacccaggctggagcgcagtgatacaatcatggcttactgtagccttgacctcctgggctgcatcaatcctcctgcctcagcctccagcatagctgggactacaggcacgcaccaccacacctggctaatttttataaattttttttagaggcaatgttctcactatgttgcctaggtgggtcttgaactcctgagttcgagcaatccactgcctcggcctaccaaagtgctgggattataggcatgagccactgtgcccagccatatgatcttttcatacaagaaaatgaacgcatgacgatataatgactgggactctcaccttcagaaagatggcctatctgggaattttatattgcagtgaaaaaaaaaaaaaaaaccctacaaagttttattttcgcttttcccgggcagtcaatcattaccgtctggagagcccctagcccaaatgaatcagtttaaatgtatgacatacatttcctgtgacttaaaaaagtcagcaacttttaacacttaatacaggtatcaaatatgactaaaatgatatccatctttaaaaacaagatctttctctacaatggcttttcaaaatagctaaccttacgtggccagagatctctttagaacttatacataaggttatcaaagataaaaatattttaagtttatgttgtaaaaaatcccaagaggtagcttaactcacattttatgttccgtagtagtacaaatctatcttaatgttactaacaacagatcagcgacaacaaaaacctcccaacattccaatatttaggtatttattggtgtccgagtttcctggcagtgtatgaatacatgggtcgaaatgaactggcctcatattatttcagggtagcatggctatgattattaaacaccacagacacccatttgcttatttttgatttttgacattctaagacatagactttttaaaaaatcttcttaaggggacaaatctcctaatttaagacctagataaacccaagatttaccagtttttgaaaacagtgatgttacttaaattcacaagaaacaccattctctttcagatataattacttcaatggagtgcgaggagggggttaaagtttacaaaaattggaaaaataactgacaattagatactggcttacttgttcagagaaacaatttttttttttttttgagacggagtctttgctctgtcacccaggctagagtgcagtggtgtgatctcagctcattgtaacctctgcctcctgggtttaagtgattctcctgcctcagcctcctgagtagctgggattataggcgcccgccaccatgcctggctaatttttttaagtagagatggggtttcaccatcttggccaggctggtcttgaactcctgacctcatcatccacctgcctcgtcctcctaaagtgctgggattacaggcatgagccaccgcacccggcccagagaaacaattttttcatgcaaagacaatagacaattcccacggatgtagcaaagctttgtcaggagtcaccaagaaacttagggtacacataaaagtatttccaaatactgatgcttcgtcctttaagtactcaaagcattattgttttgttttgttttgttttgagatggagtctcactctatcattcaggctggagtgcagtggcacgatctgggctcactgcaacctctgcctcccaggttcggataattctcctgcctcagcctcctgagtacctgggactacaggtgtgtgctactgtgcctggcaaattttttgtatttttagtagagacagggtttcaacgtgttagccaggatggtcttgatctcctgacctcatgattcgcccactttggcctcccaaagtcctgggattacaggcatgaaccaccgtgcctggccagcattattgttttaatctctgccagtacgattctttataaaattcacagctatacttcacttcaaggagttaaggaacataacccaaattattttgttgttgcttttgagttcatgaaagcccaatattagtataattttttgtaataaaggtgggttgtgagatgactgacatatgtatccctacattaaataccatcagaggctgtagtgggtatgctttgtgttatttttgagatggggtctcactctgtcacctacgctggagtgcagtgacatgatcatagctcactgcagccttgaactcctgagctcacgggatcctcctgcctcaacctctcaagtaaccgggattacaggtgaatgctaccatcactggctaattaaaaaaaatttttttagaagtggggtcttgctgtgttgcccaggctggtcttgaactcctgggctcaagagatcatcctgccttgcctcccaaagtgctgggattacaggtgtgagctaccatgccctggcctgtgtatgctttttatagccttgagtctcttccttcactgctaggaagctctcaggggagctacgtctggcagttccttcatgctgccttacaaaagcatatactggacaggcgcagtggctcatgcctgtaatttcagcactttgggaggctgaggcggggggatcaccggaggtcagaagttcaagaccagcctgactaacatggtgaaaccctgtctccactaaaatacaaaaattagccaggtgtggcggcggagacctgtaatctcagctactctggagtctgaggcaggataattgcttgaacccaggaggcggaggtggccatgagctgagatcatgccatggtactccagcctgggcaacaagaacaaaactctgtctcaaaaaaacaaacgaacaacaacaacaacaaaaccaaaacacacacacacaaaaagcatgtactgatctactgcatgatgggaaaactaatagctgagattgaaatacatctaaaattaaagttcattttaatgcgtgggctttatggcatttattttagtgcttaagacaattcttttccttcctttgtttctcttcagtcataatctaggtatttcagattcagagaatggggcatttctacgtgtggttcatgcttatatcactacaaaaacaatagcatcaagggaaacacattaatcttttttttctttttttgagagggtgtctcgctctgtcgcccaggctggagtgcagtggcacaatctcggctcactgcaacctctgcctcctgggttcaagcgattctcctgcctcagcctcccaagtagctgggactacaggcgtgtgccaccacgcccagctaatttttgtattttgagtagagacggggtttcaccatgttagccaggatggtcttgatctcctgacctcgtgatccgccctcctcggcttcccaaagtgctgggattacaggcgtgagccaccgcgcccggctaagggaaacacattactcttaaaacagatgtgaagtgtaaattttcttagtatggtgatataaagtcattgtaacacatttttccacacctgtttaggaaagacctccatcaaatcagttactttgtgagtctaagtgctaattccagtgataattccattgctaaaatatttgaacttgcattttagaactgccttcatggttcatttacaagagacaccttttaatcacagcacatttcgacctagctaagtcacctactttattcaccagtcttgaatgtgcatgacttttagatgtctttaaaaagaaaaatcataaagatttgccatttgagcataaagatttgccaccaagaaagagatttactaatgaaggcagaaggcagtccaagtaatatagattctaaaggcagcttgagcaacagaagctatcactggaaataattctcctgagatgaccattttgaaaacaaaacaaaacaaaacaaaactcaacaattctagaatatttttgggggtaacataggttaaaaaaaataaactattggtcacgttctgaaagatatgcattaatgcacatatcctaaatggaggggaagattctcgtagatacaaagcaactggtttacgtttaagccattttggaaatgccccaccaggctttttgcccccagtggtgacttcccactagcatctctgtggagtgcttttccctacatgtgtgcctataccaggccacagctgtttcaggaattagggaggaggtcttgctggtctctgtgggcttttgatgaagaattccctatggcagctgtctgaacaaaacagccactcaagactattttctatgcattattcttaccctagatggaagatttccaaccagaagtcccccacccccgcaaaataccttctttacatcatctcattttcagacttttaaccatttttgaataagatgtgatcgccctgctgaagttattttcaagagcatacttagcctgaaccctcaaagaccaaagcaactgatccgcatcatcgcaagtgttggctccgtgttacctgggatgggaggggacatggcggccacccagtaccccaactggggggcaatgtatgtccacgtcagctggctgccttcctggtgcacaagacccagaccgctcttcagccacgttcctgtggaattgagaaagagatgttagctacaagcacaccacgctcctttgtaaggcttgagcatattgtaaaagtcatcttaaatatcttaaatgtcatgtttatgacctataagataaccaagatggccaaagtgtcatctagggaccccaggcagctttctggagaaattcttttcaatttcctttcagggaaagataagcaactttagtgttcctttgccttctcaattaaattactttcagccactttatcaaacaaccctccttccaaacacagatgattttagcagaagcctttggaactcagaagcagaatacaggcagcatgatgggggctggtgggagtgaaaagagagggggaaatccggctctattcaagctctttgtccttgagcaaattttctatccagagctgcagactggctatatcagaattacctaggggtgttttgaaaaaatagatcccttcatcccatctttgcaaactctcatccagtaaccctggcttcagtgagcatttttaaaagcttccagtttgttccaatgctgggaaacaccaaatacatcaaggtccctgctgtatcttccagttattactttagctagcatttgaaagtaacaagcacctgctatgcactagctattcacagcatacgtgtcttataatacaccatctataattctcaccacaacaatgaagactggggagttacaaaacttttccaaggcctctcggtggctgagagcagagtgggaatagaacctggggctgcctgacctcaaggctgtgctatttcttctgctctgccaggctgcatttcctagaaaccttcccagcatttgattgcatttttactttgtgaagtttctaggagcaaactcattgaagaggatgaacttgcccaaggttgttgggctatttcccagccaaaaatggatgccttttcctgggctcacctgcagagagccttgctctgaggcctgcgatggcagctgtgggcagaaggccagggagaggctgggcgaacctctagacagcccgcgcacccactccgacctatcagcatggagatgtcccggcatacacaggcctcctgtgcagctcacctctctcctataatcatcctcacctgaaatggctacgtgggcgaccctgtggctctaaggcctaaatagaccagctgtgcaccaaatgcaggcatgcatcatttaacagggatacattctgaaaatgcattgttcatcgctgtgcaaacatcatagagcgtccttatgcaaacctagatggtactgcctcctacacacctgggccacacggtctaacccattgctcctaggctacaaacccgtacatcgtgtgactgcgctgaataccataggccaccgtcacacaatgggaagtatctgtgtatctaaacatagaaaaggtacagtaaaaatacagaattatagtcttatgggatcatcattgtacatgtagttcatcgttgacccaatcatcatcctgtgactcatgcctgtattctacccaaatgcttgccttgcttagctacacgcctcatgcagaggtggtggtaatggatttttattccccctgaagaaagaaacaacacttgggttgcttcgaggccttatcagttgccatagcaacattcaaatgcagtgggtggaaagatgcccttggtgatgcctcccctggcagccgctcctctgctcacatggcagcggcacacagtgggcacgtgggacaagtcgggcaccagcgagggctcggcatctcccccttcccacgccacaggctggatcactgcaccaaagggtttgggctccagaaagagcagactgtaagcaaggttttgcaaatgggtatgagggcagggatgcccggttctggtccatttcctgaagcgcaccctcctagaaatcaccctgttctacaggactattgtacaaggggagcgacaacgtaagatgtttgacatattgaggaaaaagggctgggcatggtggctcacgcctatagtcccagcactttgggaggtcaaggtgggaggatcacttgaagccaggagttcgagaccagcctgggcaacagagtgagatgccatctctacaaaaaataattttaaaaagtaagaaaaaggttttctctgatggtaagaaagcttcctcaaaggtagagaatgtttgcgactgctcctactcccgctccaggcttggcacccgttcagctcatgacttacacgtcgtatcccctccccaaagctggcccactacagtgatgctctcagcctctctgcatcagccaggaaagggctgtgcattctttggtttgctgttttccccacattagattgttgagtcactgcttgtcaaacagcagattctgggttaggctaaacgggacccagagggtgagagctggaagcagagtaagtcctgctcattcatgaatgcacacctgcctttctcctgcctttctccctaagttgcctttcccttctaaaacacacgataaccaattgaaacagactttaaaaaatagctccacattggctgggggtggtggctcatgcctgtaatcccagcactttgggaggctgaggctggtggatcacttgaggtcaggagtttgagaccagtctgagcaacacagcaaaaccccgtctctactaaaactatgaaaattagctgggtgtggtggctcccatctgtaattccagcaactggggtggctgaggcaggagaatcacttgaacctgtgaggcggaggttgcggtgagctgagattgagccactgcactccagcctgggcgacagagcaagattctatctcaattaaaaataaaacaaaacaaaacaaaaaaaacccctccacattacatttgggacaagcctagtgggtgaccacatatatagaccccaccagactaatgagtccccaagttcactctggagggcctgcagtccagcagtggtgctggtggaggccagaaagtccattggctgaagaagacatagctgcttggagggtcagctaggaaacacccacctggggtgggtgtagaaggattgggatgagtttagttttgatgaacaggcaggggttgtcagtgatggggagagatggggcagggcgggagccaggagaaagagaaggaggacattctacccagggatcagtgtgtacaaaggcctggtgtggtgggcctggatgacatgtgaagatggaagtggggatgggagcacagaggccccgggtgaacaggacggagcagctgtgcccgggctggaaaggagttaggcatccttctgggacgatcttcacaccccatttgctgcaggaggacatgggggacctggaaacggaggcacacatggttggagcttctcccacttccttcctctcttctacccctgatagggtttggctatgtccccacccagatctcatcttgaattgtagctcccacaattcctgtgtgttgtgggaggcacctggtgggagataactgaatcatggcggcaggtctttcctgtgctgttcttgtgatagtgaataagtctcaggagatctaatggttttataagggggagtttccctttacaagttttctctcttgcctgccaccatgtaagatgtgccttttgccttctgccatgattgtgaggcctccccagccatgtggaactgtgagtctattaaacctctttttctttataaatttcccagtctcaggtatgtctttatcagcagcgtgaaaacagactaatacagtccccaaccccctctttagttcctgccaggcagtcttcacaatgcacacctctacccattctgtgactttgcctgcaaatgtagctccaacctcatatagtttttctctcttccaaaaatctacccagtctttcaagattcaaatcaagcccagtgtttttccagaggcctttctaggacacatgggtcttccgtgtcttggcacatcctgggcaagtgttactgcatcacccatttgccaaaaacacacgttgccttccgtggctagcctgtggccctcagtcttatctcctttcttagatcgtaaactccatgggtgtggcctgtgtcttgcgttccttttgttttcttctcagcacctagagatatgcatagagtaggaactccagagaccttcagaatgagtggaagctacaggtgcaatcaaaaaataatatctggtaacctgtgaaaggctgggtgcagtaggcagggaaggatatccccatggcagtctgatcatgcctgggatgctgccctttcaaactaaagggaacagaaccagctggggaagagcctactatggctaaagcgtgacactctttggggattcaacaatcatgctgttactggcaaaagcatttcatgctttccgtgttttgtgggaggaaataagctccagggagtatgggaattagcaaattgtgtactagaaacacatgcttctcatggcggaatcctgatgccactgtgggatgcagacagtttcaccaccggagcagcgggcaccagggccaggattctttactggtggtaccggatggcagagcacacaggcctctgcaaagtctcttctgctgaatatgggaccgctgggtgttgcaaccaggaagggcgccctttcatcatgcggtgagagcctcgggcactgctgagacagagcaagggaggaaccaggttgttcctgctgcacgaaccaaagaaagctccactgcaaggcctctcaagtcggcccacctgcccctaagcatggaggccttgggatgctcctgggtgaggacatctgcccagagggctctccttcttaagcctgtctccttggggtctgacagacaacagtccctaatgtgacagcagcccagctgggctacctgctcaagcccccttcaccctgagcttctctttctgcccttcccagcctcttccaggggcttaccactgcctcttagtgtcctctgcacaagcaagcagctgaggtggccgctgggacttgcagactcaaggcaaggtcatgtggtgaaggcaagcaggaccctacagcctcctcctgcctcaccccagaaacccaggcttcttcctgcagaagccgcaccactgcagctgcgccaacctggtcgtgcagccggcattttaggaggtggctggacaatgacatgtgcctctctgttccaatcaacgcctatggctgggcctgttaccgggactgcatgtgtgtgaaggttacggggtgatctctctggcatcatcaagggatgaaattctgcgttactgaaatttctacatcattgattgttacatagtttttaaagcatttgaaccccctctttaatggattcttaggcagaaactaatacatgaaacagataaaaggtaagcttccctgcatgagggcaaagagacgtccccccaatccccaccacagccatccccaggacacctcctgaaccatctgggagctactcttctacgtaacctgactctttgccaaaacttgaaaaggccatttataaaaattctaaaaagcatcatttcctcctgctctgtgaatgtgaatacaattttgacttttcttcatccctcagggtcataattatgatcaactacaatgctaggttctgacatatgaatgtccttaagaatacagaggtggggattataagttgtttgctcttgcgctgaatactcccccctaccctcatgtttatttcccttttctttcttccttataacgtgttatcagtgttctgttatcaactctgctcccccaccacaaccaccccccagcttcccacctggagctgtatgctattgggaaacacacaaccttattacagttctgtctgaaataagatacacaggcagtgtgagggacaggaggacaaaatcagatacggaacagtgatacatatatttctttttagacagagtctcattcttttgcccaggctggagtgcagtggtgcaatctcagctcactgcaacctctgcctcctgggttcaagtgattctcctgcctcagcctcctgagtagctgggattacaggcacctgccaccacaaccagctaattttttgtatttttaatggaaatggagtttcaccatgttggccaggctggtctcgaactccttacctcaagtgatccatcccccttggcctcccaaagtgtagggattataggtgtgagccactgcacccggccggaacagtgatatttgaaatccaagttcagtattgttttcttccacaccacactctcaggtcagtttttgtctgaactgtcattttcttttttgttcttttgagacagggtcttgttctgtcacccagctggagggcagtggtgcaatcatggctcactgtagcctcaacctcctgtgctcaagggatcctcccatctcagcctcccaaatagctcagactacaggcacgtgctaccatgcccaactaactttggtattttttgtagagacagtctcaatatattgcccaggatggtcttgaacttctggacccaagtgatcctcctgccttggcctcccaaagcattgggattataggcatcagtcaccatgcccaccttgaagtatcattctttagagttagaccttacacaatggaaagactcggagatattttcaagtataaacaatttgttgaactatcttactaattttttgaaaatgagtaatgcatccagctggcaaggttcactgggtgtaaagcatcatgcattcttaatttggaagctacatttaactacaatgattattacacataacaactgacaggcagggaaagatgtgtcctgcaagatctgatgctgtctcccagcaatcgccaagtgtgctgctttcctgcttggttaccaaccagtaatgaaatctacttttatttgcaaagtataaagaaaagtgagttcaaagatttaacaaatggccatcaaaagagaaaagaactctaaagtatgaaaaacggcccaaaacaatgtctaatttgaatatggcctaaggagatcacagttacctggcttttcctgcctggcacatttactctgcctggaaactcccccgtagcagccaattaccttctcaccattgggtaagaagcagacagacctgatattacaagcactattgactttgaaaagatcggacctgaatctcacatgttaagagattcttaaaatctctttttgagaaagagattagccaaagtacaagaacaaagtgggagtattttttttttttttttttttttaagagactgggtcttgctttgtcattcaggctggagtgcagtgttgctatcttggctcactgcaacctctggttcctgggctcaagcgatcctcccacttcagcctcctgagtagctgggactacaggcatgcaccaccacatctggctgatttttgtattttttagtagagatggggtttcaccatgcttctcaggctggtcgcaaactcctgggctcaagtgatcctcctcctgcctcttcctcccaaggtgctggggttgcaggcgtgcgccccgcgccagcccaagtgactgttactatgctgagatttgttagcatgtcagacctcagaacactgggcagataaacacccagcagcataaagggtcaatggaccatacagatgacttccctggattgacatgatcctaaatgtgatacccaagtctgccacttcctagtcgtgtgcgctgaggacatgctgaggatgacacagaagaggagctgaacgtccctgtgacatcactgaaccactggtgcaatcctagagccacctgcctcatgtttctttgtcacgtaaacactaaatggcctcgtcatttaagcgcttgtagctgggtactttacttcttgcagctaatgtattctaatagatgtatttttccagaaagaggctgcggtgaattctactaggtctataagctgggactcggaaagaaatgccacagccactcagaaatcccattgccaaaagttctatcaatgaagacgtgattgtccacactgtgaaacatagccatttctactcctacagctacattcacactgtgagagatttgggaacatttagggtggggggcaaggtcacttgtgctggtgcaggcatggccttggattggggaacctgctgttgtttcatttttcagctgtgggctctgcctaatcactagctttcttgggctgtcatggctctggatgaataattagcatggagtgagcactagctcgtttgaggaataatcttcttaagaggtatgcacctctcagatccatggcaaacactcatcatcatcatcatcgtcatcaccaccatcatcaccatcgtcaccaccatcattgtcaccatcatcaccattgtcaccccatcaccataatcaccaacaccatcatcaccattgtcacccccctcaccatcatcaccatcatcaccattgtcacccccatcaccatcaccaacgtcatcatcatcaccatcatcaccatcaccatcatcaccattgtcacccccatcaccatcatcaccatcaccatcatcaccattgtcacccccatcaccatcatcaccatcaccaccatcaccatcatcatcatcaccaccatcaccatcatcaccatcacccccatcaccatcatcaccatcaccaccatcaccatcatcaccatcaccaccatcaccatcatcaccatcaccaccaccatcaccatcatcatcatcaccaccatcaccatcatcaccatcacccccatcaccatcatcaccatcaccaccatcaccatcatcaccatcaccaccatcaccaacatcatcatcatcaccatcaccatcatcaccatcaggcgtttccagatccctgaatatgctagatttctctagaaaacagatgacttgcttcctagagctttcatctgcattaagcaataatctccataagttcctaccaactgtatatatagaattatcaatacttaagtctatgttattgtatactttaacaaaatcagcatagaatcacattaaaatcaaataaaaagccatcagcccttaaaccacattcttcagtatggcagaaacagtgacaatttctacatttatgacactgtgggatagtcctctttttttccaaattaaagtctacggctttgagtagctaggtttccttctttggaattgtttttccatgaaatatgtcagaagtaaacattccttgttaattatatagcaaagtatttgcccggtggtcaattatctaatcattcttgttgaaagcaatcaaactgaagagcaaaagttatgtgcagatggttggattctcatagctgtaggcaagtacatttcaggactggtttaaacaagaataaaattaagggcaactcattgtaaccaacgaccttctgtttgaagcatgaaatcatgaatgtgttgaatattagaaattaacacgatgactgtattcagctgcaacacattccctgggtatttttagggtagtttttgagaaagattcttaaatttaagcaactgatttttttttctttaagctttagctgagctatcgtaagacttactgaaacaagttttaggaaagaagcagttatgggaaaccacaaaatactggcagacttatagaaactttattccttaaatagatagctagacgtattaggatacataatagcattaataaaatttaatgagagacttctgaatttacaatagatatatatacatttcctgaaagtaggtcagaatacaagctaattagccccatctggagagaaattttgttcattacccactgaggccaatacccatcttgcaattacatgtcagaagggactgggtggggagcacacaaggattgtgggtggcacagccattagtcccctgcattggaaaaatcctcaggatgaaagacagcataacagataatttgcagagaataactgagcgttctcataacagagaaattacaaatctggagacatgtggtaggatgcttgctaaagagcttgttgacacagagatcttgctaagtgcaggttctgatccagaggtctggaggaaagcctgagaaggcaattcttattttatttttttttttgaggcaggttctctctctatcacccaggctggagtgcagtggtgcaatcacagctcactgcagcttcgacctcctggctcaagtgatcttcccacctcagcctcccgagtagctaggaccacagacacatgccaccatgcctggctaaatttttattttttatagagatggggtcttgctatgttacctgagcaggtctcaaactcttgagttctagtgatcttctccccttgccttctcaaaatgctgggactacaggtgtgagccaccgtgcacagccctgagaacgcggttctaacgagctccgggtgatgcaggtgccgttcatcagcagatctcactccgagtagcaacgcctctctaaattatttgcccttttgtgggtgtggcaactctgtcaggcagagttgccacacccgcaaaatgccctaatgccatttcctaccatgtggctgtagcgggttcactaggtggccagtgcttgaagcaacttctgaaatatttctgatatattcaagaaggaatctggtcaattgtcagactataggccaggagtcagcgcactcaaatgcctacagatggctgggtgtggtggctcatgccagcaatctcagcactttgggaagcctaggtggaagggtctcctgtgcctaggagtttaagatcagccctggcaacacagcaagaccacatctctacaaaaaataaaaaacaaaaaaattagctgggccgtggtggcaggtgcctgtagtcccagctacttaggaggctgaggcaggaggtttgcttgagcccaggggcttgaggctgcagtgagccacggtcatgccactacactctagcctaggtgacaaagtgagatcatgtcaaaacaacaacagcaacaaaaatttcaaatgcctacagatgccattgtgtccttgcctagagggatgtgttgcttagtgacctggctggttccaagcttgagacctctgcactgaccactgttgctgccagggatgtcctgtccccgagataagcccacgttaggattctgggtgttgttaggatctcagctcaaatgtcacttctccaaaggctctgaccagctaatgactctctccaccatcactctgcttaattgtttctccgccatctgaaataaactagctcattctcggtctccttcttctagaacaacagctttgtaattatagggcccttccccagcttgtttcgccattgttttatcgcaagagcctacaacagagtcatgtctggcacaaagaagatgttcaataaatatttgctgaccgaacgaactgtttgatttttttttccctaagtgaagccaggaatagaattccatgggaaatcttcccattttttaatgttggcggtaaattcaaacacagcaaacaaatatccccaaacgaactgtatggaccaaacaaaatacatctggaaacaggtggttgttctgcattcccagatcagcccatcattctattcagccacattaagtcttggcattgaagcgggaatccacaaaaatctgataaactgggaaaggggatttggagtctgaagaaatcacgttttgtgtctcccccttccctaggatgtcccatgagtgtgggaaacactcaactctactgagctaaagttcctttctgataaagacgggagtcccccacctccagggttgctttgggaataatggtgtaaaatgttggtttataggaatacctgtttttctaatggataagctcagctaagaatgaatagataaaaacattgttttttcaggccaggggcagtggctcacgcctgtaatcccagcactttgggaggctgaggcaggcagatcacgaggtcaggagatcgagaccatcctggctaacacggtgaaaccccgtttctactaaaaaatacaaaaaattagcttggcgtggtggccggtgcctgtagtcccagctactcaggaggctgaggcaggaaaatggtgtgaacccgggaggcggagcttgcagtgagtggagatcacaccactacactccagcctgggtgacagagcaagactccgtctcaaaaaaaaacaaaaacaaaaacaaaaaaacattttttttccctaaaggatctaagttgtgatcccatttttcttccccttcagtttaggaaaacttcaaactgcatactggaaatggctgggctgccagatacaaatacgtgtacatggcgtactgcagggacaagccagacacttctgtggaagcttctagtgaaggacattctgcacatgccgggtgtattcagggtgtgtgtgtgtgtgtgtgtgtgtgtgtgtgtgtgcatgtgtgtgcgtaaaaataattttaaaggggtgattcaaaggaaggggcaaaaagaaccacgatggcctggtgtggtggctcacgcctgtaatcccagcactttgggaggccgaggtgggtggatcatgaggtcaggagatggagaccatcgtggccaatgtggtgaaaccccatctctactaaaaatacaaaaagtagctgggcatggtggcacatgcctataatcccagctattcgggaggctgaggcaggagaatcgcttgaaccagggagtcagaggttgcagtgagctgagatagtgccactgcactccagcctggtgacagagcaagactccgtctcaccaaaaaaaaaaaagaaccacgacatcaaaaatgtgatacatggctggagtgtactaggtgctttacgtaaatgatcacacttaggtcttatgcaaccttggaagggagattttacagatctcatatttgaggccagaagcattaggtccagagacattagtaatttgcccaaggacgggccctctcctaacatttacagaacttgagaagtttcaggcgtgatgaaggcacaaaactacattcgaaaggaaaaaaaaaacatacaaagtgttgatcttcttttaaaaaatcatgtgttaagtgagtgctaacataaaagagattatagctcatacaaaagtataaaaccaaaacaaacttacgaaagaaacaagaaacaaagctacagtttcaaaataaatttcgaattaaaaacatcaacttaatggtgtacctgatgacatattgttacccgttgagggtagctgcccaggttcttggcgttttgaacaaagaattggacaaaacgcacaagcaaagcagccaaagcagaaatttattttaaacgagagtacactccacagactggcagaggctacagcaagaggctcgggaacattggttacagaatgttctgaggtttaaataccctatagcagtttcgtattggctcactctagtagcccatgagcagtctctttggttacgggaggggaaaagtagcctagcgaccagtctgattggctgcaggaggggaccgatcagatgtacttttctttttttttttttgagacggagtcttgctctgtcgcccaggctgaagtgcagtggcgcgatcttggctcactgcaagctctgcctctggggttcacgccattctcttgcctctgcctcccgagtagctgggactacaggcacccaccaccacgcccggctaatttttatttattttttgtatttttagtagagacggggtttcactgtgttagccaggatggtctcgatctcctgacctcgtgatccgcctgcctcggccccccagagtgctgggattacaggcgtgagccaccgtgccgggccgatcagaggtacttttcattttccaactgccaggcagaaaaaggaggggttaaaaagtagcccctatgccgggcgtggtgtctcacgcctgtaatctctgcactttgggaggtccaggagggccgattacctgaggacaggagtttgagatcggcctggccaatatggccaaacctcgtctctactaaaaatacaaaaattagctgggcaggcgcctacaataccagctacttgggaggctgagacaggagaatcgcttgaacctgggaggcagaggttgcagtgggccgagattgcgccactgcactccagcctgggagacagagcgagactctgtctcaaaaaaaaaaaaaaaaaaaaaaaaaaaacctctgatatccagtcagctgagtcggccttaggttctctaccttcagacccaattctcctgcctcaatattactgaactgaacttgtcacttgcaacatacatacacatgacatccatggctaggtggggcttctttcgagcttggcatgactatgattcaattcttccactacctttctcaaactgaactgtaaaacttcccatctctcaacatactttaattccacctgtccttattatgctggtgttgtatcatttgtatattacatttaccatggttcattctcatttgtcctattctatccaacagtgtgttcataaatgcagactcaggcaataacattatgtgatcgttttaaattctgtattgaattcagatgatgcagaatattttcatgttaagttgtaaaagatcatgatcaaaccccaaactccaaatttgaaaatccttgcagatgattcccaggcctcaaagaagcggtctggatctacaggcttcagtgggaaacgctgaatctcactggggaaaccttggatacctggaaccttcatctctccccagtacccatcctcggggtcctcacctacaaggtgaggataacacaggttgctggaaagagccacggtgttcagccaggagataggagtgagcagagccagggagcacattaggctcacacactagacgaacactcgctttggacatcagagacttacgttcctgctgtacccaaattaaaaggcaccacttattgtgaactttaaagttatttggaagttcaatcccaaacaatgatgtttccaaatatggaacagctggtcaggtatgggccccgaccaatcagactggatggcagggccattccagctaaatagcaaccttgggtgagactgggatgttaaatttaaaaacagtaaggctttcctgtacctgtccttttatatcatgcttccaaaaaaaaaaaaaaaatcacacactgcatatgggctaaataatagcagcgatgatgatgataagagcggcaaacacatacggagggttttccaagcgccaggctctgtggtaggcactctccactcacagcaattctatgagggaggggctggggctattatgatccccattttatagaggagaaaactgaagcccagagacgaaaaaggacttgctcaagaccacacaacgagtcaccagaggaggagccggcattcaagaccaagccgtctcggtggctgggctgcacactgcctctatcctgttcacgaatgctatcagctgtgtctcatccagtgcaatattcacatctatcaataatattctaccttctaattacccactcaagtggaggcaactgaaaccaggtgatacttaaaagtactgaattctgaaatatagtggctttactttcctagttctttttcacccaggttaatattagaatgattgtgttagatgctgtccttaaaatccaggccagactgggcgtggtggctcactgcctgtaatcccagcactttgggaggctgaggcaggaggatcacttgaggccagaagtttgagaccacgctggccaacatggtgatacccccatctccactaaaaatacaaaaatatgctgggtgtggtggcacttgcctgtagtcctagctacttgggaggctgaggcaggagaaccgcttgaacctgggaggcagagtgagactctgacttgaaaaagaaaatccaggccaaatagcagcaaactaagagggccttgaggctcctgggtgatggggaaagcccgcaggaagacacaaatttgccacagataatccacaaagtgaatactccataagtggtaactaagaatgaagtgtaaaataaaacctctacaactccaagatcacaaaagcaggctataccaagacgggaaattctagttctacataaaatgatacgttaagagacctaagtccctaagaatggggtttttaaacaaaagtgccccctgaacccgatcatactagaacaaatgtgatgctattattttatgaaagttctcattttggggggagacaaacacaaaaggcttaatgattcctaggaatggattgataatacaagattgttttttgagttgctaggcaacactgaaaaacaaatgtcgatgttctgagatcacagcttggttgttctcccatgggcaggaccagtgctacccggccttcctgcactccattggagaacaggagtggtacagagccactgcgatgctgagtccacagtggcaacagacaccaactggcatctccatgaaaagtcacaactgaccgcctggctgccaagatctttggtgagacaaagttttcactgaactgtcatcacacccaaacaagtcccatgctctccgggttctttgctatctgtgatcacttcaatcgctttttttttttgcaggtacattacccccttttcccctaccggtctcattaaagccccattcacccctaagagtgattttgacatctgggaaagtacagacacttttcctgagagttatttctttatttctaagccatagccttgactctgaatatttccactgtaaaaaggcctatttccaataacagctttcttagggatatgttgatattaccttaggtaagttgaattcctcctttgctgaatgccctgaactacggcatctattctttttcaaaaaataaaagatgatgcccaaggttctaaaatcacgtcacacatctacgcacagacttggtaaagaaatgaactcccttctttcattctaatgtttgggggcacagtgtagtactgtttatccctataatccaatcacccacctcagtattccaatctgggttacttcacctagtcatgtggcttgtgatatatagagacaaagataagctaatattgtaataatgatttcactgaagactattttttaaagagcagatttaggttcgcggcaaaactgaaaggaaggtgcagatatcccacatacagcccagactccctcttgatcaatatcccctaccagagaggtgccttcgctacaattgatgagcctgcattcacatgacattatcacccaaagctcatcatttccatgttcaataatagtttcattttctttacgttgtaaacataattttgtgctttaagaactcccactctttgccgcccttcccccccacccccaattaaaaacccaatgaacctgaaaaacaatcttagatctgtgttttaaatgagtctccaccttcaagggcaagttgtccgtcacttaggtaaaaggactaattaaatgagcttgtcatagccgtaacattcaccgtctgaagtgcagacgaatctactacaggccaattgtgagtgggtattcctgagagcctgacacgaatgcatcgtacgtggtaagaggctggttcagtaaccaccatttctatagcaacccccacacactctcaggctgtgttttgaagaggcagtgaaaactggattctacaatgtagcttcactcttagaatatgcttttatttctatcatctcattagaatgagagtatccaaatcatataatccaggttgccattaaacaggagaaacttatcaaatacaggatccgtaaatctttatttattctttttgccacttgatgtccatcgctttaaattcaaaccactgacctggtttgcctgtgaccattccccagggcaacaagtcagatgtccgtctgacaacctgtacatcagacagccatctgctgccccagttacaggataaagaaagggtaaacgtctgtaaaatagagctgacataatcatctcttactgtccagaaaggctcagctaagaggcattcgctatgactaacaaaacttcctttgacagacatgggaaggaaaactgcttctttcaaaggtcaaattggccactgcacaataaatattcactttatttatttatttatttttatttttatttttttttgagacagtctcactctgtcgcccaggctggagtgcaatggtacaatcctggctcactgcaacctccacttcccaggttcaagggattctcagcctcccaagaagctgggattagaggcacccaccaccacacccggctccagctaatttttgtatttttagtagagatggggtttcactatgttgaccaggctggcctcaaactcttgacctcaagtgatctgcccaccttggcctcccaaagtgctgggattacaggtgtaagccactgtgcctggctacaaattcattttaacccattcccctcacatacatcttgacacccgggacacagagagggcacaattggatcattacatattccgctgattctttaaggaaaagagatccactaaatagagtgctccttcgctctacgaatcacagcattttaacaaaatagctttaacaaaacatgtcaatgtgacaaaagtctcgattccagtatgggtggaatatcctttatccaagatgcttgggaccagaagtgttttggattttggaatatttgcattatacttacctgctgaacatacttaatctgaaaatccaaaatccaaaatgctccagtgagcattgcctttgggcatgacctttgagtatcatgatggaccttaaaaagttttggattttggggcatttcaaaccttggatttttggatttgagatgctcaacttatatatgcaagtcgtgcttcttaaaaaatttattttaggctgggcgtggtagctcatgcctgtaatcccagcactttgggaggccgaggcagaggcggatcacttgaggtcgggagttcgagaccagcctggtcaacatggtgaaaccccatctctactaaaaatacaaaaattagcctggtgtggtggcacacacctgtagtcccagctagctgggaggctgaggccagagaatcacttgaacccaggaggcagaggttgcggtgagctgagattgtgctactgtactccagcctgggtgacagagcgagacaccatctcacacacacacacataaaattatttttattgagggtccatatagcaattagccaactcatgctgttgtaacatgctaaacaaattcaatgttatttgtattctaagatggtgttaatctagttgatcaccttctaatgaatatataggttgaaatatgaagatgccaatttcaagaatgggaaattctttgcttgttccaaaagaaaaaaattaaaagacaactgtgaaaaacggcagcatcaaaaattgatcccactctcacggggtttgaaagagagcatctctagttctctctcctaagagtaaactttcaatttcctggcagtcaaggattaaagtgtgtgagttagagttaaaacatggatatactgagttagtgttaaaacgtgattttgaggcagggtggtggctcacagtcgttgtaatcccagtgacttgggaggctgagttgggaggatcacttgagggcaggagtctgagaccagtctgggcaacacagcaagaccctatctctacaaaaaaaaaatttacaaattagctgggcatgctggcacacacctgtcgtaccagctactcaggaagctgaggtaggaggatctcctgagcccaggagttctagctccgattgtaccattgcactgcagcctgggtgacagagcaggaccccttctttaaacaaacaaacaaacaaacaaacaaacacaaacaaacaaaaactaccatgtgattgtatcatttgaacagaagtcccatcaaaccataaaataatttcatctttctttacagagtttgaggtctggccctacaatgaaggtgctgtcactctgagtatcagttgtcaactctggcaaaatacaggggagctgtcagctaacaggaaatatggacattggggctgtctgggcaccccagtttgctcctgtagagtgtggaatacactggcactgtaatattagaatggaaagaacttctggaaggcatttagaccagaggtcacaattttttttaaatttttttatttttttctgtaagaggacagatagtaaatatttttggtttgtggggatataagtttctgttgcaatgattcaaccctgcgttgtagtgcaaaagcactcacagacaatatgccagcagatgggcctggcaaggttccagtgaaactttatttagggatgcttacgtataaatttcatgtaattttcgacccatgagatattctccttttgattcatttcccccatatttattgacgtacagttgaaaaacaaaaattttatgtacttaagatgtctgacctgatgttttgatatatacatcaagctaattaacatatccatcactttacagttaccattgttttttcatcttctttctcttggtggtgagaacactttgaatccaccctcttagtaaattttaagtatacagtacagtcctattaacaacagttagcaggctttgcattaagtctctggagcttaatcatcctgaagaactaaaactttgtaccccttgatcaacattcccccatttgatttttttctttaatcatttaaaaatgtaaaaatgattcttagctttcaggccacagttggccaaacccaatttagatgaaaaattattaatagattcacaagttgctatctgtgccatttctggctgttaaacaatttggaattggcagttattttgatttacctcaaaaatagataatttaaagtattaaactatttgagatgatcgattactgtaatcataaatagcagctaattattaaattgttttatgtgcttaagatgtgttggcccattccccatttttttcctgatctaataccgtctttagattttttatttaactaaaatattttaatttctacttagataatattacaattaatgtaatagcaacaaaagtcttatgaaatatgcaggcttctattgagtataataagtgaaaaaacatatggtttctttgaaatgtccatcttaaagttttcagaaaacattttaattcatttggttatttttgaatgactatccacaaacgttggcttttttctgcatacatgcaatctgttacaaccaggaatttggcagttacatttttcatagtaaatgtgaagttaaaaagaccatttcggccgggcgcgttggctcacgcctataatcccagctctttgggaggctgagatggatcacttgaggccaggaatttgagaccagcccgggcaacatggtgagaccttgtgtctacggaaaataaacaataaaacaaattagccaggtgtggtggtgtgtgcctgtcgtcccagctactcagggggctgaggtgggaggattgcttgagcttgggaggtcgaggctgcagtgatctgtgactgcaccactgcatgccagtctggctgacagtgcaggactccgtctcaaaaaaaaaaggaagcggaaataggtcaacttcacaatgaagattcccaatgtactgtcatggttattttttcagagaggaaacagagaatgggctaacttatatttcagaggcttcctaacaatgcacacacctctgttttcaccaatttctgtattgtattcatttcctattgctgctataaaaaacattaccacaaataatagggtcttaaaacagcacagatttactttcttatactcctggaggtcagaggtccaaaaccagtttctctggtctcaagtcaaggagtccacagggccggtttctcctggaggctcagaagggagaatcccttgcttgctgattttggcttccagtgggtgcctgtattccttggcttgggtccccttctcgcatttccaaagtgcatggctccggcctgcgctcccatcctcacactgccgtctcctaatctgattctggctcctcttgcatcctgctcataagggcccttgtgatggccgtgggcccacccagaaagtccatgagaatcaccccatctccagattcttcatcacttccaccaagtcccttgaccgtataaggtaatatccacagggcctggagattaggatgcagagatagttccatctgccatggacatcaaaaacttctttaagtttgttatttgtgaactgtatataaagtccaccgaggaaagcaaggatgctgctttcatacacctgtgccatatagttacagtgcacacaacccatacaggaatccctagggaaggcttccttatattaggagccccagccttattcctccatattcaaatatactcattaaaaaagagaaggcaaaaatgagaagcaaaaaataaacagcagggatggaggctccaagatagaaaaaaaatccaatagaactgtcctccctctaaacaagagcttaaacatcatccttttataacgtgtacatatacatatatacataaaggtaaattctatgtatacagtcaatgtatacattgactgagcagctcaccgcaagctctgcctcccgggtttacttacgccattctcctgtctcagcctcctgagtagctgggactacaggcgcccgccaccacacccggctaattttttgtatttttagtagagacgaggtttcaccgtgttagccaggatggtcttgatctcctaacctcgtgatctgcccaccttggcctcccaaagtgctgggattacaggcatatcagagtatcttaaattgccttttaaagatatctaaattggctagacatggtagctcacgcctgtcatcccacgactgtgggaagctgaggtgggtggatcacttgagctcaggagttcgagaccacctaggcaacatagtgaaaccccatctttactaaaaaaatacaaaaattagcctggggtggtggtgggcacctgtaatcccagctacttgggaggctgaggcactagaatcacttgaacctgggaggcggaggttgtagtgagctgagatcttgccacagcacgccagcttgggcgacagagtgagactccgtctcaaaaaagccccccaaattagctaggcctggtgaccacccttgtactcccagttcttcagggggctgaggtgggaggattgcttcagctcttgagatagagactgtagtgagctatgatcacaccattgcactctagcctgggtgacagagggagaccctgtctcttaaaaacaaaagaaaacaaaaaaccctaaaattattctcatgtgattcaaccattcaacagacattttagttgggtacctagcattatgccagaaactgttattgatcacaagcattcagaataaatagacttggtgagggcatagggagtaactggtacccacacagacttggtgaaggtgcagggagtggctggtacctgcacagactcggtgagggtgcagggagtaacaggtccccgcacagactcagggagggcacagggagtaactggcacccgcataccgtgccgttcaagctgataggaccattgcaacgtgcacaatgtgctcaggatgaggccggggaggagactggaaaggatcggctgtgctcgtgaaagtgacaagctgtcatttacttttgtgatgactaattttgtctgacaacatggctaggccacagtccccagaaatgtggttaaatatgtccagatgtgactggggaggtattttgtttagaagagataaactgttcagccagttgactttgcttttttttttcttatttatttatttattttttgagacggtgtctcactctgtcatccaagctggagtgtggggacgctatcttggcccacctcaacctccacatcctgggtttaagtgattctcctgcctcagcctctggcgtagctgggattataggcatgcaccaccacgcccagctaattttttgtatttttagtaaagatggggtttcaccatattggctaggctggtctcaaactcttgacctcaggtgatctgcctgtcttggcctcccaaagtgctggtattacaggcatgagccatggtgcccggcccaatctgttgactttgagtgaagcagatcactctccacagtgagggagggcctcatctcatcagcctgccttgcaattttggacttgccagccttcccaattgtgtgagccattccttaaaatcaatctctccaaatatacatatatctcctattggctctgtttctttagagaatcctaatacactcattataacaacagtgggtactattattattgccatttcacagtggaagaaactagatcagaaaggctaagtaacttggccagggccacacagccagtgggtggcagagctggcattccacaccactgtgccccccagactccctgctcttaaccacactctccgctgcttctcagtgcattgacctgggtgcgcttcagcgccccctgggagggctacaggggacaggcagaccatacaagggggtgtatattcatatctcttacaaatgcaaatagaggtaagtaatttgcccaaggtgggactcacagttttataagtagcagaacccaggttttcaggaaacaaaacacaaactcaaagctctttccattctcttgcccacttcctctgtgtttttctttatccattttcttcctccctttagaattccggcattcttcagagactcttggtcacacatccctcaggctactccctcctggaggcacagtgtacctcaggtccccaccatgaccttgatgccccccaaattatcaggctcacagagaacacacaccatcaataaagtgcccgtctcgcttactgcaggatatgtgaacagattatcaggctctcagagaacacacaccatcaatgaagtgcccgtcttgcttactgcaggatatgtgaacagacagcatcacaatccacttaacaatatcaagtttactgtggctggtaaaatcaatgcattccacacaaataattacagtgtctctattaattatttggaaagtaaaaataagacaaaacaaaaatcccctccaaaagcccaacaggcgtttcttttaaaatataattcctagaactctgttttaactgattcgaggaattagatatctttgaaaatatactgatatcaaaaatctcccaattatcttcatgcatggtctaacagttttaaattctgaactggcttatttgaaaactggtattttcttttttcgagacagtcttgctctgtcatccaggctggagtgcagtgatgcgatcttggctcactgcaacctctgcctcccaggttcaagggatcctcccaacttagcctcccaagtagctgggactatggacatgtaccaccacagctggctaattttttgtatttttagtagagatagggtttcaccatgttggccaggttggtctcaaactcctgaccacaagtgatctgcccgccttgcctcccaaagtgctgggattataggtgtgagccaccgtgcccagcagcaaattgatattttcaagcttgactttcagggcactaggaagcaaaggggggtaagaggccccacgctgccaagaccctcagcccgagcacatgctcgtgggctggtatcatgagtgcaaaccaatacaactgtctggagggaaatctggaaatatgttttaaaagttttagaattttgtacattttgtaactcagcaattcttctaaaatgtcatcctaaggaaataaccaaggctgtgcataaagatttagctagaaagatattttctacagcattggttagaatagtaacatttttttctaattgcaggggattgatgaaccaaagtgaagtatgatatatccacagggtggaatactatggacttattaaaattgacatggcagaataatgatgctatggaaagatgttcatgctgtacaaatgtatttttatgtatatattattggttgattgagtgagtgagtggtctcgttctgttgcctaggaggtgcagtggctcgatcatagcgacatcactcactgtgactttgaattcctgggctcaagcaatcctcccgcctcagcctcccaaagtgttgggatttcaggtgtgagccactgcacccaaacagtacccagcacatgatctcatttctgctaaatatgctttgtagaaggcaacctctcagatagccagccccaagtgacccctgcctcctggtattcactcccctgtatagtctactctcagtgctggtctataccagtgtgggtctgtgtgaccaacagcctaatggaaagaaatgatggtatgctgcttttgggattaggttacaaaagaccatgacctcaatctgggcacttgggcttttaaaaggctggtctcagactcttggcctcaagtgaaccacccgcctcagcctcccaaagtgctgggattacaggtgtcagccaccacacccagcctactatatcatttttatttactcttggatcatttgctcaggggaaagcaaactaccgtgtagtaagcagctctatggagggtcccacgtggtaaggaggtaaggcctctggtcaacagccggcaaggaagtgaggtctgccttcagccctgtgagtcacactcattagccccagctgaacactgctggagaggaccacagccttgactcacagcttgacagccgccttgtaagagactctgagccctaccacccagctcggctgtacctggattcctgacccccagaaactctgagatactggagctcactgttgttttaagcagctaacttttagggtggtgttacacagcagttgataactaatacctacgtgcactgtgaaagccctagaaggacagaattcaagatatattagtggttttctctaggtggtgagacttatgggtaatttttattttctttgttttgtacagttttggcaaatgtttgtcctttttcagaaaacagaaaaaaaaaataccacacatgaccaagagcaaccatatgaccttctgatgaataaaaggatgaagattaggagagccagttttagctctaataacctttacagattcttttcaagtaaattaggttaaatgtgcaaaacaaaaacaaatatgaaaactaacaaaaaatgagttcccaagagagggtctgaatggcacggggaagggtgccgtccccatgagaaaccacacaatgcaatgtgagcagcagcattcactgacttcaaggaaaggagacttccatgagcttcttagaaggaaaaccaaacagtaacgaagccatctggtagccgattgtcggcacagaactcttgcttacccagcttctggtcaaaccgccacgccgcgacataggcattgtgcctcaggctgctctgcgtggccaggggcacagtgacatagatgggaccatccaccagcaccggcgttccattactgctcagcaagtggacgctgacggctgtgactggggtcaggtcatgcctggtgctgtttcctagaaggaagaggcattttccatcatttgcatgcaaagtacccatgtggggctgtggaaacctttgcaaaaaaatagtcgcagctaccattacctcctatatgccagggactgcatgaagcactttacatacataatcctcaccacaacccagtaaggcaggtaaaatcgtcatttttacacacaaagaaacaggctcagagagagtagtaatggtaggtggcctaagggcatacactcagtatgggctgagctggaatctaggctcaggttttcttttttcttttttttttttttttgagatgaagtctcattccgttgcccaggctggagtgcgatggcacaatctcagctcactgtaacctccacctcctgggttcaagcgatcctcctgcctcagcctcccaagtagccggtattacaggcttccactaccctgatggataatttttgtatttttagtgaagatggggttttgccatattggccaggctggtctcaaactcctgacctcaggtgatctgcctgccttggcaatcccaggcctgtgctgggattatagacttaagccactgtgcccggtcaggcttgctatttttcattattgtgttttgctttcaaaaacgatctcaaaagagaaggatttttctataatgtgagacaaaggtgtaagtggaaatcaccggaaataacttttacacaaagtgagccccatgcacatgttaattacttggcagataaccttaataaaaccaaatgttttagagcagaggctgctttttttttaacatagcaaatttcttcaaggattgcttcaaaaatattaacttctgctaaaaagtatgctattgaggactggacttgaaatatttatgagttattttaattgccattgttattttgatctgtttaaaaggacctcagtataccaattattttccattaaaggcctttggtccaagccaaagctttaatgactgcctacagataaattagagaatgcttatgagaccgatatatttatgcactcaagcaatccattttacattttcctctagtgaaatacaatatcgcacaaactgtgttgtcataattttacatatttctttgagcacaatgacaaaaacacagcgataaaaaatttaagctgcattaaaatacaatctataggactttttattcagctacttatatacttacctacctaccaaactgagctgatgtaaacctccaatctggtctacatttaaacatttaaagaaaacctagtgaattttagagtctcaacaatgaattacagctaaatccttcatacagcaatttctacacagctaatgccaccctaccttttatcattcatacccgtctgttttttaatgaaggcaaaggtgtgggaatggagatttcgtggaaagatcgaagttggaatcacagatccaagttttgaaatctcttagtctggttatgtcattttatggtaaaaaaacaaccaaccaacaaaactcagaatttaccatgtttctggtccaaagattttgtgtcttgaaacacaaatgtgccagcagctcaaagttgatagagaagcaaagccaggtctacaatctactgctctagattctgttaggccctctcaggaagatggaacttacaactacagaaaagctggccaggcgcagtggcgcatgcctgtaatactggcactttgggaggccgaggcaggttgcttgagcccaggagttcaagaacagcttgggcaacatagtgaaaccccgtttgcacaaaaaaatacaaaaaattagctgggcatggtggtgcatgcctacagttccagctactcaggaggctgatgtgggaggatcacttgagcctgggaagtgaaggctgcagtgagctatgatcacaccactgcaatccatcctgggtgacagagtgacaccctgtctcaaaacaaaacaaaacaaaaaaagagaaactacagagacattaaataatttactagactgtataaacaactgagagataatgttttccatcagggagtgctgttttctttcatcaaactctagtcaagatgtccaagtacgtaggtagcaggtacttggtagatagaggagaaaagccctagaaatggtgtctcccttctcctcccttgtcacctttcaactctcccttcctgcacattcccagcccaggaagatggagtcccagtaccagatctgccactcactgcctatgtcacctctgaaagtgacttcattcctctggggtctgtttttcttaccttcaaaactaaggagggtagactagatgccttcctgcatctatggaaataagtacactcagcttgaaacattcagaagtaagtagagcattgcagaaacgagcatattaatggacagcaatgtgcattaggttcatgggatttcatgtccctttagtgtcctctagctgtcttaagacattgtggggaattatatctgccttcttgaggcctctttcctccctcagggcttcattaaatgcctgcttctctatgccttcccaatgactctccctctatgtccccatgttgtttattctgcaacgatttttttttttttttttttagacagagtcttgctctgtcacccagagtggagtgcaatggtgcaatcttggctcactgcagcctctgccttctcagttcaagcaattttcctgcctcagcctcctgagtagctgggacaacaggcacacaccaccactccttgctaatttttttttctttgtttttgtatttttagtagagatgaggttggtcaggctggtcttgaactcctgacctccctcccagtgatccacccgcctcggcctcccaaagtgctgggattacaggtgtgagccatcgcgcctggcctattctgcaacaattcacattttgaagggctaaactattttccttctctttgttatgaaactccaattttacacaaaatactgagttttatatagaaagtggtcatccttcccgttccatctggatgttgcctggctccctttaagtctgcacaaagacaagcaggtgtcaggcaaatgcagcaggatcgtgttgcggggcagaacaccactggcccaagcgaggagaggagctgtatcaccttgggccatctacctggtcactcgtcacgtgacaggttctgctcagctgacatctaaggttctgttgggctctgtattctaccaactttttggaattgcaggaaaagtctgcacctgtcattttattgactcttctctgtcttcctggagttattagtgaaagcaatttttgtaaaaaccccttgggaacaccacggaacattctgtgctttctcagcagctgggggaagagtgcgatgctctccggtgagaggagggggcccccaagagctagaaagagaagatgcttctccacttacttacaactctggatccaccctctaaaccaaacaacacaaccttcatggtacccccagaaaacagcctttcggagccctttccagtctcttccgcagcctctctgtttccatccaccttcactgaactctggttatgacgctagtcattttctgcgtcttcgggagatgaacttgtgtcatcttccaaagacacgtctggtccaggcgtgctctctttaggctgtgagctcttagatgcctttagtaaaacaggagatgagtgactgtgggcaaaagacaagctgtgtgcaaactgaccccaggggccgccatggagctggtgagttactgaggtgtctgtgctcaagggagcccaggttccaagtccccgagggcgcgtgtgaattcactatgggtggatgccttcgctgctaggtctccaagaaagcctagtcatttctaggtcaagtcatccattctttccgtggaagagaaatttcatgtcacattgcaaagacctctcttccctttgaaatcacggaatgatcttaaaataggacaaactcctctaaaatcaatagttctgtgtcttagtgttcgttttcccccattttctcagactgcataatttattcaagagctactggaagtggggcacagaaaaatttaatgagtcccgagcacggaggctgtccctccaagttagggttttgtggatcgtgcaccattttgtccgggaggctggatgctggctatgatattttaaaactttgtttttttgtttttttttgagacagagtttagatctgttgctcaggctggagtgcagtggcacgatcttggctcactgcaacctccaccttctgggttcaagcgattctcctgcctcagcttcctgagtagctagaactacaggcacctgccaccacacccagctaatttttgtatttttagtagacgcagcatttcatcatgttggccaggctggtctcaaacttctgacctcaaatgatccacccacctcggcctcccaaagtgctgggattacaggcatgagccaccgcacccagccttaaaccacttcttcatgctccccaaaacaagacttttctcccagaccggcacatttcaagtaatagtcaacatttttttttcctaataatgtttacttaagatgactgctatgccatctttctgatgaccaagtactgacatatttactgacaagttaatcacatcctcatcagcacacaaaaattaaagaagaaacgttttggaaaacagagagaagaaaaatgagtaacaaatcaccatgttgcctttatgtataaccagaaacttattaatatgctacaaaatggatcaaatgtttcaggtttaaaagctttttcagaataatcagtttatgtaaagcactggaaaattaagtgaaattcaagccaagtatccctgggaaatgcagtgagttactctcctagcagaatgcaactcagaacagcctttgatttaaaattttaatgctgtgattagtttaaagtgtgggggaaaggaaagtggggtagacaagaaaataattcaggactccagaatcctgacacctcttccaccaggaggagtggggaccattccagtgcaaaggggtccagagaatggtgcagttggacacaaacagaggtggaaggtacccgtcttgggtctttctctgataaggaattatcacttattttctggtggatggcttttagtttctctgatcttttagctgtggcatgccagaatagtggtactgacccagctgacttagagacctgccaggagagggcggattctaaagcaaattcaaagcctggccactctatgcccagttgaggacagagagagcaagtgcagagaaagaaacgatgtgggaaagagctgggtggacacagatggcagagggcggaggctccccatcctaagtggtccccatgccggtggggcatggagccaaggtatgcctgtctctgagttggaccaagcaccacctcttcccctcctggctgcagcataggtgggtggggtggtaagtctctaccagccccacccacccacaggctaccctctcaaatgggggctcgtgggacgaggcagagggcagctgggccaaaaaccctaagtctaatcttatacttaaaaaaattgcaatttcaataagaatttctctgaattgaatatatttagtccaccaaaggagagctcagagaaggtgcttaaggcaactggtaacagaagaaaagctcaaggagaccaatgtgctaacatgtaattctgcagggctcgtaccgacgtaacacagtttcaaagcacttgaacttgtaccaagaattccccttctgcaccttcagtgcctttctcccacatagtgctaaaactcccaatcatacctaaaatccacatgtaaagactaaaacacagtaactcccactgaaaagagaaaagactccaattacctgttccatttccgtctaatcctcgcaaataaggaaaactgtccacctccgaaggggagctggcggccgtgagaaacgcggtcaggtcactgtagctggtgttctcaggcaacctcagagcccttctctggaaatgaacgcgaggctgtggccgggcacctgcagagattaacctccgagttatctcccccaggagcagtttctgtttttagaaaatgcaaaaccaggaagtgcctctctaaggtttcagcacgcctcccccaccctgctccctctcacaaggcctcccttcccccattcatgcaggacacagagatgtgacaacatgctattatggggagagaaataatagcccattgtcacatttgttttgacacaggatgttatttaggtttttaacaaaaagctttttccaagttccatgtgcaagcagtcttgtcactgcccagcatttgcctgtggatctgggtagcattttgggaaactccatgtaaatgaaacaagtagatgactattaatctctttactcaaacaatgtaagagatactctttgataccgctgcaaacccgtctttaatctccctggaaaaatctggtttaatgccatgaaccaaattgaaggagggcaagggaattaacagtgcaaccttgaaaagaattgcaaacaataccccagcggcaatgaatcttctctttctgtgggagctgccatttgtcatcatccagtctattctggaggcgtgcttcctacttgtgatggattatgtcacagaatttaggatgagacttttgaaatgatgcaaaatgatgcttcttcaccaaactcaactcctttgtgtaggaggacaggttgggctgacaggccctagacagttggttgtgccgtcctctgcagcttaactttgctccaaattttctttttcttttcttcttcttttttttttttgagatggagttttgctcttgtcgcccaggctggagtgcagcggtgtgatctcaactccctgcaacctctgcctcccgttcaagcgattcccctgcctcagtctcccaagtagctgggattacaggtgcccgccaccacacccagctaatttttgtatttttagtagaggcagggtttcaccatgttggccaggctggtcttgaactcctgacctcaggtgatccacccgcctcagcctcccaaagtgttgggattacaggtgtgagccaccgcgcctggcccagatgttgttttgatcataaaacctgaactggtttttacctaatgctgcggtgatattcaccagacgtaaaggtgctaggtaattttgtgcaaacctggcaaaagcattgttaagagaaaaactgtagatccaaccccaggcttgaggcagaccacattccacctgtgctttgctgagggttccttctcccggccccctgctgtcctgcttcaacagctctgcacggagctggtgggctttatctccactccagggttccttttaactctggatcaaagaacttgtaaggagtgaagaagcctgtctagacgtgttctagaaaaagggagttttagagctccaagaatccactagcccaagtctctcttcttaaaggtgaagtcactgaggtccaaaggacttatgtcgggggcagcctgtcttggctacacactgcctaactggcagggagtcacaatgctccctcttccttttaaaaactagcaggtagacttctccaggggctggttctccactctgtgaaatccaggcccaggtttagagcccagcgagcaggtgcccaaaatcatgagagtcctatctaactccggtcatctctgctgaaactaaacagacacagacattagtctagctccagaccatcgattccccttcttcatccctaaaacaaacccacagcgacacaccagcctctggggatctgggtattttaacattattgtattcttcttagtctggtcttattttccctcgatgttacagaataccgatgtcttactcctgccacctccttggtctgtggagagttcaaattcctcgggggtcccacaaacgctctgtgtcctgccaggggcagtctgtttctcatcccttctcccccttgcccacacacatggcgcacagcttgcttttcttctccctttccacgctgccctccaggatggaaggtcaaagccagcattctttctcatctcctcactccggatgatataacaacattcattgcttctggtatttttttcaatgatcaggaaatatatgttatctactggttttccggctaaataatgctgctgatagtattcaatgaacaagcccctgtgtagaagcctgggtctcacatggtggaaaagtaaagcactctgctaataggaagagaacaagaatggtgagtctacatgtgatggagcaaagagggagcctgtcctcatgagggtccgggcagaggcagaagctgggttggtgatcccagagcagggaaggaaaagtgcacccctccaggccttaggaggagcccctgtgagatgggctggcagagacctgtgtgagggcagtggggcacagaaaccttctccgactggactgagggttgctgaaagacaagggggagccggggaatgggcccaggatacgcagcctagccaggacttacggggactggcctgggacccagagaaccagaaacccaggctgctctccccagctctcagggccctggtgtctccccctgatcctctgcttctcgtgccttctcgagcagatcaagtgttacatgcatttgggtgggcaacacatctctctccccacttgtgcaggagaatttggtccctggccagacatccagggtctatctgctggggctgggggctgggggtatgtagcaggctatgtgggggcagatcctcatggaaaggatatggccggtgcagcttatctgacacaccctgggactggcacgacacgggtaccatccatgagggactaaacaccccaccacaaagcacaggcaacacctatggtgatgaaaatgactgaagcagcacgtgaggaatttaagggtgcaagctattctgagccacagcacaaataaaatcgaaagatggtatgcatggggttgggggagcggttatattcttaagcctgcctccgtgtactaaagccgctaaatagttccacactacagaaaggaatatgattgggagggggtggcagggtaggcagtggataagcctgtagggctccatccccatccccaaaatactcagaccctgctctcctgaaaatacgggggtccccgcttcctctcgctgcatttctttcttttctctttttctttttcttttttttctcagagagagtcttgctctgttgcccaggctggagtgcagtggcgtgatctcggcttactgcaacctctgcctcctgggttcaagcaattctcctgcctcagcctcccaagtagctgcgattacaagtgcccaccaccacacctggctaatttttgtatttttagtagatatgaggtttcatcacattggccaggctggtctcgatctcctgacctcaggtgatccgcctgcctcagcctcccaactctctgctttcaaaaatctgttcttccctcttctcttctgcccctaaccacctccaaggtcaatccaagcctctaatttaacttttgcttattcattgtaagacttggctcaaccacctgtttttgccttcgtcagcaatctctttctctataggcttttcctccccaaccaacaaaaatactcattttttccccagtctagaacaataacaagcaaacattactctaactctgttatccccataagcgaatgccttctgtccttccaccaagctccagtgatgtggcttctacccacaatgcatgctgcccttggagacgtcgactgtgtgatccgcaaaccccatgaccacagctcagcctccatcctcgtcgacctcttcacaatggttgacactgtttgcccctcctgcccacaatccccttcctccttgggattcatggtcctgcactctggttctctccagtgtctgcctgctgtttcctttgcaagtccttcctttcttgtcctacctctggatgaaacagctcccagagggctaccacccatcgcctgtgccatttctgtgctctgctcgctccctgtgggttccctttcactgccactgccttggctggtaccatccactccagcattggattcttttctaagctccatgcctggattttcccttgccttctagacacttctacccagatgcccatctgtcactctaaaatcatcatctaccttctctttcacctaacaatattccagtctccccaacacccagttttgattctaggtcaccatcatcattctccctatctatcatcctcaagtgccatcattctccctatctatcatccttggcattcactcaagtgccaagactggccaatcttcccttaacaaatttcttgcaccatatttctctccctttttgcatccaacagcgtatgttaccttatactgcctctcacctcaactattgtgaaagcctcctatctgggccatctgcttcagcctcactcccttttcatctactgacactgtgactgttcaaagatactactctaatcatgtcctttccctgcccagaaaccatcaacggatctctcccacttaccaaattaacaatgatgacaaaaaaaacaacaaaaatgaatagaccaatatagacccagactacaactgcacctcttctctaaatgagaggcatagatcagtgctttagaatttacaaagtgcataaataaaaatatgttatttaatatttacaacaaccctgtgaagaaggaaccctttcctctttatggatgatgaactacagctcaaagaggtaagtgacttgcccaaagtcattctgcttgtaagaggtagaaaggaattattttaattctaactctgtatcctttcctatcacaccatgcctacctcaaaatagatgccctgctgactgccaaccagttctcatcctctggccaaataggactgcatgactaagtctgattgtttctttcctttttttttttgagacagggtcttcacttgctctgtcacccaggctggagtacaatgatgccatcacagttcactgcagccttgacctcctgggctcaagtgatcttcccacctcagcctactgggtagctgggactacaggcacatgccacaacacctggctaatttttatatttttttgtagagatgaggtttcgccatgttgcccagtctggtctcaaactcctgggctcaagtcatctgccctccacaaccttccaaagtgctggggttacaggtgtgaaccaccacgcctggcctctctgtgtatatacattcatgcatctccatgtctgaaacttcttcccctcatcctacagctcacccaaaatgcatgtcaaaagccacctcttctatgtagtctgttaatcccaccctaagctctaagctctatttgcatctctcttgtagcactgctcttactatgtcctgtatcataattatttgtatatttgttcatctgcctaatcaagagcatcatgagaacatgggtggtggaatcacttagctccaggtttaaatctttcctctaccaccttatagttgagtgatttgggcttcaggttatctttaaaatgggtatgaatcatgcctgtctcataatatggctgttgtgatgttggttcagaacacatatggatggtgtccaacagtgtctcctggataagcactgctttcccatttcctcttcccattatagactgaagctccttaaaccaggcgttctgtgaaatgcatggcactatgttctgtatacagttggtgctcaatggtacttatgtgaagatgagttaaacctggcaactcactatgttccagtaatgctctgtctccattccaactagatcaggggtcctccatttcagcaccatttacattttgggccaggtagttctttgtttgggggtgtcccatgcattgcagcatgtttaatagcacccctgacctctacccactagatgtctgtagcagcccccaaaatttctccagacctcactaaatgtctctggggagggggggcaaagtcacccccaattctgaaccactgcactatataccctgagcaccttcacaaaatccagacaactggcactgagaatctccctgcaacgggtctacgactgcaaagaggagtagggaaagtgtttgtattcacggaactcaagagaggagaaggcatttctctctttgtctctttctgtgtcttccgctgtctctctatctgaatctctgttcctctcccgaactatcatatgaacaaagaagcttaaaaagaatgccaatagtaaccttttggagggtgggatgaagatttccgagtcaatttcagaagatgaagtttaaacaaaaccaagggttgccacctgaaggaaaactaaagccggagggttgcagaggttttctgttttctgccctggggctcttttctgagatgccatttagcctccttaaatggatcagtgaagaattgagccagtaatcttggggataatggtactttctcttctgccctgaatcagagtcaaggaaatctcttcttagagctttcatcacctcttgatgagtttatcacatcatccttcttttcttacatgtttaactccctaaaacatcaataacattcattactctaatacagaaaagggtcgagaaggcagtcatggaaacggcttgattatcatagtgttttaagtgctagaataagagggtaatgatgaaagtacaagataaacttcaagagagagagtggccagctgtccaggagaaaagcagttcccgggctggtatttgtgaactgtgtcttgaaggttgagaggcagaggagaagtaacagcatctatgaaggggcacagataaagaaaatctaccatgtgtggggaagtgaaggaactctctgtgagctacgtggggtccaggggcagagggagagacttaggaaggacttggtaagtcccaatcaagagtttggggccgggtgtggtggctcatccttgtcatcccagtgctttaggaggctgaggcaggaggaacgcttgaggccaggagtctgagaatagcctgggcaacatagaccccatctctacaaaaaatctgaaaaattagatgggtgtggtggcgcatgcctgaagtctgagctactccagagacacaggcaagagaatcatttgagcctgggagtctgaggctacggtgagttatgattgcactactgcactccagtccatgcaacagagtaagaccctgccaatgaatcaatcaatcaatgagtttggatttgtgtgggcctgcaggggagagcgtgtgggagttaccggtagggaagtgaaagattccgatttgtttttgcccaattctgacagcaggtggagtatggccatgggtgcagagtctgatgtcagagcgatcaggcaggaggctgctatgaaattattcaagtgagaaatgataaagttccaaataaagacagcagctctgggggtcctcacagaaaaggcagctggagtggaaagctatttttgaaataagagataggcagagcaggaagaacccatgaaggagattgagaagcaatgaacagagagagggccagagaaaggatgaagacatccaggaaggcagaaccgggtagggtggtgaagctgcggggaagttaggaagaagtggccactaggtcacgtaactgtagctctgctgagctcagcaagagggatttctaaggaatcgtgtgaggcagcacaaaagggagtttaaagacatgtgcctggcaaggggaggtatctccaaggttcgggagaagattgtgacttgaaggagaaatagggcttaagaagagttttgctttgaatggcaaagccttcagtgattttgagagctgagaaagaactagaagagatgaaaggctcagcataaatccagggaggtgtgagaggaggtgataacaaatgggctccaatgagaatgtgaaggggttcatggtggggcagagaagctgcaggaggacactgccatgtcctcttcggaaaggcggcaggaggaagaccactcgggaaggcgtgcttccctgacggcctgctttccctgtgaaaccagccaccagggccctcctgggaggacggcatgcaggtggggcgaggggcatatggagtgtgctgggaaaagcttcccacagcagctgcccggggaacaggaaaaggaccatctgggaaacatgaggagccaagcagaggatggagaccactgacctgggtggtgccagtcggcccgatgacagtgcccatgggcagctgggggcatcttgtctgtatcttcttatttactctcatcacactctgagtcgttgtttctgagacagcgtgagggcctcctagaggctccgggagccagagctgcaggctggctcccccagtctcatctccggcattcatacaatgccagcctccccattcatcccttaccagaaataatctgggatttaatttatggatttactaccaaacccctccccacaagattttgatggaaatgtgatcttcagcaaaggacaaaacactctccaagaaaatgattcgtataatttacgagtgttctctctttccatactcttatcatctcacagacaagtttggaaacaatttgccagcgttttgtgacactgagcgcattttcagatatagtctacgtgggggaatatccctcttgttgaccaattactgaggcatcacctaacactgcagagaatacgtgtgagtcttctgacccttcccctcaccatcctgttatcctaagacagtcctggctggctgcttgcctatctatctatgcatctatcaatcatctatccatctatcctatcaatctatctatctatctgtctgtctatctatctatctatctatctatctatctatctatctatctatcatctatccatctaatctattaatcatctatctaatctatcatctatctatacatttatctcatctatctatctatctatctatctatctatctatctatctatctatctatctatctatccgtccatccttccgtccgtccgtccgtccatccatccatccaaccatccatctacctacctacctaccaacaaaactacctatttatttgagacagagtcttgctctgttgcccaggctggggtacactggcacaatcatggctcactgcaaccttgaactcctgggctcaagagattctcccacttcagcctccagagtagctgggactgtaggcacacaacaccacacctggctaatttttaaatatttttcgggtcttgctatgttgcccagtctggcttgaactcctgggctcaagtgatcttaccaaagtgccttgaccttggcctcctaaagcgctgggattacaggtgtgagccactgtgcctggcccaggctttctttataaaacagtgtcgaaaataacatgttacaccattactttcctcacttttaaaacgcaacaaaactggccgggcatagtggcttgcatgtctgagcaggcaagaatttatttttttctcctgaatcaattaaaaaaaaatgcaactaaatgtgaccagtttgagaacataattttaatatgtcatttataaattcagtattgtattagttttgtagacaatacaaatacatcgggcatctcagcactttgggagggcaaggtgggcagatagcttgagcctaggaacttgagactaacctgggcaacatggtgaaaccctgtttctacaaaaaaaaaaaaattagccaggtgtggtggtgtatactgtagtcccagccacttgggaggctaaggtgggaggatcacttgagctggggaggcagagggtgcagtgagctgagatccagtcactgcattccagctgggtgacagtgggaccctgtctcttaaaaaaaataaataaactgtattaagcaaatagtagtaaagaccactatttatttatctacatggtagtaaagactaccatttatttatctacatggtagtaaggaccacctttatttagctacatatggctttcttccaactagtgggaaaacaggaaacaaaatgatccattattatcattgccatgcctcaatacgaccgagacaaggaatcatacaattaaacatgattaagctcaggaagcagggcacatttaaacattaacaaaattttgtaattttaaaaagctggcatggaaatgagattataaaaaggtgcagccagtttctggttatgtacaggaagcagtgataaaattaactataatgaaaactacctgaatgtcttactcctcgggccgatttataatatgctcatgcttcttgctcctcagagagagaaagagctgctcaagtactcgtgtgtgtgcgtgtgtgtgtgtgtgcgtgtgtgtttgtgtgtgtactgtactgtacttttcttagctttcagaacaaagaaaataagtgggttgggtgtggctgcctatgcctgtaatcccagtacttttggagtccagggtaggaggatctttgagcgcaggagtttgagacgagcctgggcaacatggtgaaactccatctctacaaaaaatacaaaaaaattggccagacttagtggtgcatgcctatagtcccaactactcaggaggctgagatgggaaaatcacctaagcctgggaagttgaggcaacaatgagctgagatggtgcctctgaaaaaaaaaaaaaaaaaaaaaaaaaagaccatggagtaagtagtctatgtaggaagtacaaaaagcagctggattttgatttttttttttgtatttgtttaactcaattattcaatgaattactcattgggtgtctaccattggcaggcatagggcacagacctggcaggaccgagatgatgaagacacagttcttggccttctggttttcacctttagtcagttagataaggtgtactcccaaatatggtaggaaaggggggtatcatggaaagatccagaactcccagctggtgggttgtttaatctgctgcatttggttactgataaggacgtgagggacaataagggaggtgaggacctgtggctccaagaacaggagccagaggtggtagaaggcacaagaggtagaacgaccagctctgggctcaggcagctctcaggccacttggcaggagtgagtgggtttccctgtaacactgggccatgagtgggacccacggacgccgtctgctcctttctgacctgctccgagtgtcttcttctgcttctgcatcctttctgttcttctacctggctcacagaaggcctggcacagctcagcctgcatctcaggaccattcagccgctattctcaacccctgctgggttcttagttcaatcccaggaaaagaaaggggacgagagctgctgggtcccacctgcggccacactatggactggttacccccaagctgggtgcccactccagatccaacagccatggctgggagggatagggccacaggacacaagcccctcggctgccaggggcaggcggtgtgactctcatctccagtggatgttcaggaaagaccttccaaccatgtggcatccaggctgcccttcctgtccaggaagggtttccagacagattggcagaggaggtggaaagccccaggtggaaaacagaaactgaggtagaccagaacacagcaaaaagaaaaacactcagaagggaggtgaggccaggcatggtggctcacacctgtaaccccagcactgtggaaggctgaggtgggcggatcacttgaggtcaggagttcgagaccagcttgggcaacatagcgagacccccgtctctactaaaaataaaaataaatcatttgggcattgtggtatgtgcctgtggtaacagctactcaggaggctgaggtgaaaggattgcttgagtctgggaggtcaaggctgcagtgagctgtgattgcaccactgcagttcagcctgggtgacagagtgagactgtttcaaaaaaaaaaaaaaaaaaaagagagagagaaaagttgaggccatatcccggaggccagggagtgtgagttggcagaatggattttactctgtaggccaaggcgagccaggaagggacagaaagaactggagctccacctcaggtagacccaacgggcagtttagcgcacggtgtgttggagagcagagactcgagttagaaagtctagcttctccttccgaaatctggctccaatcctaagtcaaaggctaaagacgtgtaccccacaggggggctactgcagtggtcttggtagagatcaacagggcctgtgtcagggcatgggcatggcaatgctgtgggcacgcatgggcagggggaaggaatgccagcgtgcatgggcacagaaccgatgactgtgacatcaggctcgctgcagccatattccactcatggagatataagaaggggagaagaggccaggtgcggtggctcatgcctgtaatcccagcactttgggaagctgaggggggcagatcacgaggtcagtagattgaggccatcctggccaacatggtgaaaccacgtctctactaaaaataccaaaattagctgggtgcagtggcacgtgtgtgtagtcccagctactcagcaggctaaggcaggagaatcacttgaacccaggaggcagaggttgcaatgagccgagatcgcgccactgtactccagcctggcaacagagcgagacaccatcgcaaaaaaaaaaaaaaaaaaaaaaaaaaaaaagaaggggagaagaaggttgtgtgtgactgctgcttaggcagaaggagactgcagggggcaccccactcaggtgctgggtcctggaggaaccctgtagagacttgagaggagacagtgaagtgtccagctgtcagggccagcagggtggccatgaggagcagaacacggagcggtgaggaggctggacagccacgacggacgaagtgtggtgtcactgcagaccctgcagttcaagcttttaccacaaacacctcacagtgctgctccccaagagtgagggacagtaaaaccacacattgcctccttcagcatcttagtaaagggaaaggtggggacagtggatgttgaaggtggctgtgaaggagaagacaagaggccgacagtgagcacgtgggcctaaaagccacgtctggcagaagaaggggtgcaggcagccggctgtgtgggaagccctgtgtgtataaatgctgtagcctcgtcccttccttaccagggaggacctggacaaccacagaagccaccagaggcccagggccaggggattgtccagccctgagtggaaggggttggattttattccaagtacaatgggaaaaccattgaagatccaagcaaggtgatttggtcaccctcactttgtaaacacttgattactggtttggcaagagtgaaatgggataacccgttaaaaacctactgcagtgcctgaggggacatggtggtatcctggatttgtgaggtggcaatgcagatggagacaccaacctcatcaaaagaatgagattcgaggagagaagaatcaaggacaattcctcgagttttggcctgagtttatagtggtatcaacttaggtagacgtttataccattgatcacgggaaggccaaaaatatcaagctctatgtgtccatactgagttggaggtgcctgacaggcctccaagcagaggcgtcatccaaggccccatttcagtggggagggtctgggctggagagacggaatcaggagtaattagagcattggaagccagaggcctagatgagatgtttaggaccagaaagaagaaatgtgggcccagcacaggcactggagcctcccaagaagaagggaccaagagatagaaagaaagaaagttgggccaggcatggtgcctgtaatcccaacactttgggaggccgaggtggatgcatcacctgaggtcaggagtttgagacaagcctggccaacatagtgaaaccccatctctactaaaaatacaaaaatcagccaggtgtggtggtgcttgcctgtaatcccagctactggggaggctgatgcatgaaaatcacttggacctgggaggcggatattgcagtgagccaagatcacgccactgcactccagcctgggcaacagagactctgtctcaaacaaacaaacaaacaaacaaacaaacaaacaaagccaggaaacatgattctcaggcccatgattttttatttatttatttattcacttttttgagacagggacttactctgtccctcaggctggagtgcagtgatacgatcacggttcactgcagcctcgacctcctgggctcaagtaatcctcctgtctcagtctcctgagtagctgggactacaggcgtgcagtagcatacacagattttttttcatttttatttttagtagagatggagtcttgcttaactgccctggctgatcttgaatgcctggtctcaagtgatcctcctgccttggcctcccaaagtgctgggattacaggtgtgagccattgtgcctggccaggccatgatttagatggaatagtatgctcttagcacagaaatgcattttacacaagcattgtcaattctaaccccatatcaaggaaagcacagtccctcaaaccttctttgtgagcttttctgtgagagcaggaggggcaagatcatgtttacagacatcacaacctgtgagacaggttgaaaaaataagagggcaagagagaggataaagccacactggcctgcttattagtctttaggagtgaccctgtccacttgtaagtgaggcagaggcagtgccctggactgtggcccaaacaagatgaacatgctctccattggagaggaaagggatggtggcacacagagtgggacagcccctccttttctctcacacacttacagtgaactgatagtttaatcaaattcaaatgtggtgtgcctcacagggaaaatagatgctatgtcccagctgtggataaattcactgctatcaccatccaacaataagtggattccagatcaggttccaagatggccgaataggaacagctccagtctacagctcccaaggtgagcgatgcagaagacgggtgatttctgcatttccaactgaggtaccaggttcatctcactggggcttgtcggacagtaggtgcagcccacggagcatggcggagcatcgcctcacctaggaagcgcaacgggtcggggaattccctttcctagccaagggaagctgtgacagatggtacctggaaaatcgggacactcccaccctaatactgcacttttctaacagtcttagcaaacggcacaccaggagattatatcctgtgcctggctcagagggtcccacgcccatggagcctcgctcactgctagcacagcagtctgagattgaactgcaaggtggtagcaaggctgggggaggagcatctgccattgctgaggcttgagtagccaaacaaaatggctgggaagctcgaactgggtggagctcaccacagctcaaggaggcctgcctgcctctgtagactccacctctgggggcagggcatagctgaacgaaaggcagcagaaacttctgcagacttaaacgtccctgtttgacagctctgaacagagtagtggttctccagcacagagtttgagatctgagaacggacagactgccctctcaagtaggtccctgacccccgagtagcctaactgggagacacctcccagtaggggccgactgacacctcatacggctgggtgcccctttgagacaaagcttccagaggaaggatcaggcagcaacatttgctgttctgcaatatttgctgttctgcagcctccgctggtgatacccaggcaaacagagtctgtagtggacctttagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggagaaaccagagcagaaaagctgaaaattctaaaaatcagagcgcctattctcctcaaaaggaatgcagctcctcgccagcaatggaacaaagctggacagagaatgactttgatgagctgacagaagaatgcttcagacgatcggtaataacaaacttctctgagctaaaggaagatgttcgaacccattgcaaagaagctaaaaaccttgaaaaaagattagacaaatggctaactagaataaacagcgtagagaagaccttaaatgacctgatggagctgaaaaccatggcacaagaactacgtgacacatgcacaagcttcagtagcagattcaatcaagtagaagaaagggtatcagcgactgaagatcaaatgaatgaaataaagcgagaagagaagtttagagaaataaagtaaaaagaaatgaacaaagcctccaagaaatatgggactatgtgaaaagaccaaatttacgtctgattggtgtacctgaaagcgacggggagaatggaaccaagttggaaaacactctgcaggatattatacaggagaacttccccaacctagcaaggcaggccaacattcaaattcaggaaaaacagaatgccacaaagatactcctcgagaagagcaactccaagacacataattgtcagattcaccaaagttgaaatgaaggaaaaaatgttaagggcagccagagacaaaggtcggattacccacaaagggaagcccatcagactaacagcaggtctctcggcagaaactttacaagccagaagacagagtgggggccaatattcaacattcttaaagaaaagaattttcaacccagaatttcatatccagccaaactaagcttcataagtgaaggagaaataaaatcctttacagacaagcaaatgctgagagattttgtcaccatcaggcctgccttacaagagctcctgaaggaagcactaaacatggaaaggaacaaccagtaaccagccactgcaaaaacatgccaaattctaaagaccactgatgctaggaagaaactgcatcaactaatgagcaaaataaccagctaacatcataatgacaggatcaaattcacacataagaatattaaccttaaatgtaaatgggataaatgctccaattaaaagacacagacaggcacattggataaacagtcaagacccatcagtgtgctgtattcaggagacccatctcatgtgcagagacacacataggctcaaaataaagggatggaggaagatctaccaagcaaacagaaaacaaacaaacaaaaaaagcaggggttgcaatcctagtctctgataaaacagactttaaaccaacaaagatcaaaagagacaaagaaggccattacataatggtaaagggatcaattcaacaagaagagctaactgtcctaaatatatatgcacccaacacaggagcatccagattcataaagcaagccttagagacttacaaagagtcttagactcccacacaataatattgggagactttaacaccccactgtcaacattagacagatcaacgagacagaaagttaaaaaggatatccaggacttgaactcagctctgcaccaagcagacctaatagacatctagagaactctccaccccaaatcaacagaatatacattcttctcagcatcacatcacacttattccaaaattgaccacatagttgggagtaaaacactcctcagcaaatgtaaaagaacagaaattataacaaattgtctctcagaccacagtgcaatcaaactagaactcaggattaagaaactcactcaaaactgctcaactacatggaatctcaacaacctgctcctgaatgactactgggtacataacgaaatgaaggcagaaataaagatttctttgaaaccaatgagaacaaagacacaacatatcagaatctctgggacacatttaaagcaatgtgtagagagaaatttatagcactaaaagtccacaagagaaaacaggaaagatctaaaattgacaccctaacatcacaattaaaagaactagagaagcaagagcaaacaaattcaaaagctagcagaaggcaagaaataactaagatcagagcagaactgaaggagatagagacacaaaaaacccttcaaaaaatcaatgaatccaggagctggttttttgaaaagatcaacaaaattgatagaccactagcaagactaataaagaagaaaagagagaagaatcaaatagaagcaataaaaaatgataaaggaggtatcaccgccaattccacagaaatacaaactaccatcagagaatactataaacagctctatgcaaataaactagaaaatctagaagaaacggataaattcctggacacacacaccatctcaagactaaaccacgaagaagttgaatccctgaatagacaaataacaggctctgaaactgaggcaataattaacagcctaccaaccaaagaaagtccaggaccagacgaattcacagacgaattctacaagagctacaaagaggagctggtaccattccttgtaaaactattccaatcaatagaaaaagagggaatcttccctaactcattttatgaggccagcatcatcctgatgccaaagcctggcagagacacaacaacaacaaaaaagagaattttagaccaatatcaatgcaaaaatcctcaataaaatactggcaaaccgaatccagcagcacatcaaatagcttatccaccatgatcaagttggcttcatctctgggatgcaagactggttcaacatacgcaaatcaataaatgtaatccatcacataaacagaaccaaagacaaaaaccacatgattatctcaacagatgcagaaaaggcctttgacaaaattcaacagcccttcatgctaaaaactctcaataaactaggtattgatgggatgtatctcaaaataataagagctatttatgacaaatccacagcgaatatcacagtgaacgggcaaaaactggaagcactccctttgaaaactggcataagacagggatgccctctctcaccactcctgttcaacatagtgttggaagttctggccagggcaatcaggcaggagaaagaaataaagggtattcaattaggaaaaaaggaagtcaaattgtccctgtttgcagatgacatgattgtatacttagaaaaccccatcgtctcagcccaaaatctccttaagctgataagcaacttcagtaaagtctcaggacacaaaatcaatgtgcaaaaatcacaagcattcctatacaccaataacagacaaacagagagccaaatcatgagtgaactcccattcacaattgctacaaagagaataaaatacctaggaatccaacttacaagggatgtgaaggacctcctcagggagaactacaaaccactgctcaacgaaataaaagaggacacaaacaaatggaagaacactccatgctcatggataggaaaaatcaatatcgtgaaaatggccatactgcccaaggtaatttatagattcagtgccatccccatcaagctcccaatgactttcttcacagaattggaaaaaactactttaaagttcatatggaaccaaaaaagagcctgcattgccaagacaatcttaagccaaaagaacaaagctggaggcatcacgctacctgacttcaaactatactacaaggttacagtaaccaaaacagcatggtactggtaccaaaacagacatatagaccaatggaacagaacagagcccttagaaataataccacacatctacaaccgtctgatctttgacaaacttgacaaaaacaagaaatggggaaatgattccctatttaataaatagtgctgcagcactattcacaatagcaaagacttggaaccaacccaaatgtccatcaatgatagactggattaagaaaatgtggcacatgtacaccatggaatactatgcagccataaaaaatgatgagttcatgtcctttgtagggacatggatgaagctggaaaccaccattctgagcaaactatcgcaaggacagaaaaccaaacaccacatgttctcactcataggtgggaaatgaacaatgagaacatttggacacagggtgggaaacattacacaccggggcctgtcgtggggttgggggagtggggagggatagcattaggagatatacctaatgtaaatgacgagttaatgggtgcagtacaccaacatggcacatgtatacagatgtaacaaacctgcatgttgtgcacatgcaccctagaacttaaagtatgatgtataatttaaaaaataataagtggattccatttaagttttttttttttttttgagatgaagtctcactctgtcacccaggctggagtgcagtggcacaatcttggattactgcaacctccacctcccaggtttaagcgattctcctgcctcagcctcccaagtagatgggattacaggcatgtgccaccatgcctggctaaatattttttttttttgtatttttagtagagatggggtttcatcatgttggccaggctggtctccaatccctgacctcaaatgatcaacccacctaggcttcccaaagtgctgggattataggcatgagccataagattttagtaggtggcccaaaactgactgttgtttctctttttaattattgtacataccaaaataatgaaaagagtaaatttcaaatgtctcactataaaaaatgttaggcaagtgaggtgatagacaagttaatgatgggttaatgtgtttgatttaatcaatccaccttgtatacaaacatcacatcacattgtacaccataaatgtatacaataatgtatccatcaaaaataacaataaaaactgaaaaaaatattaaatataccttggaatcctgatactatttggacgacatcttcatataccattagagtggcagagcgttctggaagcaggccaaggctcagagaggaaaatactgcaggaaaaagaaatggatagaaggggattttaatagtcatatttaagtgcctactctaatttttgggatactctgcagtttttgtattttctgatttcaaatcaattaatacaattaatttttagttagattagcaaaagaccttcaaaatgctacaagtgtattgcagtatctcatataacaattacttgccttacaatggtcatcttttttcatttgttagaagttttcttttttttttcttttttctgagacggactctcgcttgtcaccaggctggaatgcagtggcgcaatctcagctcactctaacctccgcctcccaggttcaagcgattctcctgcctcagactcccgagtagctgagattacaggcacctgccaccatgcccagataatttttgcatttttggtagatacagggttttactgtgttggcgaagctggtctcgaactcctgacttcgtgatccacctgccttggcctcccaaagtgttgggattacaggcgtgagccactgcgcccagccagaagttttcagtaaagtaactaagcctcttcacattaggagtatatgaaagttatcatgtatacactacatgaatgtagaatacataatgttagatgttaacattaagaatggctttaaaaatacgtgtctaggttaatgtgtacctcatggtaaaagaatattcccccaatcctgggaactaataacatgatagaaattgtgcttttcatttttatttttttgagacacggtctcactctgtcactcaggctggagtgcagtggcacggttagaactcactgtagcctcgacctcccaggctcaagtatccctgctgccttagtctctcaaatagttgggaccatgggtgtgcaccactgcacccagctaattttcaaaattttttgtagagacagggtctccatatgttgcccaggttactctcaaactcctgggctcaagcaatccttcccacctttgccttccaaagtcctgggattataggctagagccactgcacctagccaagttatgctattttcaaactcttgcttaagtacctggatttctaaaaaattttagaaaccccacaaatttctgggtaaaacatgaatttaagagaaaaacaaataaatgcattatagaataataatcatcactcacattactgaacctttactaacaggacaaacagtattctaagtgctttaattttagtaatttatttaagcttcaaaacagctctatcacttaggcattattattattatttttgagacagagtttcactcttgttgcccaggctggagtgcaatcgcgtgatcttggctcactgcaacctccgcctcgcaggttcaagtgattctcctgcctcagcctcccgaatagctgggattacaggcacctgccaccatgcccagctaatgttttaaaaaatatttttagtagagacagggtttcaccatgttggccaggctggtttcaaactcctgacctcaagtgatccatctgccttggcctcccaaactgctaggattacaggcatcagccaacgtacctggcatctgaagtaggcattattaacatgcccatttcacaggtaaggaaacaggtttacagatgaggaagtaactcacccaatatcccacagctaataaatgccagggctacgatttgaactctggagttctcaaccactatgagacatggaaaagttggcctagagaggtaaatgacattctgggaaaacatcaggatctagaagataagtgctaagaagatcagtcacttcacagtgctggctctttttttttgagatgcagtttcgctcttgctacccaggctggagtgcagtggtgcaatcttggctcactccagcctctgcctcccacgttcaagctatcctcctgccacagcctcctgagtagctggaattacaggtgtgcatcaccatgcctggctaattgtgtatttttagtagtgatggggtttcgtcacattggccaggctggtctcaaattcctggcctcaagtgatctgccctcctcggcctcccaaagtgctgggattacaggcatgagccaccgtgcccgggtaagcagtgctggctcttagtgccatagggcaccagtgagttggccgtggatgtgacctcttttcactcagcctccacacagtcaatttatttagctgtcatcatatacgaggctcagatctacaccctgggtggaacagatcagtgttagaagcagcctgtgccttcaagagttatgcattgcaagggtactagacttgaaacaagtagctgtacgacacgcagaatgggccaggtaccaggagaaagacaagaatagcagcttggtgctgcagaaacagcctgggagttcctcaaatattaaacacagagtgaccccaggatgcagcaattccactcctacgtataaacccaagagaaccgaaaacctacgttcatacagaaactcacacatcgatgtttgcagcagcattatccgtaacagccgaaaagcggagacaacacacgtaaatgtctatcggctgatgaatggataaagtgtggtattgtctatatgagggaatattattcactcatgaaagggaaggtgctactgacatgtgctacaacgtggatgaatcttggaaacatcaggctgagcgaaagacgccagacacaaaaagccacgtattccaagattccagttctatgggatgtgcagaataggcaaatctagagagacagagggtagattagtggttgccaggggctgggaggtgtgggaaagagtgagttggtgctaataggtatggggttttgggggtgaggaaacattctgcaattagtcactgttgggaggaaccccaacttgggtaaatcccgcatgaccacttcgtaggtaaactattatcagcgatcctttcacctaaggcacagggcacctcctggcgaggaggaatgggcaggattgtcctagcagatgctgctggtaggaagcagcacacctcaaaacccgggctagggttacactccatgccctcctaaacgaggatgcctgggtcttcctgctccattgcagagctcccgtggcgactgcagacatttacaaggccctgaccacctctgagctgaccggtttggggggctcggagctccgaaatcacctgtgatcatcccctgagaggtgtgtgaccatcgcagtgtgttttgaaaatgtttctcacctaaaatatttggtactttcatatataaggcagctgctctggcaaattgtttctcaaactttatttcctaaaggagagaaaaatgattccttgttttacttttttaggcctttctttgaattctaaaacacatgatttcttgtaacaagcttggcaccagcagggacttcccggggcagaggacagggactagggatgcaatcaagcagtgcccaggtgggtgaaggcagcagagagacggagatccgtgggtagtgctgcttttttcccatcacagaggggaggctgattgatgtctggaggtgctgttcataccaagtagattttttttttttgatacctagagggaaaggaacatctcattctacccaggaaaggcaggaagattttttgacgcagaaaacagtccagctgggctttatgggataaaagaagtttgccggccaggcttggtggctcatgtctgtaatctcagcactttgggagtccaaggcaggcggatcacaaggttaagagatcaagattatcctggccaacatggtgaaaccccatctctactaaagatacaaaaattagccaggcatggtggcgtgcacctgcagttccagctactcgggaggctgaggcaagacaatcgcttcaacccaggagacggaggttgcagtgaaccgagattgcaccactgagactctgtcttgaaaaataaaacaaaacaaaacaaaacaaaaacaaaaccacaaattagctgagtgtggtggcgtgcacctgtaatcccagctacttgggatgctgaggcaggagaattgcttgaaccttggaggtggagggtgtagtgagctgagattgcaccactgcactccagcctgggtgacagagtgagacttcatctcaaaaagaagaaaaaaacccaaaaaatttgccaagagaacaatgcagacaaacacagacagggtagaaatggcagactccttcacagaatgacatgttgcccagggcggccgaccatgagatatggaagggagaggtggccaggggaggaggctccgtgtcacgtttacttcatcctgaggccactgaagaattttaggcaggtacatattttaatacatgaactgcacatatatattttcatacacaaatgctcagtcatattgtgggtggtctgtggggtagaacaactggactggaggccattgccatggtcctggaccatcgctaaggacctgggccagggtgatcgctgcagagacagcaataattaagacgtagaatgacagcctttagtggatggactgcatctcctatggctaagtttattcttacctgcctgccacgggtggagggtgttttccttatgctgggttcctccctctcctcccttccttgaaagtgaaaaaaacctcaacacatcctccaggaactattgttaaggatgaaaaaggaaatccgtttctgggtttcgtaagaatgctcatgcacacacaagcagtgtgctgcacacgtgtgggaaagaaggcattttttagtttcaaattttcaacatattttagaagaggctcccagctcttctcacttccttgcccagttatctgcaataccagaagtgttagtgttcatctccaaaaatatgcacaaaagcaaattgactctgcttttcacaataggctaaatttttttgtctaaattttggagatgtttcctgttaagttctagttaagagcataacatggtttggatctgcgtccctgcccaaatctcacgtcgaattgtaacccccagtgttggaggtagggcctgatgggaggtgattggatcacgggggcagtttctcatgaatggtttagcaccatctcctggtgctattcttgtgatcatgagtgagttctcacgagacctggttgtttcaaggtgtgtagcacctctaccctctctctcttcctcctgttctggccatgtgaaatgtctcacttcccttttgccttttgccatgatcggaagcttcctgaggcttccccagaagcagaagatgccatgcctcctgtatctcctccagaactgtgggccagttacacttcttttctttataaattatccagtctcagctatttctttatagtggactaatacagagtatctttattatattgaaaaggcaaagcgcagaaaaataatcacagacatgggaagatttttagaaattatttagactaattaacttgatttcagaaacaaacacaagctcagaaagtgctgatgggccgatatgtgtggggccagccaggggtgggcaggcctgggacccaggtgtcttcatgccttgtccaaaactcaattaaacttcattattcctatgacttgactcatttgtaatagtacagatatcagccgggcacagtggctcacgcctgtaatcccagaactttgggaggccgaggcaagtggatcacctgaggtcaggagctcaagaccagcctggccaacatggcaaaaccccatctccattaaaaatacaaaattaaccaggtgtggtggtgtgctcctgtaatcccagctactcaggaggctgaagcaggagaattgcttgaacctgggaggtggagattgcagtgagccaagatcacgccactgcattctagccttggccacagaatgagactgtctccaaaaataaaaaaataaaaaaacagatatgatgggaatggtttttctcaaatgaccatgttaacagagtcaaaatgaatgtgatcaaagtgtagtagctgctcattattcaccaattctgtatttgtaaacctccctacttgctaaagcttatttgtaacccctagatgtattcagggccaagcttttcatgtctttaagcattctgttggtgattttgctatttacttatttatttttagagatggagtctcgctgtgtcatcccggctggagtgcagtggctccatcccagctcactgcagcctccacatcctgggttccagctcctcttgcctcagcctccagagtcgctgggattacaggcatgattctaccgtttcaaatgacccctagtgtagtgctgtctaatgttcctaagcaggaggaggttgtgactgtgccttatggagaaaacatgtgtgttcgatcagctttgttcgggcatgagttatggtgctatgggctgtcagttcaatgttaatgaatcaacaatctatatatcaaataagatttctttaaacaaagacaacacaaaacaaaggcacgtactattgatcggttcatgaaaatgttgtgaccagaggcttgcaggaactcagccctgcgtttcccttgtagcagtggttcagtatttgctcagtccatgtttgaggtggctatggaccataactactgtgaacaacgacaattgactgatgggctttgtgtagctgttctcctgaaacaggcagagacagcctaaacgtccctcagtgatttccagtgacttctcagcatggaccatgggagtgtcaaatgcttcctttattttaatttattttattattttttgagacagggtcttcctctgtcacccaggctggagtgcagtggcaccatctcagctcactgcagactcgactctaatgttcccttggatataacttagtaaaggccacctgtcctgttgtgtgggctctcctggggtcctgtctcaggcccactgtcctccaccctctgctggagataatagttaacactgctgataagccaaactaaacctctagcccagatctctctcttgaaccccaagttcatttcaaactaaaggccgaatatgctcacttggtgtcccagcagcaatttgaactaaatataccctaaacttagcttataatcaatgactgcgacacccattcctctcctcccatttccccaaagctctgtccatctttgcctaagcctagggagagggagttacagagggagggagggagtgagggaggagacttctttaattcacaccatcagtgcaatcaactttaggaaaacgtggtgtggccagatacccacctccacagcttgcccctgctgggaccaactgctctgtcaccagctgaaaacccgaagtccaactcacattccttctatttcatccttttccttccctctctcctgtccattctccaagacctgcttaatatctctcaggtttatccccttttcttatgaactctcctagatgatctccattgtatctgtatcaaatccactttccatagatcaaaaagcagtggcctcaagctttgctaaatatttttattcacagtatctggtggagggggagaggcgtttgctcgttaaaatgcaaattcccctccccatattgaatggtggagttctggaatctgtatgtttttatttattttatttcattttattcttgaagcagggtcttgttctgttgcccaggctagactgcagtggtgtcaccatggctcactgcagtctcgaactcccagaatcaagcaatcctcccacctcaacctcttgagtagctgggactacaggtgcacactatgatgcctggctaattttaaatttttttgtagagatgcagtctcactatgttgcccaagctggtttcagactcctggccttatgcgatcctcccaccagccaatgccctctgtgttaaagaaagatgaggaacgccttaccaggtaaccggattggcttccatggggcagagtttggcacgtaggcatgcttcgaggcggtgacaatcaactgactgcccagcttatactggaacttgataaaggcgacgccatcagtccccgaggtgccagaggctatggaggcctggttggtgaagatctcgatgagcgcatctgctacgggctggtgggtgctggcgtcgctgatgtgcacctttaacgtcacctctggaggtagagaaagcacaaagaacagctactgtcaatgggaaacattcatagcaactctggtatgactgtgatgggaagtggaaggagggctctgtaaggacatcaaggttgacactcaaaatatgcagtttttaccagagacattttctccttacaggtctactttttacttcacacaatttcccattttcttcaaaaccacagcctgacccaaactgctttcttctttactactgcctgctcaaatcaacaaatgatcaagagaaaaattctatacttttaaacattgggcaaccaatgcaatacttcgtgtgtgtgtgtgtgtgtgtgttttgaaacagtctcactctgttgcacaggctggagtacaggtgcgtgatgatggctcactgcagtctcgatctcctgggctcaactgatcctcccacctcagcctcctgagtagctgggactacaggtgtgtgccaccacactgagctaatttttgtagagatggggttttgccatgttgcaaaggctggtttcaaactcctgaggctcaagcgatctgcccgcctcaggctcccagagtgctgaggttacaggtgtgccccaccgtgcccagacaacaatactctttcaatggtgtttgggctaccacagtaagggcacagtgggccatggtatttgcaagctgccgtatccttctctagtcctgggaaatgtggcagaagtaacccaggattgtgcactggtaatcacaaaggctagactgaaaagaagtgaaaactattgttaaaagggaggacccaaagagtagaacaagagaaggttagaaaaagaataaaaaaaaaaaaaagcaaacgtttgaaaagacagatgaagtcaagttaggaatattggcaaaaacagatcatgaatctgggaaacaaacagaatgttacaaattgctaaaaaattaaaatagaatggctaatttacatttactcaggcaagggatagttaccgaacttttactctgtgcctagaattgtaactacacagctacagtgaaggagaggatgcgtgagtaaacaggaaagtaccatggctgagggggaacagcatgtgtggaggcttagaggcaggaagacgccatgtttcctggagaaacaatggcaggttctgaaagctggatggagagcgtgagaggcgtaggaggctggagaggcaagtaaggccagatcacacatggctttatgagctccgtaaaaggattattctttattctaaaggcaatgggaagtcacaaaggttttaagaggggagtggagatcaaatttatgttacagaaacatgtggctctgggtgaagaatgggctgaggaagaggcaaggctggagaataagcattcaattaagaggactctgtgataacccagaactgagatggtggtagaccagactccagcagaactatcacgtcaagggtgctgattccagaactatgtgggggagcaactcagaagtgcatcctgctcccagaaaccctattttcttaagtaggaagcaagcagctggtgtgatgtatgtccacctggtcacttgcaggcaccacatgccatgctttttgagctgcctctgatctgaaagacttgggataggaaggtggggaaaggactagcaaaaagcgaggaggtggccaaggaggcttgtgttcatagcaccttccagagtggggctcagtggagtgaccatcaatgagccggctgcaggctggctgggtacagagcagcctgacagcgaggatgaggaaggagtgctgggtcagccttgcaggtattgcccagtggcacacaccctggggttctgcaattctcactggaggttcgaatctcagctccaccatgtgctagccatgtagccttgggcagtttatttatcatctctaggccccagtttccccatttgctaactgggaatgataaacatgcatagctcaacatataggtagaaacatttagtgtaatgcctggtgcagtaagcaccgacacaagctactgcaattgtgtcattccaatcatgatgcttgtaaacattccaacatggtgcttggggataccagatttggggctcagagaggagagttagaaagaagaaatatataaaacaaaagggacaggtgagacaaccctctcagagagtattaatacctttgtttgtttgtttgtttagatggagtttcattcttgccacccagggtggagtgcaatggcatgatctcagctcactgtaacctctgcctgctgggttcaagcaattctcctgcctcagcctcccgagtagctgggattacaggtgcccgccacgatgccccactaattttttgcacttttagtagagacagggtttcaccatgttggccaggttgctcttgaactcctgatgtcaggtgatccacccacctcgggctcccaaagtgctgggattacaggcatgatccaccgcgcctggcctgagtattaacatctttatatccagagctctatcctacactggggcaaccatatagagaagaacttcttttggtttgagaatctccaccttggtaacttgccaactagctgtctcatgatactaaagcagtcttttcaatactgcaaatttcagttagtcaatcatctttcacccattttttccacatgctgatttaatacatttcttgagtagataaccatagacaagagctaaagaatcctagacctagctaaatcattcacctgcctttgaggagctctgagctatgggtgtgtaccaaataaatctcttaaaatgttttagcaagaacaaataaatgctacagaaaccaatcttggctacttcatactataggagaaaactaacatccaaaaagggacaaatcagcatcatgaaaatcaaggatatgatattacagaatacatttagtcaattcacttcaatccaatcaggatgtgcacgacacatacacacacattttcttcttcttttttttttttttttttgagatggagtctcactctgttgcccaggctagagtgcagtggtgcgatctcggctcaccgtaagcttcgcctcccgggttcacgccattctcctgcctcagcctcccgagtagctgggaatacaggcacccgccaccacatccggctaattttttgtattttttaatagagacagggtttcaccgtgttagccaggatggtctccatctcctgaccacgtgatctgcccacctcagcctcccaaagtgctgtgattacaggtgtgacccaccgcgccggcctctttttttttttttttagacagagtttcgctctgtccccaggctggagtgcagtggcgcgatcttggctcactgcaacctttgcctcccaggttcaagcgattctcctgcctcagccaccagagtagctgggactacaggcgcctgccaccacgcccacctaatttttgtatttttagtagagacgggctttcaccacgttggccgggatggtcttgatctcttgacctggtgatctgcccgccttggcctcccaaagtgctgggattacaggcgtgagccaccgtgcctggttcccccacacacattttcttatttaacttggtcctctgtgtccccaagtagtatactattcctcttataaattttaaatttttatttatttatttccgtaggttttaggggaacaggtggtgtttggttacatgagtaagttctttagcggtgatttctgagattctggtgcgcccatcacccaagtagtgtacactgtacccaatgggtagtcttttatccctcaccctctcccacccttttccctgagtcctccaaatccactgtatcattctttatgtctttgcatcctcatagcttagctcccactcaggagtgagaacaaacgatgtttggttttccattcctgagttacttcacttagaataatggtctccaattccttccaggttgctgcaaatgtaattatttcattcctttcatggctgataagtattccatagtatatatataccacattttctttatccactcattgactgacgggcatttgggctggtttcatattttttgcaattgcaaatggtgctgctataaacatgcatatgcaagcatctttttcacataataactttttttgttctgggtagataccggtagtgggattgatggataaaatggtagtccttttttttttcataggtttttggggagcaggtggtatttggttacatgagtaagttttttagtggtgatttgtgagattttggtgtacccatcacccgagcagtatacactgaatccagtgtgtagtctttacctaagtagtatactaaattataacataaattaactcatggtgcattaataaccacatagcagaaatcctgcattgatgatttatgcaattttatggaaatgcaacatttactaacaattgggattacaaggtcttcactgtttgctaagaaggcaaaaactgctgagatttgagggaaaagaagatttatgaataaacagagaaaggcggagttccactctaatcaacaccctagattctaccacttgaatttcttctaatatgggaaggatagtttaagttctacaattatatacgttaaaagagattgtttagttcttcgcttggtatgatcagagagaacaaaatgtcagtatgattcggtaattcttttttttttttttttttttttttttgagacagagtctcattcttgttgcccaggctggagtgcaatggcacagtctcggctcactgcaacctccacttcccgggttcaagcgattctcctgcctcagcctcccaagtagctgagattacaggcttgcgccatcacgcgtggctacttttgtatttttagtggagacagggtttctccatgttggtcaggctggtctcaaactcctgacctcaggtgatctgcctgccttggcctcccaaagcactgggattacaggtgtgagccatcacacccggcctgattcggtaattcttacagcccacaggggcatcatcgttatagaataacactgagaatgggactctccattcaaccgcaaacaaaactatccctaactaaatgacaaccagggcagctgtcatctgactaggcaaggcattagttactacatgactctcatttataggaagaccccataaacggtcccagacctaaatatgccctagggtgcactctttgctgctcagtgagtactgaggaccccgctgagttggtcacctgaagactgcacaaaacccagactgggacatccttttctcactccataccctgcacatccatcaccaaagtctgctcattttgactgcaaactctgcatctcaaagcaggcctttcttttgtaccctcgtgaacactgccctatttccaggccttcaccatccatcacccacactgctgctcagcaactttaccaaaacagtcaccctcttcagacctgagccctgagatcccactgaggctggagggagctatccaatacactcagctgacctctccctgtctccctcaaacccttcgatgcgtccccactgtcacctgtaccaggtgcagcaacttcggcctgccctcaggccaaatgtggcctgctgcctgcttttgtatacagtccatgaaaattatctgcaatttaaatttcagtgtctataaagttttattggaacacagccacgccccatcatttgcatgggctggttttgcattacaacagcagactttagaagttgccacggagaccataagggctgcaaagcctgaactcactacttttggccctttagagaaaaaggaaggccatgtggctcacgcctgtaatcccagcactttgggaggccgaggcgggcgggtcacgaggtcaggagtttgagaccagtgcggccaacatagtgaaaccccgtctctactaaaaatacaaaaattagctgggtgtggtagtacacgcttgtagtctcagctacttgggaggctgaggccggagaattgcttgaacccaggaggcagaggttgcagtgaaccgagaccacgccattgcactccagcctggatgacagagtgaaaaaaaaaaagccaccacactcaagggacaggatccatcccagaagcctcctgtcctgcaccagccaccccacctgaccccatcccctgccctcggctcctccttcctgttccttcctgccacagcttattgcctttgaaggcaatgtttttctacacttcccttccatgttgctaattcctctttttcctttaaaaggctgcagtaaggtggattcaagaaagtactctggccggactcagcaaccctgcatttccctgaagctctccagacacatggtctctgtttcttgtccatttccatttctgtctgtttcaccttgggccaactgtgggggtgtacaacagagaccagacccctgaccctcaggagctttagctttattgattaaatacatactgaagtgtcattctgaactggaagaagtgccccaaggaaaactgggtgacacaaggcagaacggggaacctattttcaactgggtggtcaggggaggccttcttgaggaggtgtcattttagcttaggcctggaggagacacagggaccagccaggcaaaggggtgtcctgagatgagaacgaccaggttgtttaccactgaattaaaactcccacggagagagctttgtgcaggggcccttgtgactgaagatgaggggtctgggccacccatgtaccgccgttttgttttgtttagagtcttagcttactacaggcttgacctcccaggctcaagcgatcctctcacctcagcatcccaagtagctgggaccacacgcatgcaccaccacatccagctaatttttgtatttttgtagagacagggttttgccctgttgcccaggctggtctcagacttctgggctcaggcgatcctcctgcctcaacctcccaaagtgatgggattataggcatgagccaccacgtccggccataccactattttagagggtctggggtggcccatgagcccctcaagaataggggcttatttttaaaaaattcaatttataactgtgaggcctagctggtacctagagccagcaggtggtcaataaaagtttgcaaaatgaatgctggggtgaaactaaccatctcttaacacaacactacctgatataggggccatcagccacatgtgagcatatacacttgtttaaattaattaaaattaaattaatttaaaaatcgagctccttggtaacactaggctcattgtaagcgctcaacagccgtgactggctagcggttcctgcgtcggagagtgcagactggatatttctatcattgcagaaagttcctttggacaattctgatctccgaatctgagtcaagaaatccatggtatccaaatggctcaatgaactcccaaggaaaatctacctgagcgtgactctgaagtggtgtcttcacagcccttgtggatcaggccttcactcaagtccttcagtggcttaaaaggccctgtttgatctcttcccacccctcctccccagctgtatcacctcctgccctcacttgctaaactttccccattcagggacttgcagggaggccaggtacggtgaacgtgctctgctccaattgtgccctggcctggcgcactctcccccagatacccagccatgcggctgagacccacacctccctgtctttgtttcagtaccacctccttgatgaggctatcctatcactgtcactcttttttaaaaattttcaacatggaaattctagaatgcatatattttagtctgtttagcctgctataacaaaaccccataaactgggaagctaaaaaacaacaggaatgtatttcttaagttcaggtagctggttagtccaaggttagggcagattaggtatctggtgagggctcaccttttcactgcatcctcacgtggtggaagggatgagggggctctctggggtctctcaagcacactaatcccatgcacaatggctcccccctcatgacctgatgtcctcccaaaagaccccacctcctaataccttcaccttgggggttaagatttccatatgtgaacttgaggggaaaacaaactttcagaacacagaaacataaaagtagaaagaacagtacaaggaccttcctcccaaacctgtcctgataggaagtttcaaatagtgtcatctttctgccattctttctttcatgcattgctcccaccatccccacttttttgctgaaacattttgaagcaaattccagatatcatattaggttatattatttccctggaaattttttgctgttgttttttgagacaggatctggctctattacccaggctagagtgcagtggcacgatcttggctcactgtaacttccccaacccgggctcaagtgatcctcccacctcagcctcccatgtaggtgggattacagggacatgccaccaccatgccaggctaactttttatatttttagcagagatgcgggttttgccacattgcccgggctggtcttgaactcccggactcaagcaatccacccgtctcgtcctcccaacatgctgggattacaggggtgagccactgcaccgaccaccataaatattcccacttaaaacagataaggatttcttttaaaccaccaccaaaacacaattatcatgcctaactaaagtaataatctccttatatcatctaatacccagcacttattcaattttttttgattacctaaaaacatttttaaaaataattcttactattctgtctaaaacgtcgatcccagcctcaccccaaatttctgatattctcctgctctgcttctgctttttatgcgtgacattgattaattataacatgctcataactcatatgtttattattaaactctaccagatggaaactttgagacagttattttgtgtttctgttttcttcttcattcacacatcctaagcatatagaataatgtctggcacacagtagtcacctaatgtagatgctgaattaatctctaaaacgagtaggcatttctgggtatcttctgatccatggcctaagtattcctggtattttgttgttgttccatttatttcttataactactttaaaaatagataatatagagatctatttgaaaagtattaatcaatccatgtaactaactgtaaataatcagaaaatatttattgaccagctgctatatgcttagcatgatacaaggtactgcagggagattaaaaaagaaggagaaaaaaagacatgcctcctgtttttaaggagtttacggttttgcggggaggaaagaccaacaaatgtgccagaaagcaaaaagaatgaaactggctaggaacctgtaaaaaaaaaatatatatatatatagcaaagatgaggttaatctgatttggagtttccatgcaaaaacagaatcaaagatgcaaacaagatctgaatgcattcatagaggtgggggggatcatcaaaagatttaaggaagggtatggtgtgaacactgatactatgaagggtcgtggctatctgggtactcactgcatgcaaactggccctgattgtggtttacggaggtcagggaggaataatgcttcttggaagagatgaaattgaagctggtgctggaagggtgggtaccacgggcagatgagtctttgtggcaccttctgaaatagtcttcctccctttgaggaataccagatgctcattttcccagcctcccctgtagctaagaaggagaaaaaatgggctgcggttctgctaagctgtggctctgctcattctggttggcagaatttgatgtggaagtcagcagcatgaagaagcagggcctttttctggccaaagggaccgcagaggaggcatctggttgggagcagcaggggtgctcccggaagagtcacaccacacagctcagacactgttctggctgtgagcctcctcctcccacaagttctgtgtgctacccaaaagctgtaataaatgtcttttctcattaaaccagctagatgggcagtgctgcttgccctgctcgggttctgtgctatcctggcatgattctatctagctggggaccatctctttgaaactgcacctcatggctctccttccaccgtgcaccttccttctcagtacccaccatgggctccagttctgtctgcctgcccaaggtcgtggaccccgggagtgtgtgctcacacctcttcttgctacacactctcatccatgaatttatttcaccatcaggaattcagccatcgcctctagcatattcttcaatttttatcagccaattgcagagccaaggaggaagaaacgagcgctcaggaattcttcccctaccacgattcagagctcctctgctcttggcaaacatgaagagtgtggctctgtgggcacaaactggtccattttaagtagtacaaagagcatctgctttgtgggtagaaaactaaacatcatctttcagtccagcattatcttttagtcatttcctttctaactgccacagatttagaactaaatgcgacaaggctgtttccaattgttggcttgggaggaggctcctctaagtagcgagttaagagtgaacaagaggaaggaattagggtgcataatttacaggcacatggaagaagctccctgtcggtatttgacaaaactgccgacaaactttgagggaccatctgaaggcatgccttgttttttgtttttgttttgttttgttttttgagacagagttttgctcttgttgcccaggctggagtgcagtggcgcgatctcggctcactgcaacctccacctccagggttcaagcaattctcttgcctcagcctcctaagtaactgggattacaggcacctgccaccatgcccagctaacttattttttatttatttttatttttttatttttagtagaggcgggggtttcaccatgttggccagactggtcttgaactcctgacctcaggtgatccacctgcctcggcctcccaaagtgctaggattataggcgtgagccaccacgcccggccagcatgccttgtttttaatccccactttgtcaaataatgcataccttttgttatttttctataaacgataggatgcatttagtttataactttgcctccaaattccaaaacatgtactattccaaaacataaaatcttttatggtttttctggcaccagagctgggagtacagcttccacctgctttctgcacagtctgcccttctcatttctcatatttattctaacaaactctggccctatcttaaaagggaaagtaaagtttgtgggctccattttttaaatttgtttcatttgtttgtttctgtgaagtttttggcttcctcttaaccgcttttcattcccttttctatttcctcaaattggcctttgttctgggattttcattttttctttccttttggtttttagagctgttggtttccacagcaactcaccctagtagtggggaacccagcattttatgggctggccactgggtctgggtagaagaaaggcccattcccaccaagcaggccatgcaaatgctctcaccccaagtagcccagcactcctgtggctgcctgggccagggaggccagctgaaaaggagcctctctccttagcaccatgattagctacatttaaccccaatttaggggagttacgacggcttttcatctcttaaatagaacaccagaaaactgcttgatcacttaaaaacattttccaaataggaggttattgtaaaaatgttacctgacctttgctctacgaggttttgccccatgttacttggtgttagaattttacaatatcagcatgtgcattgaatttccatgtctttataaagcatgttccaggatgcctaatgcgtgaaggggtggctttctatttatacttcttttataaacatagaggttttcctgtgtaatctgatgaaattaggatgcactctgttacactggagttttcatgtaattttttccagactcacatagtgcacatgcaccttgtattattctattttattttctacccaaaatttagccaatcatgtcatccaaggaaattatatttatatattttaaagtataatctatatgttatgtaacatataacagattatttaatatgtatctcataatatatcatatactttattaatctatatagaatacatctcaataagaatctgttacaacttgtacatttgaggactcccttatatgcaatttctagctgcactaaagcatttggcaatccttgtgtgtgtttaattctgaaaacaacattcagtttgatgttcctccgcaaagaccaagactactgtcatccagaagagaaaggactgtgcaggcatacttcagagagacgaatacgctgggcactagaaccccccctagcttcctgggtcccctctccacgtaggcacctttcactcttgattgtaccaagaggtgccctgaacctcactatggatctgcggccccagtgtctgatacagaatccccacctatgtggggttctttttttgaaacatgttccttagatttcagtggaagtttacagtctctagacatccatttgaatgacctcattggagacgcatggaagagaaaaatctgctggaacttagagtaccactgtgtgcctttctgtgttctatcatctcaggcaactgatgcttatgttaaacctcgtgaaaaggcagccatgtggtagactcgacagctacagcttcagtttgaaataggatgagaagagaccacagtacagtgctatttacactggtggctcctaccggctgctcatcctctgaagggcgtgtattagagctttttttcttttttttttttgagatggagtcttgttgtgtcacccaggctggagtgcagagacacgaccttggctcactgcaacctctgcctcccaggttcaagaaattctccctacctcagcctcccaagtagctgggattacaggagcacaccaccacgcctggttaattttggtatttttagtagagacgggattttgccatgttgcccaggctggtctcaaactcctgacctcaagtggtccacccacctcggattcccaaaatgctgggattacaggcatgaaccaccgcacctggctgccatcacagtcttgatagaacttacacataacgtactctttctcaccccaatccctgcatctctctatccctctaatgcataaacttctgtcttggcagtgctaccaggatatctctgggcaaacaatcagtggatttctgctgcttcccataagaaatttgtatgaggatcaaattgatgatcctcccattaacaacacttaacaaccaacagcaccatgttgccaagaatggtgaaatatacaataacaaatattcatagaagttcagcaattaaagagatcatgttagatacatatagacatactctgattttctactttatttgagtgatgggacatctttccctcaatttaaacactctgtaatggaaatcgaaaatacgaactatctcccacagctttgtggctaagaatcctgttaccctaataagttaaacagcagaagttcattctctattactggacccggtacaaaatgaggttttctagggctggttccatatgcatataatgctagaagagctactataaaatagctatgttcttgtaactaatcaagggttatttagggaaatataccaggataatttgaaaactgttgctggacttacctgctccaactgtacaacttacacatacaaccaagtgttcaaaagcaaaattaatgttcacaagcaaaattaacagaatcttcctacaatctcatctaaaaaagttatctcatgagatatacatttgacagcaaaactcccaatcttctttttttttttctttttcttttttgagatggagtttcactcttgtcacccatgctggagttcaatggcacaatcttggccctctgcaacctgcaaccttcgccttccaggttgaagcgattctcctgtctcagcctccccagtagctgggcttccaagtacctgccaccacacccggctaattttgtatttttagtagggacagggtttcactgtgttggccaggctggtttcaaactcctgacctcaggtgatccgcctgcctcggcctcccaaagtgctgggattacaggcgtgagccaccacacccggccatgaatcaaccagtcttcttgatgtagtatcagaaatacttagatgtagctttaaaggtctatatgaaaataggattactgtacttatctcgggaaacttctccaaaatatttaaactaatttaaaataaaagaatgtaactgttcgaaagaaataagaatcgaagcaccaaaacgatgctacatatggctccaaaaaacaaaagcaaaagccatagttccaacttttaagaacttttccataagaagcaatgtatatccataaagctaatatcttcacttttctcagatatggtaaagtatctagtgactataccacggaaatgtaaatatggaaaatgcatttactgagcttcatacaataccctgctccactgaacaagaaaatgatggtgatgcaacactgtggtgaccagaggacccacaaggatttctaaagaaatccccacaacaagccaccccaacatgcttctgtttcattggtattttatttacttatttgtgttgggacagagtctcactctgttacccaggctggagtgcagtggcatgatctcggctcactgcaacctctacctcccaggttcaagtgatgctcctgcctcagactcctgggtagctgggattacaggcacgcaccaccacgcccggtgaatttttgtatttttagtagacagggtttcgccacgttggccaggctggtctcaaactcccgacctcaggtgatccgcctgcttcagccttccaaagtgctgggattacaggtgtgagccaccgcgccaggccagttttgttgatattttaaatttttcatgaaggcacaaagtccccttatgagaatctggaagaatctgggaactgcttagttaatgagcagtattaagcatgtctatgaaattaatgtacacacctttgccagcttcaaagatctgttggaaggcaccagtggaacggttgccaaggcaacctaaactggtgggggaaagattctgtgtgtcttgggtgtttccaggtctgtctttatctatagatatgcatttacagtttttgtttttgttttttttgtttttttgtctagggcttagggctgggacaagagcaaaattacatacctgttttgaaaaagcagctttaagatgacgatgatgatgatgacttttagcaagtcattactctctctgggaagagaccagttagaaagtgctacgtgggagccagtagtgaagaaactgactcattaattattttagaattaaaaaaaaatgggccgggtgcggtggctcatgcctctaatcccagcactttgggaggcgaggtgggcggatcatgaggtcaggagattgagaccatcctggctaacacgatgaaaccctgtctctcctaaaaatacagaaaattagacgggcgtggtggtgggtgcctgtagtcccagctacttgggaggctgaggcaggagaatggtgtgaacccgggaggcagagcttgcagtgaaccgagctagcctgggcaacagagtgagactccatctcaaacaaacaaacaaacaaacaaacaaaaaagggcaaaaaggcaagctgaaggggcttgctggaaaactatggatggcctaagtgtgtgaagctctctgacacttgaagtattacaaaacaagacaaaggtccctggagcagctgaagtttagtcagtgcggtgcttaaatcatatacatatgggcttatcttttccaagaaagatattcaacaagctacagtgaagctattattaaagttttcttttctgtttcagatgaagctgaaatattttagggcactttagcatttacattacaaatattcctcctgaggagtgggcacagaatgcacatttcacgaccacatggtctggggctggtttctaggctcctcacttaaccagtcacgtggtcttggccaagttcacagcctccttgacctgtcatttctgtgtccagaaaatatggataccaacttcttgaaaacactgtaagattggtgggtggactgcctggtgactttgtgaggtgcctgctagcaacaaaagtattcctgatctttccccacctgcaagcattccactaactttatttggtgaaacaaaatctccaaagcaccctttccccctaaaagcttctcagttaagaaccccctcccaccccccaaaaaaaataaacaaaaaaaaaactagaaaaagatagtatgctattcagagtgccgggctttggactgacaacctagagttgatggtcatctttgccctttctggcttactgctctgaagcagagttttctcatctgtaagaaatggggtagtggccctgcccataataatctcatggagctctagtgagatctcaagggtacagtgcttcccacacactgcagctgtgcacagtgagagcttaatcactgctagccatttttataattagccgattgtttcccaacatttgactcttgaatgaggatcacgaagcgtctacagaaagtttacaaaagacctcctgagaaagttcacggaaggagctgaccatgcctggctatggttcttggaagattccttttttctctctctcatacccactgtggaaaattcccaaggacatggagagctggaggaacagcagaagccattggcaagacaattctccatgggtctcttaagtacttctgcacatattgtgggcaagatactgactgtgctgtctgttctgagctatctctttaaggatgtttctgtttttgagagacagtctggctctatcgcccaggctggagggcagtggcgcgatctcggctcactacaacctctgtcttctgggttcaagcaattttcgagcctcagcctctcgagtagctgggattacaggcacacgccaacatgcccacacgcccagctatatatatatatatatattttttttttttgtatttttagtagagacagagtttcaccacgttggccagcctggtcttgaactcctgacctcaggtaatccacccgccttggcctcccaaagtgctgggattacaggcatgagccaccttgccgggccctcttcaaggatgtttctttagtgaatagctatgcaagacagagaagtgtctccctctagagcaaagagcaggcatgcttggtgcctctcggaaaagataagggtccctgaagctcagggtttctctcctataaagtaagctgttgcatgtgcaggtatcctctggccctctttgcattgccctgtgggaaatggggttcagggaactggagcaagaatgcagacactctggctactactgctgctctgagtaataaacatcccttatctctgaccgggaagtatcgtgtctccaccaacttctatcaaaccatgccaggctggctcattagcttccaagctcaacagaatcttagacctttttcatagttcttaggtcactaaagaacccaaggaactatatgcattatgaagacatttaggcaggaaaggagtggactacggtcctagagaagaaataggggagtcagagataaagaagacataagacagtcccaatttttgggtaatgtcttttggtttaatgaagtgggttttcaaattcttaaatcaccctttgctggggatggccaagattgcccttttcccttagtaaattctaactattcctgctctttacaccacacttagacccccacctgccagccactctgctccattagtttaacatgttgttcttggccaggtgcggtggctcatgcctgtaatccctgcactttgggaggccaacgtgggtggatcacctgaggtcaggggtttgagaccagcctggtcaacatggtgaaacccgtctctactaaaaatacaaaacaattagctgggtgtggtggcaggcgcctgtaatcccatctacttgggatgctgaggcagcagaattgcttgaacacaggaggcggaggtcgcagtgcgccgaaattgcgccactgcactgcagcctgggcaacaagagcgaaactccatctcaaaaaaaacaaaacaaaacaaaacaaaaaaacccaaaaccaaaaaaaaaaaaaaaaaaccaaaagaaaccccatgtcattctagactgtgccacatgggtccagcctttcaagaagcagaatctgaaggttttcctctccaagcattagtgagtgttttgtttgtttttatagcactgatcatcttagttcccttttaaacctgaagggttgcaaagccacatttaggtcatcacaagcagtaacccaaggagcagaattaaagtgatatgctaattaggttgccagttgccactcatttaacattcaaaaatgtgcatgtgtttagtgaaatactatttctgctttctacatttgactgaataaattctgtattaatggaacagcatggtaaactatgctgacgcctacaagtcatgaaaccttaaaatgtcttgattaaggccgggcgcggtggctcacacctataatcccagcactttgggaggccgaggtaggcggattacctgaggtcaggagtttgagacaagcctggccaatatggtgaaaccccgtctctactaaaaatacaaaaattagccaggcttggtggcgggtacctgtaatcccagctacttcggaggctgaggcaagagaatcgattgaatccaggaggcggaggttgcagtgagccaagatcgtgccactgcactccagcctgggcgacaaaagcaaagctccatctcaaaaaaaaagtcctgatttacctcaatatttatgaaatttatgaaatatttttataatttatagtttttataattatttttaaaatttataggagttttctaagaactttaaaatcacacacgattgaaatttcctgcttcatctatgggggaataaataactactttgaacagcgcagcaccgttcctggtgatttttttccgtagtgaacatcagcatacggtattttccacacagtttaagtttctagaatggttcttagttcgtgtcaaatggaggaaactttcatcttttaatctttatagctcatgtcctggcagcaatgtcaatacagggggcttgacttccctctctcgcctggagaaataagagttccagccaccccttcactgccatctcaattcataatgctacaacagacaatgggaagttgttttttcaagtagcagaacagaggctccgccattattttgtcttacatttacaagttgatgctattttaaattatccttcacattggtgttcctaaatgtcacctgcccaatgggtcacagacgtatatactgtaccaaataatcacttggctcagaccaagaactgaagttaggagagttgcaggatcagtgacgacgtgcccaagaacacccatcagttaaaggagttaggaatacaagcgtgggcagaaaagttcacgtatgaaagagattaagtcaagtcctaggatggcccattgctgacctgccctccttgtgcgggagccacatggagaaagtgtcgtttgtgccacaggcatgcagggacaggacgatttcccggggctgatggtgcatcttcccaatggaacaaacccaaagagactggcaatggagaaaaagttgcagaaagtgtcagaagcttcctccccaaaggatgaaacaatgggcttttggatgtgctataatcctcaacccttcattctgcagatgaggaacttgaggttttcattcaaggttatgtagctactcataactgagaagggaccgtcatggtgagtaggtatattaattgtgtctttgtgttctctaattttgatgctttgacatcttggagctttgctgggcatgtagggactgcccctcccagcaattactcctggagatcataaactactgctcggtgagcatgactttcacctgcagcctgtcaatccagagcccactccccagccacatcccctaggggctcttatattccaggccacccttccctgccctgatgacgccagggccaggtaccagtcaactggggtgagctcctctgccccagaacccatcaaaattagtcaaattagccaaccctaaacctgctgcggccgcataccctgccttgtccattccttcctgaaaaaacctcaataaagggtcctgcccacattttctcctgctccctcagcctcctggctggccctggtgtttctctgtgtggccctgcctgttatggtgtagccctcctcttgggaactgtgagcaactcttcttttcttttaacttccctccctctctccctctctctctgtctttttctctcttcagagtctcgctctgttgcccaggctagagtgcactggcgcaatcttggctcactgcaacctctgccttccaggttcaagcaattctcctgcctcagcctcccaagtagctgggattccaggcatgcgccaccacgtctggctaatttttgtatttaacagagatggagtttcccatgttggtcatgctggtctcaaactcctgacctcaagtgatacgcctgcctcagcctccttccaaagtgctgggattacaggcatgagccacagcacccggccaagtaactatcttccctgtagctgcccatcctctactggtctgttggcctcaccacacctgaataataataaaacttataatttaaaatagtagatgactcaaggttttcccggtgaagatacgccatgaacaaggtactggtgcagaactagttttatttatacttgctgcaaggaagatctttgtaacagtttaggctgcatgaataaacagtaaattctagatcacagaaaatattaatctggagagaggaaatgtctggttaggtaagcacaataaaagactcagtatcagacctgatgaacctctcacgtcaccttcccgactctataatgtctataaaagaactgaatggagggctgggtgccatggctcatgcctataatcccagtaactcaggaggctgaggtgggaggattgcttgaggccaggagttcaagaccagcctgggtgagacccatctttacataaaattaaaagcttagcctggtgtggtgtgcatgcctgtagtcccagttactcagggggcttaggtgggaaaatggcttgaggtcaggagtttgaggctgcagtgagaagtgatcataccactgtactccagcctgggtgacagagtgagatctggctaaaaaaaaaaaaaaaaaaaaaaaagatcagaagagtgaatgaaaaatttcagactttggacagcaaaaaatcactgaagatttttgagcagggaagtggttaattgtacatccaatatgcaaattggactgccacagaaggacactgtggggtgaacccatggtgaaagtccagccctaaaatcggagaaaggcttgctggtgcctatgtgcctgtgcacgaacacggggacagacataggaggaagactaacgccaaacttcagatcctctctcaacacaggcgaggagggtggcctggacagagctcttagtggaactgctctcaaaatatcatcagaacggggtctgacagcatggacaagatcatgcaaaggaatcgcacaaatagagcatgatccatggataacatgataaatgtatcacgggcatgggtctcgtgtgcaactcgaccgtatgtttcttgctggggcaagcccctatcttcacattcagatgtgcatttacctgaataatgtgattgagaagattttaagttacagatttcaattcaggtgtttcactgaggctatgacaggtaaactgtttggggttcttctttgaaaaagtcaaattaaaatatttaaattgtgcagaggaaaaaatgcttacatcattgtcatcaatatcaatgtaatttatttaacccttttaggattagccattctttttttttttttgagagacagtcttgctctgtcacccaggctgtagtgcagtggcacaatcttgactcactgccacctctgcctcctgggttcaagcgattctcctgactcagtctctcgagtagctgggactacaggcatgccccaccatgcctggctaattttgtgtatttttagtatagacggggtttcaccatgttggccaggctggtctcaaactgctgacctcaggtgatccacccgcctcagcctcccaaagtgctgggattataggcgtgagccactgagcctggcatagccattctttttcaatggactgtcacgaccatcagatttaaggtgaagaatctcaaggatgaccacccaaaaatataaatgagggcagtgactgaaagccacatcttaagtacaactatctgcagccagagaagcagcagttccatccagaatccttttcttctactcaattaggtcctatccaccttctcaccggaactaagtccagctgacatccatcatgactaacactcctgccagaccaagcctcctagagcacggctttccatcacgccatgtgcccttcaaaaacactcagtgattctgaagacacggaaccctctccagggctttcggtcactgcagttcacaggtgcggatatccacttacatccagggtactgtggaaaggctctctgttgggtgaccttatttcctgcttctatgtgctgacccaggagcatgaggatgacaccatcagcccacccgcaagagggcacataccttgatttgtttttcagaaagttggaatctgcacaaaccctgcaaattcccatttgcttgcagggtgcaaatgcatgtcatatacacaggccatatgggggctgaacctgcaaccctgacacgacacagacgtgattctaacaggctgagctaacaggccatacacaggatcaaatagtgaagattccatcttaaagtagaaagcgacttgaggccgggtgcagtggctcacacctgtaatcactgcattttggaaggttgaggcgggtggatcacctgaggtcaggagttcgagaccagcctggccaacatggtgaaacatcgtctctactaaaaacacagcaaattagccaggcatggtggcaggcttctgtaatcccaactactcaggaggctgaggcaggagaatcgcttgtattcgggaggcagaggttgcagtgagccgagattgcaccactgcactccagcctgggcaacaagagtgaaactccatttcaaaaaaaaaaaaaaaaaaaaaaaatgcgacttgaagaagatctcaaaacagttctaccaccacaaaaccatgggtatattcttccaatactgtgatgtttccttcctaatcaaccaaccaataagtcttatttaggagcacagaggcaatgtgggggaattaatgcctttttttttttttgagacagcattttgttctgttgcccaggctgcagtgcagtggctacagctcactgcagcctcgaatccttgggctcaagcgatcctcctacctcagcctcccaggtaactgggaccaaaggcacatgccaccatactgggctcattttttattttttaatttttttgtagagatgaggtctagctatgttgcccatgctggtcttaacctcctggcctcaagtaatccacctcggcctctcaaagtgttgggattacaggcatgagctaccaggcccagaaaaattttactttcattaggaagtgttaaacaatgttgtcactctcatgctgtccacactaacatttgtctttcaaaatcagtggttgtcaggcacacaatctaactgcaacacattatactctacttgcaagtatacaatcagagtacataggatttacttaggaagggcatatactctcatgtcagaaagcaaagcaaaattgctacctcattgtgaaaattaataaatgctagggggaggttataaaaggaaatcttgtaaatagacaaacatctgctaacactgagttttcaaaagcagaaagtttttaaagataccgaacagctcggacatcttatcttgacaaactctattttatttctattattttttgagatggagtcttgctccattgcccaggctggagtgcagtggcacgattttggcttactgaaacctccgcctaccgggttcaaacaattctcctgcctcagcctcccgagtgcagattgcgccattgcactccagcctgggcaacaagggcaaaactctgtctcaaaaaacaaacaaacaaacaaacaaacaaaccccaaaaaacaggttttccactccaagcattagtgggtattttgtttgtttttacagcactgaccattttagttcctttttaaacctgaagggttgcaaagccacattaaggtcatcacaagcagtaatcaaggagcagacatcacacccaactaatttttgcatttttagtagagatggggtttcaccatgttggccaggctggtctcgaactcctgacctcaagtgatccacccgcctcagcctcccagtatgctgggattacagacgtgagccactgcagccggctgacaaagcctattttaatcagtatttccataaattgttatttttacaacttaaaaaaaccaaataaaatcttagcatgaacaactattccttattgcaaacctggtcctactttgtattttgaatattcagctttcttgctcatttcttactatgtaatctgtaagcaataaattaatggatgtacataacataaacatgaacttaaatgtaatacaaattaggaacaagcagaaaccaaatttaacttactactatttttgagacagggccttgttctgttgcccaggctggagtgcaggggcacgatcatggctcacgcagcctcggcctcccaggctcaagcgattctcccacctcagcctcccgagtagctgggactataggcacacaccaccatgtctggttgttatttttatttttcgtagagatggggtctcactatgttgcccaggctggtcttgaactcctggtctcacgcaatcctcccgccttggcgtcccagtgttgggattacaagcgtaagccactgtgcctgggcaagtttatcttatttttctaatgcacatatttactgaaataaccaatgagctgaacactggctcacaactcatgatttaaaagctatgtaaagcaaaccacagcattcaaagtcttggccgacaattgcccatatttaaaatgaaatactcaatagcatgtgaacttgaatctacaaacaaaacaaagtatttggaggggaagaagctaatcccacctaacttctaaagactttcctcaggacttgcaggaaatctgcattttctatgccttcttttctccaatgtgaaaaacaaatgaattaaaattgcaggtaatatttacctgtgctgctaatatttaaacacagcaaactttcagtgatcattaaattatttttgcttagtgactgggtaaatgttcagttaggaggaaagaacacaaaagatatgtttaatttctaacctctaatctctaacgtttgtagtctctggtatttttgttgagcaacaaatacaagttgtctttgggtgtaggacgcactagcctaaaactaaaaaagttgggcttaagaatccgatgatacttgatagtcaaattttctttctggccttcaaaaaccaaatatataaaagaatggccagtttccagtttctgttgcaatgcctgtgtgggggcaggtgcagactgggggaaagtgtttggtgagcaggaatttggtgggtaagaggaacgaaaaattttttaaaatccctaaacagcatcttttttatgtatgggataatctagtttccaataaatcatcacacggtttctcttatttgatcttaatgttgtgacacaggttagagcaggtaatacccttgggttgttgtaaaggaaagggtgacctaagaaggttaaacatgtcctacaaatggcagagctgagatgcaaactggtctggtcttgtgacccactgccttgaatgcagagtaccgtgaccaacctggcccctctcccacagcctaacctgttctgcaacccaataccaaatgttctctccaactgacccgtctttaaaacgaaaactccttctagtataaagacccattggggctgggcatggtggctcacacttgtaatctcagcactttgcgaggccaaggcaggaggatcacttgaggtctggagttcgagaccagcctggccaacatggtgaaaccccgtctactacaaatacaaaaaaattagccaggcgtggtggcgcgtgcctgtagtcccagctactcaggggttgaggcaggagaaccgtttgaaccaggaaggcagaagtcgcagtgcatgacagagcgagactctgtcttaaaaaaaaaaaagacccattgggtttaagcctgaagcctccagagggtctccttccctttccatctctctgtacctggaaggcagctctgtggcaggatggaccccaagcacgtgggtcttggagcagggctgggaagacagagccctccaggaggggctgagtccaggccagcatgagatacaggggacctagggctgctggaaggatgggctgctggggcgtatctctgttccaagccttatccctgctcttcatgcagttacagcctgataggcccacccacaggctactgccccctgttcctcaaacaatacacatttacagttgttgcctttaaaaagaaaaaacaggccacttattttacactcagggtctaagcatttctgtttgcagagactgggcaggcttctgtatctttacaagcacatgctttctgcagcatgggtatattctcaatgtatttgttgcaggattgtctatttttgcatttgacatttcaatgacttagagggggaggaagaagattggagaaaaaaattaagcctatattcccttttagttatttttgacccacttgctgcaaaaatagggaatggcactggaaggctccactctgtaggaagtaaccttcgccttccctgggtaaatgcttttgtttcctccttcaaacagattgcattgctctcctggcattaaaaatgagaaataaatttagcttcatctccatatatcctgggattccccttaaataagctctaaagcattcttctgggtggcttagtatgaaatgcagtccctggtttcttcccgccccacagccccctagtaagccgccccaccccacctgggaggcatagagtaggaggtgattgctctcaagataaagaaggcggcatcacgttttccccctggaagaacagaagcacctgaggtccaggagagtaaaggagaattctcctctgcctagccttttctgtgcatgtgacagggtattttctctcattcacagtcaatatggctttgataacagctccaagaaaaatgatgcctagacagtgctagtccaaggtgccagtgaaactgaaggcctcatcctacatgtgaatgttcctcacgtacattacgtgattatttactgttacagtgaggtatgtgagatcagccccatttttaaagacaaggaagctgactcggagaaggtgagtgacctgcccagggcacacagctgccacccagcagagctgagattcaagcgtgcatcttctaaatctcgtgcacttcctattataccaaagctgcctcccattcaagttccaggcatggccttttgaatcggaccagatcgggtcatcgaaagagaggatcaaaagccccctgcttataaaagtgagcttgaaagaagaataggaaagaaaatatgcttcataaacaaagcagcaaggttagaaatggagagacgctcactccaactgtcactctaagtctaaagccctgttgcttactcgctgctgaactccaaaaggagtctgctgctatggtggggagctttcgaatatttttaaagcctctgaaccctttaaagataaaatgctatgctgacactaagtaaaattagagcttgctctggttaaagccagtggggcaacactgggggtatgcacgagtctcggggggctccaccttctcagggaccctctcctgtccctccatacccccagggctgtgcagctcagattgtggctcacagaggtgcccggctgcaaactgaactgtttgttactctttttaaaaatctgtcaccggaatgtaaatcaactactggaatgagttcagcactgtgtgtttttttttttttttttttttttttttttttttttttttttgagacgatattttgctcttgttgcccaggctggagtgcagtggtgcaatctcggctcactgcaaactccgcctccgaggtctaagcgattctcctgcctcagcctcctgagtagctgggattacaggcccaccaccacgcccggttaatttttgtatttttagtagagatgggtttcacaatgttggcctggctggtctcgaactcctgacctcaggtgatccaccctcctcggcctcccaaagtgctgggattacaggggtgagccaccgtgcccggccttgcacttttttattctctacttttgagcgagatgttcttgatgaagcaagcagacccctgatttccattctggcctgggctctgcatctccctgtgtgccaggaacaaagcactggcccagaaaccagctccagagacacgtagagtcccagggcactggatgggagcacggttcctcctccgtggaaacacactgggaattcctactctgacccactgctttgcagcagtaaacctcctgttccaggacccagcagcctcaggaggaaaaactccagcactggtggctgaaatgctttcagggtttgccactcactttccagccctgggcagccagcccattccatgcctgtgtggttctggatattagaaaatcctttctttccttgagctaaaattttccctcttggaacttctctgtcctcgtggtcttaactctggcaccaagggtccaagattaacacttaatcttcctcctaaagaaccagcctagaaagaaattgaagatgaaaatatataaaccgtggactgcctttaaagagatactgtaacaagtcagctttcttacaataaaggaactgaccacttagaaaatgcaggagagttctgagtaccggtaggtttgtaactcgtgagtttttgcagatttccaagtctttcataagaaatcacatccaaacgccaaggaaaatgaaggtgcatacataaacatcccgagggtgaaggaaaacagcttcccacggtgaataatgccattcacggttcacattgtcatccttaatttggaagaaataaaatatgtttaatggaaactgctttaaggtttgcaagagtgtgtgatcagagaaaagcaagcctccaccttccccaaccgagggttgatctgtttcctgccaggacagaagagaactttgtgtgaatccacacgctctgtacaaggcagaatcactccccacttcctcgatctgcatagtgcaaggcaacgacgggatctggcctctcctcctgttatctttcctgaagccttttctgtgtcgctggcagatatttcctgttgacactgtgcctccccaatcagtttccactgccagaaccccataatgtgaagcgtgacacgccaagcgtctggtcatgcggtatctggtaggataaaccgtcaccctacaactggggaaggatttcaaaacaggaggcacgtcgtgtgttattataacaaagggctgaatgcacatcaccattgccactgagatcttaacattcctagcaaaaaagaaaaaaaaaagaaagaaatctccatgtggcatgttttagagctcttatttaagtggactgaccaaatatccaattctcaaacacagtagaccccaggcacttgcagagtttaactttggctgttttatctatttctatgtctttttgaggctggccatacggggaagactgtcatttgcctagggtgtgaatcaagtccattgtataaggaacatgggttaccgggtccatctggccaactgtccaatacccctggcttgacctaaaattgggaccgaggtgttctcgttgaagcaatcagacctgatttccattttggcctgggctctgcatttccctgtgtgacaggaacaaataatggaatgctgcagttttctgcatcctattatttcgggggaaagagttcaagggccccagcactcttctgctttgctggtgcagatcaaggcatttcatcccaactccaaagacgccaaccacgaaatggcacaggttcctggcgtgcccaggtgggaagttggggagtatccgctgccacattcctgtcacttctcacgagcccaggaatgacttccaagccagcacccctgccacctcggcctggcctgcagccgcggggaggaggctggttggcgctgtctgggccctgtctctccggttcctccgggatgggtggctgagtttcagctgagcctagcctttcctcatatcagaatggtacgatctcagactccagtttggaattcgagaagaggtcaccctcaggcctttttattattttttaaaaccaacctggttgaggtataatttagatataataaagtccatccattttaatgaagtgtacagtttaatgaagttggacacacgtatacacctgtgtaattcctaccacaatgaggacagacagacaacatttccgcctgtccttggatccatctaatataggaaggcagagagtggttccactctggagccaagctgctctgtcatgtcctggctgtgatgggcgcaagctgtctcatcttcctttgtctcggtttctcccatctgcaaaacgggtcaagtattaacatcgaaaacaccgtactttgagtgttagttgtgtggtttgatatgtgtagaacattcacatctgtgcaggcccgtggctagcctttcacggtgtgggctttgttatcatcactattattatgagaaatggctaagcttccttctcaatgacaatgtctctactgcagagcgtgcctgtgacagcaccctggagaaatcaccttttaataccacattatccccttattctaacagacttagcacttgtatctgggcaaatatttgttcacaaaggtctcagcaaatctcttcaacccaaagaatttactctattctcactaatcgagatcacagagaccttgatcatgctagaaagccatcgccttacctccctgggattcacctggtgtccccccaactccctagtcccaagctcaggccttaagaagctctgatgtcctttttattggagacaaggagcggctggagaggtgtttgatttttacctctttccccttgccctcgccccctgactatcaatataaggtagaaaatacagaaaaaatataaagaaacagaaagaaaaatataatcccacatacacaaccccagctcccagaagccactaaacctaacatcttagtatatttcccccaggtgtgtttttttctgcaatttttctttacacagcaggaaggttatgttacatgtacatttttacagttttaacttcactttagcacataattattttccttcgtcactaaacctcacgttacggataacttaccctttcatcttacagataggtcatataattattccttattttgaactcacaggttgtttctaggttttcattactctaagtttacaacaagcacccttgtgcacgatggtttatcttatttgaatgactgggatttctgggtttgctgagcagctgtattttctgtttagagtgtcaggctgcctctggaatgcttgagaagcaccaggggtggtgccccaggagggcagcgcgtggcctccttccctcaccaggccattcctgctgcgtgtgtttgttctggggcgtcccgcaaggtaaagtcaacaactgtcaggtgacgggcttcgtgagaccctgcttgtaggagagcattcctcggggtgagtccatgtgtctggctaccctggttctaagaaaccattccagtctgcaggctccagaccttccaagatgctgacttagtgatgatagaatggacaggacacctccaaccaataacttttgtgcttgcctttcaataagcagggaagcccaggtggaatcccagaaagcagctgtttctgatctcaaaggtgagatgccaggttcttacctgactggcagaaatccaaacgttggataatttactgtgttggcataactatggcaaaacaggcattcaacgttcactcccggtaggaatacaagtgtgaatggcccctccgcagggatatctggcaacaaccatcaccaaagtctccaacgcacatgtgctttgacaagcagttttactttaaaagatttattccaagacagactcacgcattctccagcacaatgtaaaagagaagacagttctgcccatctgcagccccacagtgggtccgggtgatgcaaggactgaagagttcaccagcactggagctgcccctgctctgtctagcaggagagctcccagacagatctcctctgggagaaaaaaaaaaaaaatcacaaggtggcaacagttgtataggaaaaaaatataggcctttcccagtcacggaaacaggacacagggaggggccaccagacaaagaaaagagatgcagaaagaaaggcgtatgttgggagtgggatgtgcagacactgaggaaaggcaaggccaggaagtcatgacgggagagagacaggggtcgcattcagctttagaaacttgaatgccacagataagggctgggtttatcctgcaggccaggggtcactaacacgaagcataaaactacttataaacagtgctatctaaaaatgaagtctggttgcgctcatattttattttttttaattttaattttatttattcaagatggagacttgctctgttgcccagactggagtgtagtggtacgatctcagcttctacgacctccacttcccaggttcaagcgactctcctgcctcagcctccctactagctgggattacaggcatgcgccaccacgcctggctaatttttgtatgtttagtagagacgtggtttcaccatattggccaggctggtctcaaactcctgaccttgtgatctgcctgcctcagcctcccaaaatgctgggattacaggcgtgagccaccatgcccagcctgcactgatattttatacagatacatctggcatcatgtaattcataaatatatacccactagggtccatgctcaattttatttattattatttattcaggcactaatttactttttgagacagggtcttgctctgttgcccaggctggagtgcagtggcacgatcatggcttactgcagcctccatctcctgggctcaaccaattctcctgcctcagcctcctgagtagctgggactacaggcatgtgctaccacacctggctaatttttaaaacattcttttgcagagatggggtctcactatgttgcccaggttggtcttgaactcttgggctcaagtgatcctcccgcctggcttcccaaagtgctaggattacaggggtgacccatagcacctggcctcacactcagttttatcactagaggtatgcaatcacaaaattctggagacacatggtcttggcaataaagagagctgaaatgtgaccagcaggagaggggtgtgatgagatacggtgtaaggaagaatagcaggagccggaaatttttcaggagccagagattcttcctcaattcccagagccagtgaatccggagaaagagattcgggaatcctcccaggtggagctgaagttctgcttggtccttcccggaagggaaaagctactgagctcagtgatcagtcccagtgctgcaccaagaaggggtcacgaagctggttacttatctgcgtgcggtaagtctatacagaaaaaggcaatcaactttggcctcttgcagagaaatgcatttgccttcctccaagtagtctgtgtcctctaagatgctcccttttggatcccgggtgacagaaatcttgggccaaatcccctaccaaatgccggagctggttcccatcagtacgtaggtcagttgtttttaagagttggaggtgtgtgtcatctcatgctttctctgttagagtgtgtttaattctatttcctccctttcaagtgtgtttaatattttaattctcatcccctccctttaagaccttataggagtctagatgtggggctgtcaatggagcacagcaccctagcctggatactggagatggggagaccctcactattttgggatcatacctgtgcctctctcactacagcagaagatgaggcagttccatgctgttactggcaaaggtgtgacatcctgatccttagagtcacaagagggaaactcaggcctgctcatagttccaagagggtttataaacacttgagaggggaccaaaggaggagaagaacatcaagaagaccacaaagtcaccagtgtgacatccactgccttccatactttggtctacaggaggccatcaatgtgctcagagaataaccaggaatgttgagttgcaggtgacacgtctggagggataaaggctgactccacagggtggaaaggagacatggcacatatgtccatttctacagcatgcctgtggaggtgacggtctttcaactgactcatgggatgtctacctctttttccatcagttgttcattccagcagaaaagtccacgttcaccagagaagaaaaatgatacgtctccttcccctcccccaattactaagtgcccaggtgggagctaagctatgaggacacaaaggcataaaaaagatacaatggactttggggactcagagggaaggatgggatgggggtgagggataaaagaaagaacaatagtccagggattttttttatttttattttttgacatggagtctcaccctattgtgcaggctggagtgcagtggcacgatcttggctcactgcaacctccacatcccaggttcaagtgattctcatgtctcaacctcctgagtagctagaattataggcatgcacaaccacagccagctaatttttgtctattttgtagagacggggtttcaccatgttggccaggctggtctcgaactcctgacctcaggtggtctgcccaccttggcctcccaaagtgctgggattacaggcatgagccaccccgcctggtctgtccagggattttgaacctagaccttctcaaaagtcgggtggaggtagaggaaccaacaaaaacagacataatcccttcatccaagaactcaaggaagggacagaacccatataaaaggttttgtaaaactctcctccatctgtaactcttttaatgagaacatcaggtaaaaacatttatctataatataaaatattcaaaaattagattgactttttaaacttttatttctttccaattgttattttagcttcaggggtttgtgacatgagtaaactgcatgttacatgagtaaactgcatgtcctgagaatttagtatgcaggttattttgtcacccaggtaatgaacatagtccccaagaggtagtatttctatcctcaccctcctcccaccctccactctcaagtaggccccggtgtctcttcccttctttgtgtccatgtatactcagtgtttagctcccacttataagtgagaacgtggtattcagtttcctgttcctgcattaattcacttaggataatggcctccagttgatccatgttgctgcaaagcacatgatttcattctttttaacggctgcatagtattccatggcatatatgtaccacactgtcttcttccagtccaccatttgatgggcttctaggttgatttcacatttttgctattgtgaatagtgctgcgataaacatatgcgtacatgtctctttatggcagaacgatttatattcctttaggtataaatgtaatgggattgccaggtcgaatggcagttctgttttaagttctttgagaaatttccaaattgctttccaatagtggctgaactaacttacattcccaccagcagtgtataagtgttcctttttctccacaacctcaccagcatgttattttttgactttttaataatagccattctgactggtatgagatggtatctcattgtggttttgatctgcatttctctaatgataagcattttcttcctgtttgttggccatgtgtatgtcttcttttgagaagtgagattggccattttagaccacacagtaagtttgcacataataactttcatctaattctaacttaacaatcgtactaacattgtgtagtagaaagactgaaaaattatcaatgaaaagtatgaaaggttttaagcaatgcagacaactttcactctgtctaacacaaattctgcctgggtactgtaactgaagagagtttaatggggatgtaacacgggtgaatgctgtgttgaccttggcattcaaagccaggatcactgtcaagtttatgttggcttatttgacatctggtcatttggggcctgattgaagagagccacctagaagaatatccttatatgttcaagtttgctactggggaaaggtagtcaagataatacggcatatgttttttggaatattcaaagcacaaatactagatgctttaaataagagagaagatggtgcatatgaattccctgcaggagaatttctgtttaggtaagcgcaagttaactggaaagtccagtagaccctgggccttgatttcctgaaagtgaaccccaatttatgttcaggggtcttgagaaacaagctgtgttctcgtgtgggctgtctgccctctcccattcctagaaggatacctctctgaaatacttacaaacacttaacaatgagaagtccacagtgtcaaaacacttcatgtctcagaagccacaaaacagattttttaaaagcttttttttacaactaaaactatgccctggtttcacagtcaaatagtggatttccaattttgtaacactttcactaaaataaaaacttttttggcaaacaccaaccacaaagaaaaaccaaaagacaaactttgagtttttctgagtctagaattttgatatatgcaaatactggcattcctggtcagaagcctgaaccctttaatgaaaacagaaaagaaagctgaggcttccaaaccaaaatggtttgagcattaagtcaaaaagaaagactgtgttgcctgtatttcatatcattacaagctcataaaactagccagtctcagccgctctgtaagataaaatgcttaagatagaaattcacctaatagtggtttccaactctttagttaagcaaggaacacacacagcactggtttttatcttataatatttgtcatgtagttgagaaacaaatagtagatactgttgctgactttgagccaagacagccacatatgattatgtgccatggtgctacattctgcaggaaataaaattctaatggttctaattcctttcacatgaacttgctcactgtgtctccatgctctggtggtaacctcaggcccgatacaagcatgggttattatatcttttaaaccctttgcagagattagaaggctgcagaaaaataccattgggggttgaaaacagctttctgaaattgttctaaatggacaaataatgcgttgctttctttgacagctgttcaataactgaatacagctggaggggccgtcggctgccaagggatttctacttggttcatgaccaggttttcttttccagaatgctttccaacactcgaactagtcttatttatgttaagtgtatttttaaaagaggaatttattttaattattttccatcctgctccatccatgttacataaaatagtctgcagatttaaaggaattgtcttaagggttagcatttccctcacctgaactgtagcagcagctaggtggagttagggctgattatctctaaggtacccccaaaaggacactgcatgcattcagctgcactgatctccagctggtactatcagtcattgttcccaaacccatttaatagtaactgttcatgtttcaagccgacagcccgaaggaagacagggttcttccagacatagcaaggaagctgtccaccaagtagccctccagagtggggtcattttggtaaattcacctcagtgtttggggtctggtccttagccctgatggagatcttgcccccagaatggacttatcttcatcaggcatcagagactgatcgatgcaaacaaatgaccaaggtcttcatttgcaataaaaagtacaccttttttttggctgggggcagtgactcatgtctgtaatcccagcactttgggaggcccaggtgggtggatcccttgaggccaggagttcgagaccagcctggccaacatggcgaaaccctgtctctactaaatatacaaaaattagacgggcgtggtggtgcacgcctataatcccagctactagggaggctgaggcatgagaattgcttgaatttgggaaggggaggttgtggtgggctgacatcacaccgctgcactccagtctgggcaacagagcaagactgtctcaaaaaaaaaaaaaaaaattaaaacttaaattacagggccgggtgtggtggctcatgcctgtaatcccagcactttgggaggttgaggcaggtggatcagtaggtcaggagttcgagaccagcctggccagcatggtgaaaccccgcctctactaaaaatacaaaaattagcttggtgtggtggcacgcatctgtaatcccagctacttgggaagctgagacaggagaattgcttgaacccgggaggcaggggttgcagtgagcagagatcacgccattgcactccagcctgggcgacaagagcaagactctgtctcaaaaataaatacatacataaataaaataaaaaaacaaaataaagtacacctctttttaagatggcaatggtatcatcatacgatcagtacgttctctcccctgcaggcagatctattcaacaagccaatttataatcagaaatggacttggtgggcatatagaattagaaaaaggggagctaattataggattcaaaacattttaatggcatcaggctaaaacagcccaatgcatacacttccacaatcagaacagttttgtgaaaaggacgtggtattttataccctctatgttaggattttacttaaagtgagaagcaataagagttggaaggaaggaacacggtattaggattgcagtgccatacagtgcctagtctactttcaacaattaaaaaaaaaaaatccttaaacacagtgcagtttaaaagccatagcacctacttgccaggaaagacttccactttcagtgccactaaaaatataacagtgaaaaagtccacatagagcataaaccatttcaaaatggagcatcaaaaatggaaacgatgctggttagcccatttgccagccctgcaatcacgcaacttttagctctaattcctgaaattcataaatagttggcaagcaaagtggctcttagcaagataaatctgagccttaacctccaccccagcacgtgtaaaatttaggatggaaattaacattcagaatgcctggttctgattaatggagaatttaacaccaagacatctacttgctgcatgcgcaactgagacccaacttccttcctttctccgtcttttcctaaaggaagacggggtgattcaagcagagaagtccacgctcagcagggtttgcttggggtagatgccccaggcaatgcaggtccttcccccatcctcaaatgacacactcttcaggagctccctcccgttctttctttggaggaaacattctttatgtactgtaaccaaatatattctatccccataacgtatcgtgaatattccaaatttttatcatcttctccaggcaatcagctacctttagactatactaaagtatttttttgtggcatcagctccagccaacctgcagccccgtgcgctagctggccatcctgcacagtcggctgagatttactgttggttttcagtggtggcttcactcacactgcacacgtctaaccaaggaatgtttagaggtttcctactgacaatcttaaaatcatcttaaccaccagcgtggattaaacagccttagtttcaagagtgagggggaaaaaaaaaagtccacaaaaaaaaggacaaaaaaaccaaaccaactccaccatcaatatctttgttgtcatgatagaaaccacaacttagtcacggattcagtaacatatcacaggcagaccaacttgtactaaataaggacttttacacttccaatcactgagtagaaacatgtgcagtgactcgttacagccagcacttgcactccgcatctgaggattcccaacaaaatggaaaaggcaaggtgagtgacaagacttgcgaaaagctagaggcacatcacgtgtgtctaatgataaatatctaatgggaataaactggctaataatgagatgagctccccactcctttcctccttccctgacagccaggggagttctatgtcctctttggtgcaaaatgtatgcagaaaacactctacaatttccagctgttccagctgttctttctgaagcagacagagaacttttaaggacagttgaaggcccggggctcacacctgtaattccagcactttggcaggccgaggtgggcagaacacttgagcccaggagttcgagaccaagctcgagatcagcctaggcaacaaggcaaaacctcgtctctacgaaaaatacaaaaattagccaggtgtggtagccctagtctgtagtcccagctgcttgggaggctgaggtgggaggatcacttgagtccaggcagctgagtctgcggtgagctacgatggagccaccgtactccagcttgagcgacagagtgatactccatctctaaaaaacaaaacaaaaaaactccatcttttctttgcttcttttccaggcctttctgtggaccccagatacttctagcttatgtcaggggctttccattatgctggaactcacttcctgaaagcttactgcgttccatgggccccacggagtagaatcaagctttgatattggctaaatcctggcatggacatcccatttgtcttatctccatgttacacgctcatcttcgcccacggtcgtgcttggcttccacgtccaattggaccaggaagtgaatgacgggacattgagtgtgaatgcggtagggaagtgctgtttcactccgacctgggtgaagatgagtcataggaagtaaaaagaaagggctctgccaagtccatcatcctgtcctctcgcattcattttaaacaattcagactcttacttgtaaaccacatttctgactgacttcaacccagtacagattaaacatcgctacatcaaatcacattgtaaataccccaaggaggttcaagattaggaaatccatcacgaactgttcagcaaaagaaatataatcattttcctctgcagctaattactccctaatttatctgttgggaaagtttagattcttctattttatgttccattaataactcaagagtcaccagaggacttatgttctctgcctcccctgtaacccatcatttcactcagtcatttcactcatagatcgtttggtgaagtaggctcaggaagtaattaaaaattagtctcaaacggctgcctttggtgagaggaagagtttcccacaatcccacaattcttttttttttgttttgagacggcatctcgctctgtcatccaggctggagtgcagtggcatgctcctggcttactgcaacctccacctcctgggttcaagcgattctcctgtctcagcctcccaggtagctgggaatacaggtgtgagccactactcccggctaatttctgtatttttagtagagatggggttttgccatgttggtcaggcggtctcgaactcctgacctcaggtgatccacctgcctcggcctcccaaagtgctgggattacaagtgtgagccaccacacccagctaggtttcttacaattcttgttgtttgttttttaagatggagtctcactctgttacccaggatggagtgcagtggcatgatcttggctcactgcagcctctgtcccccaggttcaagcgattctgctccctcagcctcccaggtagctgggattacaggtgcctgccatcatacccagctaatttttgtatttttagtagagacagggttttggcatgttagccaggctggttttgaactcctgacctcaagtgatccacccaccctggcttcctaaagggctgggattacaggcgtggcccacgacactccggctacaattcttgtttttgttggtcaggaggacacagccacatgttgtggtttttcatcaccaaaatgtggcaatgaatgtacacaaatagccaaccatctctttcctccctcaagtactgatcaaaaattaatgtgagctgtaagttttagatcaagcattcccttaaaaaaattaaccaagatgaaatccctaggaggcatgatagtatggtggccaacagctctggagtcagactacctgggttcaaatccaatcccagctctacccattatcagctgtgtaagcttgagcaagagcaagctgcctaccccctaggccactcacctcatagattattaggggaataaaccagtcaatgctgaaaactgtgcctggcatgtgctcagcgctcactagatgctactgactattattatttctataagaatgtcacaaatatgactgggcacggtggctcacgtccgttatctcagcactttgggaggccaaggcaggcagatcgcttgagcccagtagttcaagaccagtgtgggcaacagggtgaaaccccatctctacaaaaaaacatagaaattagctgggcgtgctagcacgtgcctataatcccagctactcaggaggctgaggcaggaggatcacctgagaccaggaggtcaaggctgcagtgagccgtgattgcaccactgcagtctagcctgggagacaaaacaagactctgtctctaaataaataaataaataaggaatatgataaatgccacatgttctcactcataaatataagctaaacattgagaacacatggacataaagaaggaaataacagacacatgggcctacttgagggtgcaggttggcaggaaggagagaatggaaaaactatgtatttggtactatgcctattacctgggtgacaaaattatctgcacactaaaccctaccacccccgtgacacacaatttacccatatcacaaacctgtacatgtatcccctgcacctaaaataaaagtaaaaaaaaaaaaaaatcagagattacctaattagtaatctcggtctaaaactctcagtccgaaaacttgcctcagaacactgtagacagaaataatgatgttgccattgcttaaatccaccaggtacttttgcagccttcaaaaaaacccaaaaaacaaaccaaaaaaaaaaaaaacctttctaaagataaatattaaatgactgttttttaaaattttttccgagatggagtttcgctcttgtcgcccaggctggagtgcaatggtgcgatctcagctcactgcaacctccacctcctgggttcaagagattctcctgcctcagcctctccagtagctgggatcacaggcgcccaccaccaagcccagctaattttttgtatttttagtagagacggggtttcaccatgttgggaaggctggtcttggactcctgacgtcaggtgatccacccgcctcggcctcccaaaggtgctgggattacaggcatgaaccacggcgcctggcctgttgttgttttaaatcaggaactgagctattttgaacaagatgccttgtagtttaaccctggatacagagcgacgcggatacctggagaactgtgggggcaatatgctgtttcggtaacttgctctgctcaggcaacagcattagctcaagctcgggttttcctgagctgcagtagtgcaggcatctggctgcttctacttggttgacatcactactcttctttcatcagcttccttgatttcctcacctatttttgggtccaattgtctagccttggggatctggcaacctcatgttcacacagcccaggccctggcaaccatccttacctcaagttttaggccccaccaaatacaggtatccccagggcaccaccagatttggccagccttcatcctgcctctcactatcagtatggacatcagaaacctcgggtccctcattgggcttcttttgacagatatgtcatcctggcaaacatgcaaaacaactctgtaaagagggaaagttacaccaagaacctgtggctcagcggttaagtaatccactttcagtcacgccgcacataaacagcactgctgaagccaccgggcagtgggtcactgctgctgacacggtgacaggtgggaggacgccctcagatgtggtgatgtcgggaagaaggttgagaatcaaaatattaaagaactatgtgaacagccaagtactgcatatttttagtagatattcatgtgtatgtttaaaggaggtatactaacttgaactacaaactgagagcttataaataagagtgctgaccaaccagccggatgcaacagatgtaggctgcagggaaaccactgttggcctagtcaccaatttccacttgtggttctatcggctccagaggtgaaattcaattcagaatgagctgggccacgccaggcttggtggcgcacaattgtaatcccagcactttgtgaggccaaggcaggaggactgcttgagtgcccaggagtttgagaccagcctgggtaacatggtgaaaattagccaggcacacctgtgcacatctggagtcccagctactcaggagaatgaggtaggaggatcccatgagcccaggaagttgaagctgcagtgaaacgtgatcatgccactgcactccagcctggacagcagggcaataccatctcacttaaaaaaaaaaaaaaaaaaggatgagctgactcaataagaacaagtaacacagcttttcagggaatgctggggacagggatacatatggccctaagaagctacgggaagtcattttcagatcacaaggggagtctgccttagaataaaattgataccatttgagaactaagtagacagaaagaaactggaaccttcagtgacactgctaagccctgccaagctttgtctcaggcccgcacactacctttggctttttagtctcataaagcaatgctccctttactgtttaagccacttttaagttgtttctggtaaacttaaagaggacttttgtggaatgcatttaagataagcactttcttgcatagtatggcactgcaaatcactgaatattataagtttaattctcctggtaaacattttccctgtgagggctgggcgtggtggctcacacctgtaatcccagcactttgggagactgaggcaggtggatcacttgaagtcaggagttcgagatcagcctggcctacatagtgaaactccatctctactaaaaatacaaaaattagcctggcatggtggtgcacgcctgtaatcccagctactagggaagaagcaggagaatcgcctgaacccggcaggtggaggttgcagtgagccaagattgcaccactgcaccccagcctgggcaacagaccaagactttttctgaattattttaccacagtgtcaaaatcatgatcctctcatatttttaaaggtaaacaaatgcatttctttgggagtcatggaataggtaaatgcaagtagaagagaaaaagcagatgtgacagtcaagggcagagagatgacagatactcagatttcatagattagcacagaacttctttcggcctttattaataagattgccctaataataagtgttgtgcaaccaattgaaagctgttcagtttatttctgacacaaacgtaaatgttacccacaggcagcctcttactcaccttttctactatggcctaaaaagcactcctgaacacccaggcagttttgaagcctctgaagcatatttttttcttcttcttcttttttttttttttttttttttgagatggagcctcactctgtcacccaggctggagtgcagtggcacaatcttggctcactgtaacctccacctcccaggtttgagcaattctcctgcctcagcctcccgagtagctgggattaaagtcatgtgccaccacacctggctaattttttattttattttttttttgagatggagtcctcactgcattgcccaggctggagtgtagtggcatgatctcggctcactgcaacctctgcctcctgggttcaagcaattctcctgcctcagtctcccaagtagctgggattacaggcgcacgccaccacgcctggctaatttttgtatttttggtagaaacagggtttcactatgttggccaggctggtctcaaactcctgacctcaagtgatccactgccttggcctcccaaagcgctgggattacaggtgtgagccaccgcacccggcctacagcatgttttcacacacatgcatgcatatatgactcccctgaaacctagcaacatccctgtggaggggaggcgtcaccaggcaactgcaaacgaagaagctgcggcctagaaaagttgaatactttcctcaaagtcacaggactcaaaagttagaggagtcagaagttggaagaccccggtcttctaactgaatttcaaaagacgttttaccatactacctggcctctcctggacagttctggaagtatctcccacctatgaacacagatgggcacagcaggcttgtgctggacaccaaaggcgtgtttctgagaccttatacaagggcagaagattgagaaacaggcattctggacaatctaaaaaatgtaaccaccaatatcagaacattaaaacttagctctagaaatactctttcatcatactcctggttccagcagccactccttatccctgagggtccaaagctttagggagtgcctggaatactgcacacccaaaagacaaacacaggccaattacaggactgatgttttatatatatgtgtgtgtgtgtgtgtatgtatatatatatgtgggtatatatatgtatagatgtgtgtgtgtatatatgtatatatgtgggtatatatatgtgtgtatatatatgtgtgtatatatatgtgtgtatatatatgtgtgtgtatacatatatatatatatatgaaacaattaagattcaagacctgaggtattatctagagcacctgaaatttaggccttgcatttcgttttttagacagagtcttgctctgttacccaggctggagtgcaatggcgcgatcttggctcactgcaacctctgcctcccaggttcaggcaattctcgtgcctcagcctcccaggtagtagctgggattacaggtgggcaccaccatgcccagctaattttttgtatttttagtagagatggggttttgcaacatgttgcccaggttggtctcgaactcctgaactcagacaatctgcctgcctctgcctcccagagtgctaggattacaggagtgagccaccacgccaggccaggacttgcattttaaagcacttgtattttatgctcaccttttaagcaacattaaccaagaagcaatccagtattttcctttctagaacatgagacggaacatttggtttacttggactttgagaaatgcccaatggttctgttttatttttttaagccagtgactttctatacttctcaatgctgcatgggcaccaacagtatgggggctacattcttccataaagggacaggttctggggcgctgcttggcaatgctttctcttgtcatatccatcaatgcttttccaatcaatacatggaagcaacgatagaaataaaaggccttcatatgatagagtttgccaacctgtaatgatgagtgtcatgaatttatgcatacatgtagcatttctcttagaaagcaggttgcagagactcattgcactgactacagtgggcctcaggcaatgcaactgttctgttccattacctacagtgatctcccttttttctctcatccagatcctcttccagaattgaactgagaaatgggtattctatgaggaaagcatttcagtgaatctgtctgagaatggcgaggaaggaagagctcggaatccctgggcaatctaatggtatttatgataatgaagagtgaatataatctattaaagggtgttcaagcaaagcgatgtcattcccccagacatcctcaacacagagcccaccagagagcctgcacaccaaatacctcctatagtgcaactcttccctttaccatcaccagccccatcaaccccatgagacaggaggaatggcttgccctttaaacctcctcctggaagtccacagctactctccttacagtcctgagaccccattctcagctcccttcagagtccactcaacattttccttctgggcttctagcgtttgggtcctgggaactggggctgctttaaaaactctttctgggctgggtgctgtggctcacgcctgtaatcccagtactttgggaggccgaggcgggtggatcacctgaggtcaggagttcgagaccagcctgaccaatatggtgatggtgaaaccccatctctactaaaaatgcaaaaattagctgggcgtggtggcgtgtgcctgtaatcccagttacctgggaggctaggacaggagaattgcctgaacccaggaggcggagggtgcagtgagctgagatcacgccattgcactccagcctgggtgacagagtgagattccatctcaaaaaacaaacaaatagacaaccaatcaaccaaaaacaactctttctggctggacatggtggctcacacctgtaatcccagcactttgggaggctgagtcgggaggttgcttgaggccaggagttcaagaccagcctggccaacataatgagacccccaactttacaaaaaaatctaaaaaatatagctgggtgtggtggcataggcctgtcatcagtcccagctactcaggggactgtcatgggaagattgcttgaggctgggaggcagaggttgcagtgtagtgattgtgccactgcactctagcctgggtgacagagtgagaccgtgtctcaaagagaaaaaaagaaaagaatactaaaaaaaaaaactatttccattggctcctccacctatactggccgtcttttccctgctccttttggggtcgtttcagagctcatggtctcaatatcagccttccttccagaatcactaggccaggctttcactgttacctcctgaatctccaaagccccttcccttggggagtgcctcctcccagatccacagcgcctgactctccagcgtattcccagccctaaacatggacatgcaaatgaactcgcccagatgtcatggcttcattattctggcctaagactaggacttctctttacatatccccttgaggagtgatttaactgccattacccttttctctagcccccattcccctttcaaatgagaaatagaaaaacagaaaacatcctctaaccttgggtttttgaccttggctctgggatgaaagaggagataccatcatctccttgcatgccatttactggctgggaaatactccagcatcactgctgctctgggaatcaggagatctgagggtaaatgatttacaaaaacttcaatgaatgaaacatttggtggttaaccgctaaagttattaaccttacttttgtttataatctgcaggaatggttaactaaaattaacccaactcaacatgtgcttgcagaacattcacgctatattgaaagaagccaaacaaaagaaagatttccaatcctcaacatgggtttcccaaactgccttcataggacatcaatagctcctagagcagggggaaagggtgtacaaacacatctgagggaccctgagttaaacaaagatccttttcttggaggtggcacctctcagagatttcaatacaccgatgggaactgtgaaaccccagatcttctaaggcaggttcaaagctgtttctactatactatcttgagtctccaaaatggtttggaatgtactgcctgccactggagacagtagctgaatacactttatgctacagaaatgtttcttgaaggttgtatgagttcagaacatgcagttcatgagcgtggcttcccaaagtgccttccaagttgcaacagaaattctacaaaatcccgattcaagatacacataaaggcccagtgcagtggctcacgcctgcaatcctagcactttgggaggccaaagtgggcagatcacttgggtccaggagtttgagaccagcctgggcaacagggtgaaaccccatctctacaaaatatacaaaaatcagccatgcatggtggcgcttacctatgtagtctcagctacttgggaggctgaggcaggaggattgcttgagcccaggaggtggaatttgcagtgagcagagatcatgccactgcattccagcctgggcgacagagtgagaccctgtctcaaacaaaacaaaacaaacgacaaacaaacaaacaaacccaaaaaaattcacaaaaacagatttaaacactgtgataagaagtcaacacacacactcaaacaagttacctcattttaacagtgttctcattactttgtaagaagaaatataatttaataaacttacatgaacaaatgctgctttcaaaaatctgtttaataagtgtgcacaaaagaaaaggttttctggtattaaataaccacaatccgaaactgccttatcaggattttcaaatagaagaaaaacaaaacatgggccaagggagattattaaattttaaacagcaatgaaacattttacaaatagtgtgcttctatttagcaataatgtcgagatttgacaaataaagatgctgaacttgtttgattcacagcctgaaagtgacaggggactttcagccttcttcattttcaggctagactccagaacacattctttgtgcgttaggttcacttttcagcagaggcaaacagtgtgtacaatcacactttatctttgtttccatgaaaatggagtaaaaatgtgtgtatactgatgccctgctttttttctaatacagattaaaaagggaaagaggaagtaggaatacatccttaagattgataataaagatgaggctcatttttatcttctacctagagtcaagtttctgacttgtctaagctttcattatttaccttgcaaagaattcttttaatccctgcaagtgacctcagatttttttttaacccaataatcaggaacttaatacagcatgtggtgtcagaggtccttatgagtgacaactgtgaaatgtttgatttatacacaagtcaacaatgttgtattctgagagagaagagaataataatgaaaaagatgttcctcagagcatggtaccctcagaaatagagtttagggacagagaaacctagagtcataccaggatggaaagccaccatctgtatggcatctgccacccccaggttgatggggcttgtggtattatgcacacgttcctcctaaggcataactgggctgaaaaagacccagatttttttttttttaaaaggaccaaatagggcagttttatcatatacaatatatttgccctctacatgtgaaatggaaaaagctgtgatgtcatactctaaaaccagtggttgtcaacatacggggctgtggtgtttgtaagagcacaaaaccacacacagtaacattttctcggggctgcaaaaatctgtgtcccatgtactttttcaattttaagatgtaacttttctatttcatattaatatttctgaaatggggatatgttttataatccacacggacttatgatgtggttgtgtctggccagaaatgcttccttagaaccaaggaaatactgtacatgccaactattattttcagttccatggaaatatggttttagttaataaaatgtcaattaagtgtaaagtattagtacactgacagaactaacatgttttctcacagaactaacataagagacttccctccccaaggatacaatgattgcagtgactaaatgaatatggggccacctacaactgttttgataataagttcttaaactcaaggactcaggatcactgtgtaccatgaattttctttctttcttttttttttgagacaggctcttgccctgctgcccggctgagtacagtggtgtgatcacaacttactgcagcctcgatctcttgggctcaagtgatcctcccacctcagcctcccaagtagctaggactacagttggctattttttttttttttttggtagaggtggtatctcactatgttgcccagaatggccttgaactcctggacacaagcaatcctcctgccgtggcctcccaaagtgtcaggattacatgtgtgagccaccgaacctggctgctatcacctttatacaaaataattcaggtctgtgtttcaaagagccagagttggaacaattagaggataaatccctaaaaaagaaatatatgcaaatggtctttgatctatactttaatattagaacctgaaattgtcctggtattcctaaattatagttcatttcatctttttggtggcttaagctgaaaagatagaaagagtatctttagtttcaatacatcaaaggccgttggaaatagggggcaaaaccagcactttaataagcagtaggggccgggtgcggtggctcccgcctgtaatcccagcactttaataagcagtaggggccgggtgccgtgactcacgcctgtaatcccagcactttaataagcagtaggggccgggtgtggtggctcacacgtgtaatcccagcgctttaataagcagtaggggctgggcgcggtggctcacgcctgcaatcccagcgctttaataagcagtaggggttggcgcggtggcttacgcctgcaatcccagcactttgagaggcagaggcgagcggatcacttgagatcgggaatttgagaacagcctggccaacgcggtaaaaccccgactctactaaaaaaatacaaaagttagctgggcgtggtggtgcatgcctgtagtcccagctactagggaggctgaggcaggagaatcacttgaacctgggaggcagaggctgcagtgagccaagatcgtgccactgtactccagcctgggtgacagagcgagactccatcttaaaaaaaacaaaaaaaaccctttatcaagactgttatggctcaataatcacagtgccaaataaataaattcctatttaaaaaacaaagaattcttcttagcaagcatactacaaatggcccaattaaacgcctttcactttggaaacctgaggtctgatccagacaaggatgatctgctcaaagttttagagctacagaaacaaagttttcaccaggattttacatattcaaacataaatttagtacaggggaaatttaatagttctataatcttaacactggtgtctctcaaaacactagcagaatttaatcttgttctaaatcaaaccgggaagagttgagaaaagtcacttatttgtatgctctttcccaacagtataaaaataaacaatatacattatgtgcctatcaaactaaaaaatgaataccaattaataaaggaaacagcaattagcaaagtcattagtttacattccttcttttgcttctgcagttgtggctaatgatttgttttgacaacttttacctgtattttacttaatgctgataaataaattcatgatacagacctagtattttatatcaattttacctgaaataaaaggagacccaggacatttgtgaggaatatagtctcatagtattaagagacccaaaattcaatcctattaaacttgtatttttagctaacaagcaacacatttaaaacctcttcatttccaccccagcaccgacagttagctttcttcttgggatttttttgtttgtgtgtagtgatgtctctgcaatgggatattttattttattttttgagacagtctctctgtcacccaggctggaatgcagtagcgtgatcttggcatcctgcaacctccacctcccaggttcaagtgattctcctgcctcagcctcccaagtagctgggatcacaggcatgcgccaccacgcctagctaattttttgtttttagtactctggggtttcgccatgttggccaggctggtcttgaactcctgacctcaagtgatccacccgccttggcctcccgaagtgttgggattataggcatgagccaccgcacccagccctggattacagttttgagggcagctgctaaggttaagttttttaagctcgtaaatgactcaattttaaaatatccacacctggcagatattttattttttaataaactttcaaatatagaataatttttgatttacaaaaaaactgcagagacaacactgagaattcctatgtatctctcacccagtttctggttattaatattagttgcaattagtgaaccaatatggatgtattattattaactcgagctatacttcattcagatttccttagcttttttcccctaattttcattttctgttccagggtcctttctgagtaccgcatcacatttagtcattacagcgccttagctcctcttggctatgacagtttctcagactgtccttgcttttgatgaccatggtagtcctgaagagcgctgctcaggtagtttgcaggattccctcaatgtgggcctttttctgatgttttgtttatgatttgacatcatgacagaatggaagaccatggcagtgaagtgtcattctcatgacatcatatctagggtcctactatccacagtattcactgctgctgctcttgagcttgatcatctggctggggcagtgttcatcaggcttagttactcctcctacacccaacccctttcccttcccacctttgtcaggaaggctacacttaatgggggaagacttatgctccctgtattcgtctgccttcacgctgctgataaagacatacccgagactgggtaatttataaagaaaaagaggcttaatggactcacagttccgtgtggctcgggaggcctcacaatcatagcagaagatgaaagtcacgtcttacatggtggcagacaagagagaatgagagctgagcaaaaggggtttctccttataaaaccatcagatctcgtgagacttatgcactatcatgagaacagcatgggggaaaagcccccatcattcaattatctcccactgggtccctcccacaacatgtgggaattatggaagctacaattcaagatgagaattgggtaggcgggggcacagccaaaccacaacactccccttcttaagggcagagtacagacatacattacttggaattcttctgtgtaggagactgtctctgctccccatcagtaaatggggatatgagtcatttatttctatgtgtatggactcatggctatccacagttaatttttaggaagagggatgaagggattttgttgttgcttgtacatgtgcgtggcagatacaccaaggctggggatgacatgggcctgttgatgggatgcaggagagtcacaggcctccctctgcctaaaaggctttgctcacacactggtatcatgtcccactatattgaaatttctgcctcaataaacttataaagtacagtgcattgtggaactttgagttcaaactgcaaatgctgaactcactatgtcaaaggcccaactgtctgtattagtgcctctccttcatcctaaatccccacctccatgcagccatggatcccatgtgtgacaccttcacgcactgtgagctggcatcctgttaggaggaaggtggctattcgcagcccactccacaacctccctcctggagttgtgcatacttggacgcatgcaataaatgggttttcagtctgaggagtggtttggagtaaacaattctgcaggtcttgatagtgagtgtatttggatactgagagcacagcagcaaagggcacctcccaataacatgagagaggtgacatgcagaagctatccagtgtgctctgtgagcccaggggaaagaatgtcactcaggagtttgacaattgagatgatgggctacaccaacaagggtgtgagatggagggtggggagggcatgggctttaatgcaggacgacatcaacatttcatggtcaaaaaggcccctcccagaatagtctaatgctttcaaatttgcaatcttgtctatgccagtacgtctcaagctttttaagtggcagcacacctacaagtgatagtgagacgtgcactgacatcaaacataaagacgtttacaatttagggttggatagaatttatttggacggtctagtaggacacgcaccatggactagaaacctgtataggagacaaaagctttaaactgtaatgtttcccaggacaaattgggacagctccccctaaattccatttttagtaacaaaacacctctgcttagcttacaaaaagtcatatttgagaactgctggtttatactaatttgtacaacaaatcttattttcaatggactgaagggtatgctttagaagccgctctctgtctaaatcactacaaaatccaaatgagcaaagtataaaatagaggtttcgtaatatacatctttaaaacgttattcgagagtttttttcctccccgcaattgctggcaatagccactgttgtatgcttagctctactatgcattaaagaagatttctgatcggatccatggaattatttaagagtttaatgtggaagactttgctcatggtaaaaacaaattaattaattcaatctgccttcaaagcaacaggaagaaagtatcagagagggaaaagtgataccatcccagcacaggaacaagaccagctgtgccaaagttatcagagagtatgcagagctggagataagcctgcagggaaacctgggacttctgaggatgctcttaatataccctgacacatcacgacagaaaagggacccttctgaaaagacaaagaggtgggacatcactgcctagacagagggagactcgcagcttgcatgttcatttgctcatgaaggtcgacttccttccctatctgaccccgggcaaacacagggctacgacggcagtctgccatggcctgaatgctgctcagataacccttgatcccagcatcagaatcccagagtttattactggattccagagctcctgatccactagttctgcagcaggacccaggaatccacatctttaactagcaacccaggacctggatgcagaaggtctttatgctactttgattgacatcatgaaattggggctacaaaccctaagcaatctacgggcaagccatcctgagagtcgtttctcaacttttatcaacaggacggatttgttaacctaattgggtggcacaccttcactgggagagggtctcattagcagcctagtgctaccagttgttgtgtaactgttaacaggtgttgctggccaggtgtggtggctcacgcctgtaatcccagcactttgggaagccaaggcaggcagatcgcttgcagtcaggagttcgagaccagcctggccaatatggcgaaaccctgtctctactaaaaataaaaaaattagctgggtgtggtagcgctcctgtagtctcagctacttgggaggctgaggaggaaggattgcttgaacctgggaggcagaggttgaaatgagccaagattgcaccactgcactccagcctgggcgacagagcgagcctctgtctcaaacagaggctctgtctcaaaaaaacacataacgggtgttgctgcaacaggcttctgtcagccggtgcttatacctaattggattcaatttcacatgcatcattttcactagcccaggtcaccaccaccaaagttacatcaacaaactgcacagcacaaaagactagtgacaaagagaaaatagacatgaattttaattcagatttgagacactctagaaggcaagtcagaccctctccaggcacatttatcagtgattttacaacgcagtcagtgcctacatggatttttgatcatttggaaccctactgaaagtatctggaagaccgaccttggagtcatggcccagggtgaaacctgccctgtgtttaacccgtgagcaaaggttctgtccttaccatgcacaccccacattggcactgggagaacatttcaagacagcacaagaggctgcagccgagtgggtccccagcctggctgaatactacaatcactggaagagacctgatataattacctgtgggcagggcccaccagaccaagtgcttagaatcttgggtgagtcctgggcatcatgttgctttaaaatgctccccagagcctggacaacacagcaagaccccatcacttaaaaaaaataaaaatttaaaaactagctgagtgcagtagcatgtgcctgtagttccagttacacagggggctgaggtgggaggatcgcttgagcccaggagttcgaggctatagtgagctatgattgcaccactgcaggaccagatgagtgagtggcagttctggccctaaggagagacagacatgaagacgtgcaccagctattgcaatccagggcgggaagtgtctggaccctcagcgcctagaacagtgcttggatcactgtgccattccataaatattttctgattaaatagcaaagctaagcacacagacctgggacaggagaaccagagaggacgacatctgaaggggacaacacctgatgctttaggaagagtgaaaatgactccattaagcaaaagcaccctagaggagtgacctgtataaaggcagggtggcgaaggagtgaggatatatgtcatccgtgaggacatccagacaacagccactgcacaggccggtggtcaggagagaggtctggacgggggacagccttgggcatccgtccaggaggggggctgggaactgaacctgggccctccagcctggacgagagagcaagatccatctctcaaaataaaataaaatgctcccaggtaatgataatgtcccaggcttgggccccaaaaggaatgtttttgttcctaagacagtctcaaaagtgggcactgtttcccctgctctgcctaacaaatggaaagttcaataaattattgctgaactacactgaacacatttaaagatcagacaacttccatttctataacaggcaagaaacctcagggatggaagactgggttgtcatttgtgatctcatctctgcaactgtatgactttgtgacaattagtgtcagaccttcatctttaaagaggtgcaatgaaaaagcactgccttctcactgatcctactaaaaagtttagggttgagaagtttgctaaaagtgctgagatttaaattggcaaaaacaggagcttccaccaaagagtaggctctctgtctgaaacatcaccaggattgaaaattgagagcgaaaaactgttaatcccagcaactgtcttctaccagttataagggtggctatatttgagcccaggagtttgagaccaacctgggcaacatagcaagacttagtctctacaaaaaataaacaaaattatccagacatggtggctcactcctagagtcccagtcccagctacttgggaggacgaggtgggaggatcgcttgagcccaggtcaaggctgcagtgaccaaaactgcaccattgcactccagcctaggtgacagagcaacactgtttccaacaacaaaaaaaggatgcccaggtacattcaaatttcagatgacaaacaaataattttgtgtaaatatgtctcatgcaaaatttggaatatctttatattaaaattttatttgttgcttatctgaaatgcaaatacaattggtgtcctgtattataactggcaaccctagggataacagccccaaaataaattgtctagctatgttgtcctgtgtttcagactttgttactttgtctcagtggaaaaggatgacagtattactggataaaaacatttgcgaatctcatgtttgtttcccaacaaaatgctttgatattcataggcataggggccacctaagaataggcagaatattcgtctcacagttacttttcagagcggagttcttcagccctgaacaaaggacacagcagaaaggaaacacagctgagcaaatcgatggaacaaaggaagcattcaactcacaccttgcgtcatacacgcacaaaacttcagctatctgtagaagccagaaatgatgatgaaatttgatctgtttaatcttgtaactatgaagttccacttcctattttttgcttctgtgggaggtgaggggaagacacacagtagaacttaaggagagaagagaacgaaggaaattggtacgatcacattgactttttcagaaaacactgcgcaggaccagatgagtgagtggcagttctggccctaaggagagacagacatgaagatgtgcaccagcaattgcaatctggggcgggaagtgtccggaccctcagtgcctagaacagggcttggatcactgtgccgttccataaatattttctgattaaatagcaaagctaagcacacagacctgggatggcagaacgagaggggatgacacccaaaggggacaacacctgatgctttaggaagagtgaaaatgactccattaagcaaaaacaccctagaagagtgacctgtataaaggcagggtggccggggagtgaggatatatgtcatcagtgaggatatccagacaacagccactgcacaggccggtggtcaggagggaggtctggacgggggatagccttgggcatccatccaggagggggctgggaagtgaagccctggtgcaaaggagatgctctagagaggtcaggcctgggatcctaggccacgtcttcctcaagcaaagagcagggtgcccatcaaaaaacatacaggttcctgggctctagaaagctgaggagagcaaaggtgcaaagaagactacgaaaggacagatcagccacataaggaaagcctagagaggcccctgccgtggacagcaggacagactcctggggtgacggaggctccagtgtacaaggagagcagacccagaaatgtccgctggatctggagaaacgggttactgtgatgtgatagggaagggacagacagcagacagctaaggcatgagttccccttaagcaaagggaaagattgtatagacagcagcttctgtctatgaatggaatgaaggaacaggtggaggggctctcccatcaaagcggggctgcttcacaggtattttttgtttgtttagagacagggttgtcttgtcacctaggctggaatgcagtgatctcagctcactgcagcctccaactccttggctcaagtgattctcctgcctcagcttcccaaggagttgggactactggtgcgcatcaccatgcctggttaatttatttttaatttttgtagacactgagtcttcctatgttgcccaggctggtcttgaactcctggctttaagcaatcctcccgcctggcctcctgaagtactggaattacaggtgtgagccactacgcccagcccacaggcatgttcttatggtgggaagaggcctcaagatctgtatgaaatgaagagatggagccacaggcaggaaaatgattatacagctcccgaatgaaagctcaaatgctctgagcaagaactcacagatcctttttctcaacttcctttccctgctattccatccaggagatccagatgccccgtagcagaaacaagccgaggtccatctggactacagcccactcctgatgtccaggctcttatctggctgagtgactcttctaatacagaaggcgtggaaatgagtgtttcaagaggtatgggtccagcacacccaactccactgaattcatttaaagacacagaacaaaaatcaaagccctgtgaactaggaaggcaagtgctcacaaggatagccatttaagtgatcctccagagtcttctgagattctgcaagcagctgagaatctccagggaggtaaattactaaaaagccactggagaattccaccgctttagcagtgcccgagccactttctacagagggacaaaagacacagagggaggggtagctggcagagctggctgctgtgctatctggacatggtgcaaaaaacacggctttttgctacgtcaactgtagtaaaagagatctcaggaagacctagacatttgttaaaattaaacaattttttttaaaagaatgggaaaatcaggcattctgcatctctgagcaacaatagccaactattatttctttaaatgaaccccaaagagcactcataaaagacttattcaagatgccatttgcacaatactaaaagatcacacgaacagaactcataaaaatgtgcaagctttatagttgataacagtcgaactccatttaaaaagaaaaagcataaaagggtggttcaacatgaagtacaaactggacctaggacaacagcagtatttctgttgctccctgaagcagttttcattgggtcggaaatcgatgcagtctgactggaggtgacctaaaagcagatgaaagacagccaggcccaaagtccacaaacagcatcggtaagacctactgagagtttcttatgcatataataagtatgcaatacaatatttttattgttatgaacggagtcaccaagtatttacctagaaaaagctgcagaattcggccgggtgcagtggctcatgcctgtaatgccagcactttgggaggccgaggcgagtggatgacaaagtcaagagatggagaccatcctggccaacatggtgaaatcctgtctctactaaaaatacaaaaattagctgggcgtggtggtgcgcacctgtagtctcagctacttggaggctgaggcaggagaatcacttgaacccaggaggcagatgttgcagtaagccgagatcgcaccactgcactccagcctgggcaacagagcgagactccatctcaaaaaaaaaaaaaaaaaaaaaaaaaattaagaaaagaaaaagctgcagaattccttccacatgatttgcgttctaccccaatgcttgacatactaaatccaccacctctcttgaagctaggttttgaataaaatgagaatgacattttctttctttcttttgagacggggtcttgttctgtcacccaggctggagtgcaatggcaccaactcggttcactgcaatcaccactttctgggttcaagcgagtctcctggctcagcctcccgagtagctgggattacaagcgcctgccaccattcccggctaattttttgtatttttagtagagatggggtttcaccatgttggccaggctcatctcaaactcctgacctgaggtgttccgcctgcctcagcctcccaaagtgctgggattacaggcgtgagccactgtgcctggccaagaatgacattttctaggtagccttttttttggtttaatgtatagacagggtgtcaccatgctgcccaggctggtcttgaactcctgggctcaagtgatcctcccgcctcagcctcccaaagtgctgggattacaggcgtgagcccccatgcccggcctctaggtagctttcttaaattgagatgttaaaagtctaagggaaaaggagtggcttgtttacctgtaggcagaactgactgcagtgtaactaggaccccttgcagtcaccagggtctatgacggcgtcctggctctgcccctctctgttcctaaccatcaagcctggatgtgcagccctgctacttcgagtgtggtcctccaaccagcagcatcagcctcacggaagagcttgttaacagtacagcctctcaggggccacacgggaccctgaatttgaatctgcatttaacaagatccccagctgattcccatccatgcttcgtgacgcagttgagcagtgagaaaagctggctgagtgaattgctgccccattccaaaaagccatcgggagaacgggcagcagctgcaggaagtgactttcactgtactccatttcattttatcacactttcattttattgaccttttctctaaagcaacggagctgttttcctttgttttattcataactcttaatttttaaaagtagtctgacttcatgctaccatctcaaattgtatcaactttaaattatttacatgaatcgggagggaggaaatggaaaccatttttcacattcgatttatatccaatcagagttttttcttttttcacaacagttgttaagttgttagcaaacctgtgttttcacagcaagctaggaagtcccttagatcattatccagaaaaacggcatgtaattaggactacacagaaaggcgccctagaaaatacagaacagggctagaggtacacacctgcagacaggtgttctacaacaaggctaagtgcacatctgtccacctggaacagcaatcttgcttactgagtagttaactgcatgcaataaactgtgaactcaggaagggcgagggccatgcatgtaactcgagtaggaggggttcaataaatatccatgaatcagtgaatcgatgaatatcacttaaaacaggctcttcccacaacactctgctccttccctttcaattcctgtaaaggccagaatattaaaggaacctccaagtcattcttgattgctaagaggccactagccacactgagatggctcctccagggtggccctcatgaggaccactaaagggcttttcccaccaggaagtaaatcactcctatgccatcagaaggatgttcggcatcagcttccctatcctgaacacttttaggacttggaaaggtaaacgtggcaccgatctgggtgtaaatggcttcactcaacaatgttcataatctctttctgcccctgctaaaattctcttgaaagaggtggaactttctgtacccttttggttgctgtgatgtggacactctttagttaactgaaaaggcaacaacaagaacgaggaaagaaagtaaaagagatcagccacaaagacaactaagggtgttctaaacaaatcacatgagattagcagaacaggtgggctggaggaaaattcatgctggaaaagccaggcgctttgatgttggaatatctggttgaagatgaaccaaccaagcagaataaatgggtgaagacgaatgataataatctgtgagagggagatagatcagacacggcacccggttcacagaattagagtaacacccctacacgtgatgcccccgtggtatgagacctgagttcactagcaaaagctcagcaacccactgataattttgaaaacaaacaaacaaataaaaaaagaggatgctctttttcgaatacttcataaacttagacatcttagttgtggctgatgtctttactcccttgtcccatccaaaagctacaatccacagggatggccatgtggtcttgaaagcacctcatctcctgctctatatcattaattttatttttatttttactttttttttgagatggaatctcactgtgttgcccaggctggagtgcagtggcgtgatctcggctcactgcaacctgcgcctgcctccttggttcatgcaattctcctgcctcagcctccccagtagctgggactataggcacgtgccaccacgcccagctaattttttgtatttttagtagagacggggtttcactgtgttagccaggatggtctcgatctcttgacctcatgatccgcctgcctcagcttcccaaagtgctgggattacaggcgtgagccactgcgcccagccaattctctctttttttttttttgagacagtctctgtcgcccaggctggagtgcagtggtgccatcttggctcactgcaacatctgcctcccaggttcgagcgatcgatactcctgcctcagcctccccagtagctggaattacaggtgtgtaccaccacgcctggctgatttttgtatttttaatagagacagggtttcgccatgttaagcaggctggtctcaaactcctgacctcgagtgatctgcctgcttcagcctcctaaagtgctgagattacaggtgtgagccaccatgcctggccacccttctctacatgattaattcttagccctcagactccagctcaaaagtcactgccctgggaagccccccttgaatgcccctttctcattgcctcctctgttccctaacatgcttttctcacacctagactgcttcactcgttctctttttctttatttatctttgcttcctccataggaactcgaggccctgaaaagcaaggactgagtcttaattctttttatctttgctcagatcagaagaatgactgtctgtgctcagttcattatgagtatgtgaactatgctttgtgagcccaggaactgggtggccccggactgaagagtccctgcgcaggaatcatgactgaacccgagtgtgggtgcgtaagcccccaagagagatgagctgagaggagagaggaagaggtcgcgtgtgggatgaacacctccacgctgcagcagccaaatgactttgagcaccttttcttggtctaaaaaaggaatcatatctctcctgaatacctctcaggatgatgaggaacaaaatagagaatggatctgaaagcacttgaaaatctataaacgaccatgcaaatatataatgacagcattttggtggtgaaaggtaaggaaagtagggacgatggatggatggatggatggatggatgcatggatggatggatgcatggatggatgcatggatagatggatgcatggatggatggatgcatgcacggatgcatggatgcatggacggatggatgggtggatggatggatggatggagagtggctcatcagccacaaaacagctatgttcccacaaaaactaaaaataaatttaaggccaggtgtggtggctgatgcttgtaatctcaacacttctagggccaaggcaggtggatcccttgagcctgggagttcaagaccagcctgaacaacacggcaaaacttcgtctctacaaaaaatacaaaaattggccaggtgcggtggctcatgcctgtaatcccagcactttgggaggccaagctggatggaccacctgagcttaggagttcaagaccataatgggcaacatggtgaaaccctgtctctattaaatacaaaaatacaaaatacaaaaaaaatacaatttttttttgtaaaaatacaaaaaaaaaaaattagctgggtgtggtgtgcacacctgtagtcccatctacttgggaggctgaggcaggagaattgtttgaacctgggaggtggaggttgcaatgagccgaaatcacgccactgcactccagcctgggcaacagaacaggaccctgactcaaaataaatatactaattaaattaaaataaaaattaaaaaacagaaggaaagggttgacaagtatctaacttcaagtattgttagtccattctctcatggactctaagaagtcaaagttcagaaataagaatgtgaaacaggaatgggcctcacccaattaataaaacgttgtctaatgagtgcacataaaaaataccaagggtccaaaagctagtagctcctccctcatgtttacttggcatttatgaagcactttaacatgtattgatttagaatgcctaagtttaatatttaatgcggcatctaacagatttccatcaagacgcagaaagaaacattctaacagtacaggcagtgattttaagttttaaataaaggcaaatgaggttcaagtaggtgaagaaaattgtttcaaaaagttgtggggaaagtacacaacgaaagtcttttgtctatttcaaatccaactaaaaacacaagttacagcacaagaatcaattctaaagagaatacaaagtgtgtgttaaaagccacttgaatggttcgctctgccaagaggtgaatgggctaaaaggctcactcttggagtttactttcaccatgtaatctttaggtttagagtaaagggaagcaaacgtatccataaaactatgcactgagcatatgcgctgtgtgcacatgaagtcactgagggaggagacacttaattttgctaccagcaacatttggacaatcggtagatgcagggcctggatagcaaagccgcattttaaaagggcgctctgtgctccggcagatgggctacaaacttgaccagactgcagccactgtgtcttccacttacaccagttgcatgcattaacttttctattccttagccatatgccttatcgcacattcaaaaacatgtccagcagatggtaggtaacaaagagaagagggtgagaagtgaaaaaccctgttctaaaggaggcatctaaaaaccaatcacctccaacctctgatgagaagggaatattgtgaatcatcaaatgccattaaacaccaatagtttgacgccgccctttggaagcagatattgactttttgtatcacaatacttggaataacacgcatacatttttctaacactgttgtgttttcctaactcagaataatcacagattttcataataccataaatattgacataatgatagattggcaattcccagaatatgacttcctgtcacatgaaaccctaaatagacgtatggctctacactgaggaatcagaccaaaggaacattatctcatgagcattgaagcaagaaaacgtcctaagttcagaaaacatcgtctctttttataaaatctgtatttgaagataaacaacagaagggctatttacaccactaattctgtctccatgcagagtccaaagaagccggacaaagggcatgggaaaatacctccaggaaaaaggcagcagtgtagacagcaggggaagagtaccaggtgccactgttctctacatggtacagctcctacaatgcaggcggctcagaaacacagtaaaagtcaggaaaggccccaggggagaaaaaacaagagggaagaaagggaggaacctgaagtaaagggagggacctgactccaacactccattctgccctaatcccaaacatggaccctgaaaacagctcagctccattcaatcaggccgtgggcatgcacgctcatctgaaatgccaaatgcaaagtaagctttaacacaatcacacggcaactcagaatgaatgtcatcaacgccaggcattgtccttccaaagtcccttctgggacatggacagcccaggtgtgtgcctgctgagctagtgattagagtgcaaccaagtcacatctggtggcccaaaactctcgccatgcttgcactccagatccctccccacctctgaagtggctcctggagctctgcataaaaagtggtgggcaggctgggcatggtggctcacacttgtaatcccagcagttagggaggctgaggtgggcggatcacctgaggttgggagtttgaaaccagcctggccaacatggtgaaaccccgcctccactaaaaatataaaaattagccaagtgttgtggcacttgcctgtagtctcagctattcagaaggctgagccaggagaactgcttgaacccgggaagcagaggttgcagcgcaccgagatcacgccactacactccagcctgggtgacagagcgagaccctgtctcaaaaaaaagtggtggacggtggaactttcaaggcaatgaacttggcaatgtctcccttcaagtctcaggaagacgcctggggagccaggcccggggaagcaccgagtccgatctgtaagtcctttctccaacagcacttcacataaagagaagaaacaggctgggctgcagctcccgctgacccagcaccgtgggcctcagaattgctttgacatcatgaacttccattctacaacaggtactgctcctggaataacgatactttcactaagacttgtcaacagacgataggtgaatggtacaagcagaggaaataaggaaataatcctatcctgtctaactttataaatgagagacctgtaggagcagcttgttcaatctggaggcatttcagtttttccagtagaccatctcctgttatgctcaatgctgattcaaattatctgacttctggaatagatatgcttagaacttaacctttaaaagttatgagaatactttgaagaaatgagtcaatacattaatgactcaaaagagttaatgaagcgtctcaagtaacatctagaagctgcttagggattaagatatgctagttttgtttgtttgtttgcaacagggtcttgctctgacatccaggcaagtgcagtggcagaatcatggttcactgcagcctagaccttccaggctcaagcaattctcctgcctcagcctcctgagtacaggtgcgtgccaccacgcccagctaatttttgtattttttgtagagacggggtctcaatatgttgcccaggctggtcttgaactcctgggctcaagtgattcgcccacttcagcctcccaaggtattgggactacaggcatcagccaccaaggccagccctggctcttgtttgtatatcaacagttgcaccttccaaacggcaaatgtacttgggtttccttccaggcatggtggttcacgcctgtaatcccagcactttgggaggccgaggcaggtagatcacctgaggtcaggagtttgataccagcctggccaacttggtgaaaccctctctctactaaaaatacaaaaattagctaggcatggtggtgtgcacctgtagtcccagctacttgagactggattcctgaatcgcttgaatccaggaagtggaggttgcagtgagccaagattgtgccactgcacttcagcctgggcgacagagcaagactccatctcaaaaaataataataataataaaataaataaataagtaaagagggaacaggcatcaaaacagtcccatatcacctccagttccatacctgtggcatgcaaatattaaactccaaaagcgtttttacttcctctctctcccattccttctttacccagacacacacacacacatgcatgtatacacatgcatccatatataaatacacatgcacacacacctatccacaccataccttatctggtaggtgtgtgataaagtggttctacataatcagataggatattcattgagatcatttgatcatttgatgggctaatagaataaagaaaaatataagtttggattaagacattattgaaaataaacataaacatcgtagtgaaacctcaactttggtttctaacaatgcttccacattaaaaaagtcaagccatttatagctggaaagtaaaatgaatgtgctatattttaaaaatcaattcatatatataaatacatacatacatatatatatataaatacatacatacatatatatatataaatctgccctcaaaatggctaaaatttaaagaactaacaataccttatgtttatgagaaagagaagcaagagaaaatttctcatatattttcaaggggagtatagaaagatacaaccaatttgggaaaaagtctagcagtttcttatgaaagggaacactcacctaccctatgatctagcaatggcactcctaggtatgttctggagagaaatgaaaaatattgtccatggaagaattgtcgaaactgtttacagcaactacagatagaacagccaaacactagaaataacttgagcgcccagcaatggaagaaagggtaaactgtgaaatattaatacagaagaacgttatgcagcaataaaaagaaacaaactactactgatacagtagtatcagtactgaatgatatgggataaatggatgaatctgggcctttcgtggtggctcacgtatgtaatcccagcactctggggggccgaggcgggtggatcccctgagatcaggagctcgagaccagcctggcaaacatggtgaaaccctgtctctactgaaaatacaaaaattggccaggtgtggtggtgggtacctgtaatcccaactactcgggaggctgaggcaggagaatcgcttgaacctgggaggcagagattgcagtgagcagagatcatgccactgccctccagcctgggcaacagagtgaggctgtctcaaaaaacaaaaacaaacaaacaaaaaaaggccgggcacagtggctcatgcctgtaatcccagcactttgggaagctgaggcgggtggatcacctgaagtcaggagttcgaggccagtctggccagcgtggggaaaccctgtctctactaaaaaatacaaaacatattagccaggcatggtggcgggcgcctgtaatcccagctactcgggaggctgaggcaggagaatggcgtgaacccgggaggtggagcttgcagtgggccgagaccacaccattgcactccagcctgggtgacagagcgagactccgtctcaaaataaataaataaataaataaacaaaccaaaaataaatggatgtatctcaaaaaatccatggtgaataaaataaaccagagtaccagagtacataatgtcgatttatatgaagttctaaaaaagacagaaaactaatctgtagtagaaaataatcagaacagtggttgccctgaagagtagaggcagggatttactaggaagggaatgagggacctttctggaatgatggaaatatttggcaccttgatagggttttgagctgcacatgtgtatgcctaggttagcacttaatatttgtgaatttcctggtatgtaaatttccctaagaggaaaaataagcattaagtaaatatggaacactaattaatgagatacatgctgaagtatttatttaggggaaagggcactgatgcctgagacacactttaaaaggcacagaatatgattaatggatggatagaaggatgaataaatgagcaggtaagtaataaggcaagcataataaaatgttaattacagagcctaagtgatgtgtatgggtattcactgcaaaattttttccgtttctttgtatgactgacattttcatgagataaactggaaaaataaaaacctattacggtcccataataccatctatcagttcaaaattagttttctgagtctttgtataagcaaagattggaagtagaaagctttttattttttgagacaaggtcttgctctgtcacccaggctggagtgcactgacaggatcatggctcactgcagtctccaacacctgggcttgagtgatattgtcgcctcagcctcccaagaagctgggaccacaggtgcctgccaccatgcccagctaatttttaaattttgtgtagagacgaggtctccctatgttttccaggctggtcttgaactcctgggctcaagcgatcctcctgcctcagcctcccaaagtgttgggattacagctgtgagccactgtgcctgtctagaagcttttttaaaaagaaagaaaaatattaaacttttacaagttcaaataccaaataaatactggtatttcacacttatttcagagcaaagaaagccctcactctatgccaaaaggagaaaaaaggcatctcattatgctatatgaatccaatcatacctgaatgttttacacgtaacctcatctttcctttccccaactcaccagtcgctgggttcaaacatgtttctctttttatataaacagtttgccaaatattaatgagctctgaacacagaagccagaagattccctcaatcccagctaggtgtaaacccaaatcccactctgttctattggacctccctaagagctcatgagagttatttgtgggagcttcttatctcttccacacatctggatcccatgcagtatcaagtaccaagcctccctcataaaagatgctcaaggttgcttttcatggttcaagggcaaacaggaaccacacatggggtgttttcatctttgttcatgaaaattaccaggcccatgaaaagccccttatttacattggtaaaatgctatgaggatcaacattgtgtgaaattataatataatcctctaagtcataaagcagcacagttggggggtgaagtccaggctgtctcctacataacagtagagtcttccaattaatgtgcaaatttgggaaagtcgtttaacttctttgcacctcacagtcctcttctatagagggagaatgatatttacgctgcatgcgattgatgtgaagattaaataagatgatctgtcaagctcctttgcatactgtctggcatgtaagaagcaccgagcacatgtttcctaatcgtcattgttagttttacgtgtccaggtgaatgaagctgagagtgcctgtctctattacatcaatttaacattaagtagagcagacaaatcaatattgacaattccaagaatttaataaatcacagttatctaaacaaacttcactcctggggtcctaaagtcagcatacaaaaacagcaccactttagatacagctttcaggattgcagaagctgccttttttccttgcaatgtgtgtccatggtgggttctaaagtctcagggagggaagggacagggaagtcacttgtccagaacctgagaggacaccctcagcagtctttttcctccttctcaacatcctcaagggcagagaaatgggcctcccggtaccctctggccattggacagagggtcatgatccatcctcgacattttagctgggcaggcggaatgagtcctccaaagacatccaagccctcatccccggaacctgtcaatacattgtgttaaaaagggactgcagaggtcattagggctatggatttcaagataaagagattatcctgaatgagcccctagaagcagggaactttctccagctgtagccagagagacgtcgcagaagggtaagtcagagcaactggacatgcaggaggcctggatgcactcttgctgacttggcaatggaaggggcaaggtgacaaggaatgcaggtggcctcacggaggtcagaaaggcttctggccaggacaacaaaacaacagggactccatcctgaattggcaaggaactgaattccaaaaaggaacatggcccagctgtttgtttgtttgtttgtttgttttgagacagggtcttgttctgttgctccggttggagtgcggttatgtgatcacggctcactgcagcttcaacctcccaggctcaagcgatccttccacctcagcctcttaagcagctgggaccacagtgtaccaccatgcctggctaattttttttattatttgtagagatgaagtcctgctatgttgcacagggtagtcttaaatgcctgggctcaagcaatctccccaccttggcttcccaaagttttgagattgtaggtgtgagccaccacacctgggcccgatgctttgcttttgaccttgtgagaccccaaccagagacttgactgaaccatgctgtctatacccaagcttctgacccatgtaaatggtgagacaataatgggtggctaaattgctccatttgtggcagttcgttaaggtagaaatggaaaactaatgcaatgaaaatatcagaagttccttaacatgcttcccttttttccctctagatcaaatactctctggaattgaaccatctttcacaaacaagactttgaggctacccctttaggatttcctccttctgattagttcagtttagctattctagggctgagcttgtcatgaccagggacaatgaggtttctgtcacagggatgggtgggcacagaggagtgccagtccagcccaacaccagcaaacatcatgaatgggtaacagttatcacacggataagcagagcatacaatgccaggagacctgatttcaagctgtcctttgaatgtgtctggcatctagggtcaaccacaatcatctgagtatagtcagatcagctcatgatacagtaagattatgccccaatctgctttctagaaaccacgccttcatcaaggcagcccaacatcaccctggcggttctggtagccaagccacactttcgactttttacttgattaatgttacagtcacctaaaagatctaagtatttttcccatggattaaaataaaattaacccattctatgctgcaactttgtaactgccatagttactggctacagagggttattattttttcgatctaaatttggacctaacttttgcaagccctcgtcttacctttataagaaactataatcaatgtcgtcacctaatcattaataaaatatgattaattataaaggataaattattaataattaaacaactaagataatagcaaatgttacttataataaaatgttaagatacaaagtacacgtgctttaattctctctgttaatatacatttcccttagaatacacttcttattgactcctctgtgagggaagagatttaagccataattgtggtgcaaggaaaccacaccacaaccacactcaaataatgtcagaataaagaggaagagagtgaacgtcattcattgagactgggctactaatggctgttcttgaaatcagaagtcttgccaagggtagcaactcatgcctgtaatcccagcattttgggaggctgaggtgggtggatcacctgaggtcagaagttcgagaccagcctggccaacatggtaaaaccctgtctctacaaaaaatacaaaaactagccaggtgaggtggtgtgcacctgtagtcccagctactcgggagggtgaggcaagagaatcgcttgaactcaggaggcagaggctgcagtgagccgagattatgccatggcactccagcctgggtgacagagcaagactctgtctcaaaaaaaaatcataaatcttactgataggactcactttatggattggggacaactttaataaaagtgttcagtgctcttcattcagctctgccaaaatgacattaaaactctttctcccaatacaaattcaatcattttcctattcaaattctgagctcaagatagtacatctaagaaaataaaaatgttcatctgacttggaactacctgggccttttctcattaagtgtatgcctctctatccttgtgggagtacagattaaaacaaggcaaacaaaattataaaacaatctctggtaaactcaattttcacttccaaggtatcttttcctaagctaactgctacttcccaaaattccaaaagatcttgctagttctcacatttgagtgtccttatatatttcatataaaagtaggagttcaaaatatggatgaacagatgaaatccacatttgatcatcttatctacccatccagtttaaggaatataagacagcttgacctaattcttccatcgttattattcagagattcccagtgacgatgaaaatcactaaagcaccagtattgtccaggctgtgctgtagctactttaaatatttgatcaactagggcctcttctacttaatttgcaacttttaggaatcctgagtgatggaatacacacttatgctccttgaaataagacttctgtgtcccaccgtgcataactccttgaaatatctagaaatcaacattactggccgccatggtggctcacacctataatcccagcactttgggaggctgaggtgggtgggtcacctgaggtcaggagtttgagaccaggctggcccgtctctactaaatctgagatggggtgaaaccccatctctactaaaaatacaaaaattagccaggagtggtggcatgtgcctataatcccagctactggggaggctgaggcaggggaatctcttgaacccaggaggcagaggttgcagtgagctgagagggtgccactgcactccagcctaggcgacagagcgagactctgtctcaaaaacaaaaacaaaaacaaaacattaccaacaaccagtagctgaacttgtttttagtcatacgagagttagtgggtttcatctgaatcaagagactcatgcctaattacataaaaactaccatctagatgtccttctcactttaggcatttatttttccacttattttccaataggattgtaaactttccgaggtgagaattgcaaaataatcaagcttatgcaaaaaatataatgcccctccccgacagaccacctctttttgtccaataagtatttagcacactgtcttcatacagcagatgctaagatttaggaacttgatttcaagagcagaaaacaggtcagctacagatgaaggaagtgagggtgtagagcaactatggaaaggaggataaaggaaacgctttagaggagacgatttgaactgggaagagcaggagacagtgggaaaggcattcaaagacaggcatggaggtcgtaaaggccgggcttagtcatccaggcttcacacttcgggcaaaagggacatacttcgcattattctgcaggacaggaatgtgaattaaatggtgcttgaagacagacaacatggaagagggttttgagttgaaaggacaaattaaaactgagatgaagacgatgctgtctttagcaaggacccaagagggctaaggtagacatggagtggaaatcagcagaaatgaatgaatactatgtctaagctatgagagagagacaaagatgctaccttaacctgtggcaaggtcatcggccttaaaataactgaatgattcactcccttcctccattatttatctaccttttggccaaagcccagaaatcgagaaggttcaagcttctctgcagctttaagttcagttccttggcaggagactgatggcaggacacttcatcacccttctccttcccctagacatgaggttggatggagtcccatatgactccaccaagccatcagtgaccccttcagcttctgtttgagaccctgcccaaatgtcacctgtctcccctctttggggcccactgaactggattcttttgctcccaaatgagatggaaattgcaggaaagcaagcaactcctccctccctctattccccaacagatgcagtggcaaggcttgtcgaggtgtttccacagcgctcctccctcatcagcatgggggcttcttggattgttcaaatggccctgggccctggagctggtggggtgcatttgcctgagagaggcagagaaatctcagaggggccatgctgagccctggggaggacaactgggaggccattcaagtcgggtgggtggagggtgggggggcggtccctaacatttcattacataaaggcagaagggactatggcgacatcccatcccagctttcttttacttcatttggttactaacagatatgtttcaacaaaaattagagcacagtcaaaaagccagcaagacttctgaaagtggcttttggcaggggtttcagaggctacatgttctccctgcaggtgtgaatcccagctctggaaggaacacagcacactcaatggacccgaacataagaaaagccacagcccacttttccttcctcatctggaaggaaaacagttattctggtgatggtgggtgtccttgaggtggtccccaaggatccctgtcatggctccagtttggtggaattctggtaaaccgatgcaaaaactccatgcgtttttccaaatgtaacttcagtagctcagttccaaaaagcagtccatgctgcaccaccatcctgtgtgggcgaatctctattcacagttcttaggggttagggtctgtgttagttccctattgctgccataacaaattatcaaacaactcagtggttggaaacaacacacacttataatcttacagttctggaggtcggaagtccaaaatcagtttcactgggctaaagccaagatgtcagcaagcctgcattccttctggaggctctagggtaaaattggtttccttgccttttctggcttctagaagccacctgcattccttggctcctggcccctttctctatctgcaaaggtatctgtgtagcgtcttcattctctccctgacttggaccccttgcttctattagcacatctcctctgactttgaccttcctgcttccctcttgtgattgattacaatgggcccagctggatgataattcagactaatcttcccatctcaagatccttaacagaatcacttggccacagtctttagccatgtaaagtcacatacggttccagggatcagaatatggacattctgggggccattattctactaccacaacgtctgcatggccagagagcacaattaccttaggtcacctggcctgggtttcctcatctccagaacaaggaacatcaactttatccccaagactcttcgggcactaacatttgctacgtaaatttatctatgagattcctactgcatggattttaagggagggaagggacgtaagcagacacttagattttgagtctggttaacagagaagcaggaatgccgggctgcagaaggaaggacaaagagtttgaggtaaacctggagtgctgaaacggagatgtctaccagtttgctggacataaagagatggagctatgacatcaactaaagatgcgagagcctgagtcgtccatccagaggggcttaattcccagaatttgcaaagattaataagttctgaaaatggtaaatgaaaggaagaaaaggactgggcatggtggctcccacctgtaatcccagtactttgggaggcctaggtgggaggactgtctgaggtcagaagttcaagaccagcttggccaacatggtgaaaccccatctctactaaaacacaaaaattagccaggtgtggtagcatgcacctgtaatcccagctactagggaggccgaggcaggagaatcttttcaacctgggaggcagaggttgcagtgagctgagattgcaccactgcactccagcctgggggacacagtgagactctgttaaaaaaaaaaaaagagagagaaatgcagacagacagaaagaaagaaagatgagcaaatgtttgcagacagacttgaatctaaaagtaagaggagctggcgaatgaaacagaggcttgatcagagaaggtggagtcatcttacatatgctgactcagctgtttaggggaacttaacctgaagccctttctaaaatggttagttgcctcaaattttgcctatttacaagttagatttattttttaaataatggttttcttaattcagggtatgctattgggttacactgtagaatttcttttttaagaaacagttatttcatacaattctttggtcgagtactgaaatgtagtttcatgtatttatttatttgagatggagtttcattctgttgcccaggctggagtgcagtggtgcgatctctactcactacaacctctgcctcccgagttcaagcaattgtcctgccttagcctcccgagtagctgggattacaggcgcccgccaccatgcttggctacgttttgtatttttaatagagatgaggtttcaccacgttggccaggctggtcttgaacttctgacctcaagcgatccacccacctcagcttcccaaagtgctgggattacaggcataagccactgtgcctggcctgaaacttaatttctaaaatacatttaaaatatattcagttctgtgtttcctggagttgaataatttagctaaaactgccgtctttatgagtcctaaagtcatatttggtgatattaagtgaaaatgatttgtgtaaaatcttctctataacttgatcaaactataacagcattactggtatgtataatttccactaaacatgtttcacaaaaagtacacaaggtatttgtcatcacaggacaaactcctctctctagatctctgaaatatgctttattcaattttttcttcatgatacagcattatacatacctgctgtctatccagtttatttccatatgttttcttggtaagcagtgtttactaaaagtaggaaattaatatttattaaaaattccaaattagtatttcccagcaataataaagatgcacagttagatttactgagatgtcagtaatttggttaaaataaagaattgattaaaactgagaaagtggctgggtgcagtggctcatgcctgtaatcccagcactttgggaggctgaggcaggcggatcacaaggtcaggagatcgagatcattctggctaacacgatgaaaccccttatctactaaaaatacaaaaaaaatagccaggcgtggtggcgggcacctgtagtcccagctactcaggagactgaggcaggagaatggcgtgaacctgggaggcggagcttgcagtgagttgagatcacgccactgcactccagcctgggcgacagagcgagactccatctcaaaacaaacaaacaaacaaacaaacacacacacaaaaactgagaaagtattaatacttgaaagctatttgtttagaaatgcatgcactattttccttcttttggtttggatgttaaggtaacaacctataagttacaaagtattatagacaagtacaaataagatataaaaataattcatgaagtcatttcaaagacttttccagaaattccctagatgttactgttgctcctgcataaagccctcacacctggcttgcaaggaagcccagcggcctctgtgagtccagctcctgcggtttcccaggatgtgagcccatgagttttatttagaagtcatgctcttaatacaatgtcaccgtaagttaggcttgttggatgatcctcctgataccttacatggcttcgtggtctttcaacagatcccagtgttctaataactgaagtttgagtttggcaaagaatagacctcttagagaagagacaaagccaatcattgtcttcaaatgttataacagattgcagcttttctgagatgagcaaaaagctagcgcatcatcgcaaaacaccttgcacttttcagcactgggtttgcctcaaacacctgctagatatccagcgacaaaataaacatcatccaataagatgtctgagcatgaagttcttaacctagctctgaccttccttttggcacataaataagagtgctgggcttcaaaaacacatccctaaagagtacatctgcacagcttactgctcctccaggacagctctctctattgaacccagcctcattacagttttgcaaaagaggtgaagaaaatcaaaatgggtcaatacttttgaacaacaattttgaaaaattcccagaaaatagattcgatactataaatgctccagagcaactgagaggaaacacttaataaaaatagtcatagtctagagctagttcaaattcatgataaacaaagccaacccttaccgtgacaactgactgtggcattggaaatcactttgccaattcgaagcagctacgggaagagagtctgaagccaagcctccaattttatcttgaatatataaaaagcaaagtaatgccaagaaattctgcagatgctagtttcatcagatgacataaagactcatttaatcaaaaaggtgtcatttagttctagcaatctagttggactactacagtatatgatttccgtctgtttgaggtctctaagcagttttaccaaagtaattgccaaatcctgttggtgcataatatgtatgtgcaatgcttgttcaaagaatgattcaaacaacagattctacataaaagcaagattcttacaaattagcttttggggaaggtaaacattgaacttttcttcttaaaatgcaagccaatgatgatcactaaaggttgcgttatggtgtaggtattagctatggttgatgcttacctactcagcaccatctgagcaccaactgtatgcataacaacctacaacccactgtgggaaatgcaaagtgaaatcagatgcagcatttgtcttcatcgtgtacatgatccaggaaagcagagaacacatgaattttaaaactacgtcatactacagcaagtgaacattaagatgctttgaagaactcagtgagttgggactgaccttctaatgtcaaaggagaaattgtccattcccttaaaaatgctgctagctcaaaatccaaatgccaggtagtgagacctgatttctgaaagagttcctgggctcaaggctttaaaaagccatccttacagtagataacaacaaaggaagtaatccaaggggtaaactatgccaagatacttgatctcccactccaaccataccctaaactaagccactgctagccatggcagaaacctcttctcatgttgaccatttccctcccatttcgcataatattccattcctgagaggcggatttttagcagcaagagctgggtaaaacgtggtcttagacctaaacctgttatatatatattgaatatatatatatatatatattgaagacatgccttcctttctctaattcagaagtgcatgaatttaatatttccatatattggtatttcaagtgcaaaaggaaaaattcaacttgctctttaaaattaacggcctcgctgaagtgcaaatatcattctctaaaatagctgattcaaaaaagcagtagggtattaataaaagaagctgcaatgcaacactgatgatctaatgtcctaaacattcgtttcctacacgaagagacatataggtctttttgtattttgtagctgtccgctcttccatgatatgcattactaaaattatacacaattcataacggtcatattctaccatggccatagaagcagcaatgcatttaagatataccaggaaatgatactgcaagtgccagaatatgaaaaccttcaactcaacatgtaggcaacaaactcaacccaacagagtgttggcagagcctttcctccccgtagcaacatcgtggtggaagcccgggcgtctctgctcccaggcaccctgagcatgttagccgaggaaagggggttccagcaaggagaccctcggatgcagcactcctcgtttctttggcctgcagggccaactttgcaggacacacacccttctgaggggacaggcctcgggctcggaatcccggggttctgcagggctgcagggagctccctcgcagagacctgagcccccggcaagagtccaggcagcggtgccctgggtgaatgcagaggctcatctgcgggcctcagtggcccttttgaaaacgccagcaacagaggagtcctcgacgctgtccccacaaaaatgtgccaagcaagcctcagggtgggtgtgggggactcccctcaaaaaacgctgattttaaaaacaaaagacaggctcgtggccattctcagaggcgaccacgttactcccagggctggaaagcagatttgtggaggccaaagacgagacaaaaggcacgagctggcgacaaactgatctggaaaggatttttcttttttttttttttttttttggtgagcgatgagggcctcccagttcaattctttcttcccttacagagaagactcatgggccgctgagcaaatcccttatggtctggaagagacgtcagataggcagggggagagaaccccccaaactttcccaaactgcggcaggctagtggctagtggcggcagcggacctcggggccccgggacacagggggcaccccggggcgtcagccaccccctcccgccacaacaaaaggccccagcgcagcccaggagctgggacttcccagacccgagcccggcgtggggagccgggagcgcgatcgggcggcgcgccctgggcggcccctctgtccgcggcgacatgggagacagagccgcgtgtccgaggcgcggcataaaggggacccccgggcgcatccagacgagcccccgccgcagcggcgacagcagctggagctgcccgcgcccccgcccgacccagcccccgatccccggcccccgaagcctccgcccgggtcaccccgcgtcgccggcccgcgccgccccctcgggagcgcgttgcgggtgctgcaggcccggaggctcccgatgcggctcgggctgcgtcgccaccacgcggcccgggaccctcccgccgccgccgccgccgccgccgcctccgcgccaggcccggcgcgacacaaagcccccggccccgccgccgcccactgaccttgggctccggcgccgggctcccgcagcgtcttggtcaccgccttccagacgtggcagcccagcaggcacagcagcagcgtcgcggacctgctcatctccgccgcggggccggcggcggctcgggctcgccgagagcgggccgggcggcggcgcgtcacgggcggccgggcgccgcgcccccctccatgtcgctggctccgcgcgccgggcccgccgcccgattggcccggccccgccgccccggccgctccctcccgcgccccgcgccgggtttccccgaagagccgcggcggcggcggcggcggcggctgctgctgctccgccagctccttaaccccttcctgcctcgcccgccgccgccgccgctgcccgcgcccaggccccgggcccgtggtgccacctggcggctgcggcgccgagggcgcccccgcccggcgccgctgcgtcgcgcccccagcccgacccccggcgacactgccccggcgcgccccatccccgcagccccgcagaagagccagacctgcctttcagggcggagcccttttcatcacaccaggtcacccaaggggccgcaggagacattgtatctgggtgtgacccccccaccaggtgccatcctaatgtagttgtgtcccccaacgtagatttcacacccagtgttaaagatccgcaaaaacactccccaagccagtatagactgcagtaggcctgcagtacctacgtgttggcgggtggacagcttcaggaggaatggtacttggatggttctaggggttagggtggggaggaaatccacatcttttgaggccctaggtgctttaaaactttctgtcctattaaagaaaaaagactattccatgacacgtgtgaaagcacagcaaagaagaccctctttggaaccatcgcaataggtataagccctaccatgggattctgcagtcggggagaaaggttgggttcaactctgaatacagcaggaacaagtggggatttataaccgaggaccagggtgggatgcagggaatgaaaaattataagaggaaacatcagggggaagggggattcttgaaagtcagacatcccctggcagggctgggcaggacagggcggatggggaagctgatcagatatccagggtggagggttcttggtaaactgacttagcagggttcttcctgaaagcagattttacaaggaagggcacaactgagcctagaagaaggttccggagcctgactgtagttcggtcaagcagagactctttgtccatcttcacaatacatgatctaagaggtagttagcattatcccccccattcacagatgagaaaagaggctaaagagggttaaggaatttgtccaaaagtgcatacctggtcagtggcagagccaaaattctaataaaacagtcagtctgaccccaaaattgaaactcttcacaaaaacctccagacttggctgggtgtgatggttcatgcctataatcccaacactttgggaggctgaggtaggtggatggcctgagttcaggagttaagagaccagctgggccaacatggtgaaaccctgtctctaccaaaaatacaaaaaaattaaccaggcatagtggcccatgcctgtggtcccaactactcaggaggctgaggtgggaggatcgcttgaacctgggagtggggaggttgcagtgagccaagatcgtgccactgcactccagcctggatgacagactgagaccccgtctcaaaaaaaaaaaaaaaaaaaaatcaaaaaataaaaccaccaaaaaaaccacacacaaaacaaaaccaaacctctagactttccttgagcctagggaccccctccattccaacctcaacttttctttctctcaacccactcctgtcggtatgccttccacacaaccttcacctccacttgtccctctccaccttctcttccaactagcactgcggtgaccttccgacttccactggggacctaggaaaatccactccagacccatcatccaccccacactgcttccagaacaccaggccagaaggagggttattactgtaatttcattaattgagcatttagacatggcaggcaccgtaccaaaaaaagaatgaaggatggcacttgcccagttggcttataaaagacaaatgactgtgagacatgagaaaaactaggacgtacagaagcccatatgggttttatagtcacccttaggaccaatgctgcaatttgcgcaaatcacgcacctgcacagggtggcaggtagtcaggaaggcagaaagaaatagggactgctggattccctccttcttctgattcctgcatctaagcctaatatatggcatcaaagttcctaatatatggcactcactgaactggagctatttcctcataacaacttatttggtaggtatcattgtttccatttcacagatgaacaaaccgaggcttggtgccattaaacaacttgcccacaatacaaagatctgataagtgtaaattccctataccatgttacttctgagaataaattttatgcaaatgattcaaattacctccaggagtgtccaaattgtttgaacctgctctaatcccagtgaagtgcaaatctagtgaatactatggtgccaatgttcatttcctggcattgacagtgtactacagttatataagatgttacaattgggggaagctgggagaaggatagatgtgacctctctgtactatttttgtaactttttatgagtctataattatttcagatggaaatatttaaaatagaaaaaaaatcccattctatgccatttttctaagtcttattgttcactcaaaacactggtgtttgtgatcttagtatagagttccagaatgtttcagggtggaagaaatcttaataaactgaatcaagttgggttcacaatcttaactgtatcaagcttgtccaacctgccttattttgttgttgttgttgctgttgtgtttttagacttttagcagcctaaagccatcgttttcagtttccatctctagtgataagtggaaaagagggatgaggaaggggctttactggctcaaccaaaaatagaaatgaagaacccatgactgtattctctcccttggacacccctgcgagacgctcaggtctgatggaggtggttgttattatcgtgtataacaatactttccaggacgaattggaactttaggagaagtttatgtaccctcatagcaacactgagtcttgtctaaatagtttcagaaacaccgctgccatcccattttgcagatgcccttgtgaaagagaaagaggttaaacaatttgcatagtacattctgcaggccagtctcaaagccaaaaacagggctggggccccaaagagtattatctcatcacccgggtattttccagttacctgggtgggaggctgtaaggaacacagattctgctacatcactcaaattaacatacttgcatatcatgtagccagaattatgtaagaattaaataatcacacttatcctttacaggaataaaaaatatgatttaccttttctcatgttccgatcatgatcatcagacacccactcagtaactaagggaagaaaattacttgtggaggagtatttgcagaacaatggaagttagaagtgttctttccctgtagaacttttcctgttgctcttactaaaatctcacattgtttgactagagatgaattatgactgtacttatttgaaattgcttagaagttgcttgactgtgcagcatttgatttcaattttccaggcctgtgccaaaaaaaaagaaagaaaaaaagaaaaaaagtcatgccacatacagaacttttcctgtctgaattttccagagaccttgatttcaggggctctgtgtcaaggtttcttagcccaagattacttattctattgaaatatttcctgatgttggtcccacgtggtggatttttttttttttttttttgagacagagtttcactctttttgcccaggctggagtacaatggcgcaatctcagctcactgcaaccttcgcctcctgggttcaagcgattctcctgcatcagcctcctgagtagctgggattacaggcatgccccaccacgcccagctaattttgtatttttagtagagatgaggtttcttcatgttagtcaggctggtcttgaactcccaacctcaggtgatctgcccgccttggcctcccaaagtgctgggattacagacgtaagccactgcgtccgaccccgtggtggaattttaatggtctgggtttgcttggagaggtattgttcttccttcttccctttcttcccctagcccctgccccccagtctgcccctgagtaagaagcttccagtaaacaacagaattttatgagattgtacaggtcaggaagtatgtcatggtcattgctacttctgtttgctggcacttttatttaagttagatagaatgtagccacagatagaaattgttaacagcccagcattttttttgaagctatccgcatctatataaaaaagaaaaaacaaaccaaaacataaggtaacaaaattactgtcaagggactgatgtgtttaagtgatccccaaccctcctctttttcctctgtgtggttcagccctcatatttcaatctctgtgactttccaacaagctctttctttcaacagcatctttcggtttttttcctacaacctcacttctcgcgtacaggttttcagccaggagaggcttttcttttttttttttttttttttttttttttgaggcggagtctcgctgtcacccaggctgaagtgcagtgtcgtgatttcggctcactgcaacctccacctcccaggttcaagagattctcctgcctcagcctttctagtagctgggattacaggcgtgtaccaccacacccagctaatttttatgtatttttagtagagacgggatttccccatattggccaggctggtctcgaactcctgacttcaagtgatccacccgcctcagcctcccaaagtgctaggattacaggcgtgagccaccttgcccgtcccaggagaggcatcttattcaggaaataattctgaattatttgggagatgctgagagtgtacatcggcctgcaggattgaatttcagattacgccatttggtcctgtgatttcagatcccctgtcttagagttctactttgtgcatcctctggtaactcaaggagtctgggacacatcccaggcacttgatcaataggtttggcttttggaaagagtattcagaggctagtggctaatggagaattgagttgctcagcaattcattttaagccaatatgctcttttggcaagcccattccattagagcaagcagaagtttccagctctattctttgctgatccattgaattttttatttattttttattttattttttgagacaacgtcttgttctgtcgcccaggctggagtacagtggcgcaatctcggctcatcgcaacctctgtttcctgggctcaagcgattctcctgcctcagtctcctaagtaactgggattacaggcacgtgccaccatgcctggctaattttttgtaattttagtagagctagggtttcaccatgttggtcaggctggtcttgaactcctgacctcaagtgatccacccacttcggcctcccaaagtgctgggattacaggtgtgagccaccatgcccagccagttaacccactgaatttactgtcatatagacaaaaagtgcaaggcaagacgtaagcgtccatgttcttgctggaaaatgtctatctgtgactactgcgtctaccttcagaaatgcacaaagggacatgaagcaaggtagagaaaagacagggtttttttttgtttttgtttctgtttttttttttttttttcatagaaaacttaaaagagttagggaaaagagaggaagacaatggagaaaatggagaaggtaattagcatcagttgaacttttgttgtgtggctgactatacctcaaccagggggaaagtttcagaaattccgctgatctccgattaattttcaagttcgatctttgcatggtactttattttcttttcctttcatttcttctgtttaattataatacttttgactcaaagctgcctactgtcagaacctttctcttaatatcctagtcctgtttaattactaaacaaagagaatccttcattggagtccccataaaaatggaaatgggggtgaacagatgatttttctgggcatattatacaatacgtttagatgcatttactttgaatacatacggccctaggagagccatttgtgtaaaaatgagtcttaaccaggagtgctttggctgctggtgtcattttctactagcttcccccttgcctgttttttgagacagggtctcactctgtcacccaggctggagtacagtggtataatcatagctcactataacctcaaactcctgggctcaagtgatcctcccacttcagcctcccaagtaactgggactacaggtgtgcaccaccacacccagctaactgaaaacaaaatttgtagacatgagagtcttgctattttgcctaggctggacttgaactagtggcctcaagcaatcctccttccttggcctcccaaaatgctgggattagagatgtgaactgccagacctggcctactatcttttctttagcctgagactttagtggacaagaggaacttcattggtacatattttaaagtttcataaaaatgtcagttagtattttataactgtattcttctattaataaaatcttcagaaagtaagccaaaaaggagacaaaacgacaacaaaaaaaaaaaataataaaaattggcccagatttcctgctttcctgttgggaagcacgaggtgaaaaccaatggttttcctcaaaaaagaaagaggagaaaaaaataatcagtccctcataatccttgaaacatctggccttatgcacaaatttgagtccttggttttacaaatggattttctgtctcgaatgtttatttgtaagtcagtggcatttctcatttaatgttataaatactggttgttaactcctctgcccagtaatgtgtttgaatgtagggcaaatagtaccaatctaaatatacctgaagcctatttatacttttgctgaaggacaattgtattcctgagagtcttggggtaagcagaggtcctttatgtatggagctgcattcctgggaactgtgagtcttctactgatttggaaataaagatgtaagtagtacctctttttttttttttcgagatggggtcttgttttgttgcccacgttggggtgcggtggtgcaatcatagctcgccgcagccttgaactcctgggcttaagcaatcctcccaccttagcctctgcagttgctgggactactccaccatgcctggctaaattttttaaatttttcgtagagcggggtcttactatgtagcccgggctggtctcaaacttctgggctcaagtgatcctcctgcctcagccttcaaaagttcttggattacagatgtgagctaccatgcctgggtagtacatttaaaacttaatcaccacagtctgaaagagattttgctttttctgaacataggttagcacctccatcagtaagggctcatgtgatggaaagagaaacctctctagcttcttacacattctacagggaattaggtgcttacaaaaatctgcgaaggggacagaggaggggctctaggaaaatcttccagaacagccccctctcctgggatcctggggtgctgctcctgtgccccagtcaggaaggctgggaagctgggttgtgcttcagaggttttactttttttttttcgagacggagtctcactctgttacccaagctggagtccagtggtgtgatcttggctcactgcagcctctgcctccccgattcaagcgattctccttcttcagcttcctgagtagctgggactacaggcgaatgccacaatggctggctaattttttggcatttttagtagagatggggtttcactatgtttcccaactggtctcgaactcctggcctcaagcgatccacccgccttggcctcccaaagtgctggtattacaggcgtgagccagggcacctggcctgcagaggtttcacttaggagcctgcactcttgctgaggccagggatcaggaagccaggctcctgccaccctccctgctagtgattagacacagggaagctaaccctgcagaaaagcccagcacatcctgcagcagggagacagtcttgtctctctttgctttccaaatctctaccaagagcatccacttggcagaacctgactcccacccagaagcctagctgtgaggaagtctggaaatgtcattaagaagggggaaaaaatccaacgtctggagcacaagatggcacagggaagaagcaggcaccgattctgaacgccagctcctatctccccagagcctccgagtctagtggttgcatactgcatcttgtctatcaccccagttctaggtaccaagacaactgcaaataccccgtggtccctttatgatggctctagtatctttcttgcttttcttttcttttcttcctgttttttttttttttttttttttttgaaacagagtcttacgcttgtcacccaggctggagtgcaatggcacgatctcggctcactgaaacctctacctcctgggtttaagcaattttcctgcctcagcctcctgagcatgtgggattacaacaggcatgcgccaccacgcccagctaatttttgtatttttagtagagacagggtttcacaatgctggccaggcttgtcccaaacttctgacctcaggtgatccgcccacctcagcctccaaaagtgctgggattacaggtgtgagccaccgagcctggcctttcccgcatttctgaacatgataagcaatgatagggatcatggaatcccaggatgctagaactcaaaagaatttgaaggaactggcccattcccaccatttctcaggtaagaaagtggaaaattagagcaggatgatggagcgccaaagatcgctcagctagtctgggtgatactggctacctttgcagaagggaggaacaggctcttttagcatctgccctaaaggaggtacctccagacctgacaacaaaggtgtgctctggcactaaaggtcctcttgggcccttgtgtgtagtgtggtaggggtacttatgagtccaatattccttcagacctttagtttgatgatgtcacttttgtaaaatttgggagacagaggaaggaggatcacttgatcccaggagttcaagaacagcctaggaaacaaagtgagacctcctctctccaaaaaaaaaaaaaaaaaaaaaaaaaaaaaaaattgttttaattagccagacacagtatcttgcacctgtggtcccagttacttgggaggctaaggtgggaggatcccttgagcccaggagtttaacgctgcagtaagctatgattgcaccactgcactctagcatggatgacagagtgtgattctgtctcaaaaaaaaaaaaaaaaaaaaaagaaatcctcctggccaccctatctaaagtaaccctcctcctcccggttatgtgatatcactctatggtcttcctaacaatctcactgtctaagatgctcttcattgttcacttgtttattcagcttcttgcagtctgcttccctgacctgtactaaaacatcagctccatgagggcagggcttttgcctcactctctgccatattcccaacacccagaaaaaacgtttggcacagagtagatgctcaatagcttcagccaaagtggaaaattatgcctaaccttgaagaaatatttccttccagttaatctgcacatgcctctgagctcaagaccagcctgggcaacacagacagaccccatctctacaaaaattacaaaaattacctgggcatggtggtgcatgtctgtggtcccagccactcaggaggctgaggcgggaggatcacttgagcctcggagatcgaggtttcactgagtggagatt

SEQ ID NO: 327 - DNA, 43560 bp, Homo sapiens
cttttggtgtatcgcacttttttcaatatatttttcaagttttactttgaatgatgttaattacagcatttgaaggggaggatctaaattcacacaaaatggaaggctctaaaatacacccattaaactgctaaaaaataaattgagtggtgagaatacaacggaagtccaatttagattctgagtgttgtcaccatgtgattcttccaagcttatatccagaactcctggaagctatttcatattctggtggggggggcacaaaaccacagcatgagaaggaattaagtcctgaattattggcttcatcatatccaccctctccaccccagaatggcagaaaagaaacagttaccacaccctgcagaccttttggtgtaaaataggtgatgattaactggggtggaaacaggtcatgaagatctgtctaaaagagtccctttcaagtgagtttgcacacaccatcaagcaacaagcctctcattaattagggttaggaaaccaaggttcaattctcaggaagtcataatttcattcatttactcaatatgaatttacaaaatgcctacatattatcagcttccatgtgcagtcatttctagataaaaaagaaacctggcttctctagaggggccaccaagttcctcctccaagtctatagctgaaaggaccttttttggaattgggtttcttctctacctctgaaagagtaacactttaaagctgaattatctttagcctggaaattaacatatttagcctgtaagtctaacatttagcaatgcttgcatcccagacatacagtagaagatacactaaattctgaaggtagctgtgctgcaaaataatgtaaaagtaaacaattgtacagtatttatgctcaaaatttcagttccagacctagcgtgtaaccactggcattgttattcttgccatccaggagagctgacagtgtcattttgatacctggctttagggtctcagtgtattctaaacctgttaggctagagttgttcacttagccaagaagcaggtgtcagggttgatcagatacttgggtattccaaagtgagtgtttgtattagtctgttttcacactgctagtaaagatacaccttgggactgggtaatttataaaggaaaaggtttaatgggctcacacagttccacgtggctggagaggcctcaccattgtgggggaaggcgaaagccacatcttacatggtggcaggcgggagagaaaatgaaagccaagtgaaaggagtttccccttataaaaccatcagatcccgtgagacattcactaccatgagaacagtatggggaaactgcccccatgattcaattatctcccaccaggtcagtcccacacacgtgggaattatgggagctacaattcaagattagatttgggtggggacacagacaaaccgtattagtgttactgtttcctgctgtccaggtgaaattgacagtggtctccaacttcttactcaccttctggtaaatggagccaccaaactgtcccattatttacgttagtgtgaagttggaattcatcagacttgtaaccaactgcagagttgctctgggtcactcaggattttgcagtctcaaaatttatctggtagccagccagtcaacccttgtaacccagcaccagagcgccccagatggaaggtccagtgatgtcaaaatccaggttacagcccaagttgatgtgctcctgcttgtacctggtgttgattttagcatttttcccccagtattaggtgacaagggtgaattgagggtcagcttcagtccacttgcaagatgatcttccacagtaatctcagtcctggtgtgttgtgtgtttcacttcataaacatcaggccgtactcagtccatctgtacttggtctccatgactgcctgtcactttggtgatttcagtgttggctgagcctaagctttcaaattccaatgcattctcagattttgttttcaaaaggtttattaggccatatccgtagcccttgttgaagacattcctggcagatttgccaagattggcatacttgggtggcacagccatcttctgctcagaggtggtggtggcaggcttggcggcagctatgatgggggcttcatcagggaggcatggagcaaagcaagcagccggtgtgtagtgcttttaatggtgtttcattatatacctcataaagtcagagtccatgtctgtattgctcaccattgtatccttatcacagtgcttggcatataatgtgtgctcaacaaatatttgttgaatgagcatctttgaatctcctcccagctcaatttgctattaactaagagaaaggcttttttatcagaagagacagaagtgaacctgcacatctaacctttgacgtttttccaatgatttaaagatgtttttcacccaaaatctcagtaggtgttatcttctacccttaatagtcacagatcagtcaacatctaaaaggccccgtctggagcaaatcactctgccattctagtttccacctaatttctaagtcctatagttctgcttaaatatctcttaaaccattttccttctctccatcttcattgttattaccttaaccaaacttttatcagctttattttttttttttaagatggagtctcgctctgcccaggctggtgtgcaatgatgcaatctctgctcactgcaacctccacctctcctcggcgagtctcctgcctgatgcctcccaagcagctgggattacaggtgcccatcaccacacctagctaatttttgtatttttagtagagatggggtttcaccttgttggtcgggctggtctcaaactcctgacctcaggttatccaaccgcctcagcttcccaaagtgctgggattgcaggtgtgagccactgcgcccggccccttaaaattttatcagctcttacacagattacagcagcagtctcctaacagcttttgttgttgttacacttaaaaaatttttttaatttaatttttaaaaaaggagtccctgcagctccagcacggagacacaggggctcaacagagtgcttcctaatagctttttgtcttgagtctagaccccttttgattagttaggaattagcttagttacatgtaatagagattctgtttttccttttctgggtatgccccacattcatctatatattcacatattccacagatatttgagtgactgcttttaccaattttagcttaagccctgcagatacagagctgaacgagaacgttcaatccgtgttctcttgaaacttaacgtagttacgtgaaggttaatataggaccagtaatcacaactgtgatgaatgttataaagaagaaatgcatcttgtaatggaaacatacagaagtgcaaactttttctgtttgagggatgaaggagagcttcactggaagtgattttgaagctgagacccaaaggatgaattaaaattaaccagacaggcctggcatggtgactcacacctataatcccagcgctttgggaggccaaggcgggaggattgcttgagcccaggagttcgagaccagcctggggaacatagtgagaccccatatctacaaaaaaaaaaaaacgaaaaccaaaatatgctgggcgtggtggcacatgcctgtagtcccagctacttgggaggctgaggtgtgaggattgcttgatctcgggagatcaagactgcagtgagccatgatcacctcactgccctccagcctgggtgacagagcaagaccctgtctcaaaataataaaataaaccagacaaaagatagggagaaggtctgtcctcctttccttcaagtccttgctcagatgtcagatgtcacctttttattcaggcttactctgattatcgtgtttaaaatggtaacccatgctcccttagacattcctgattctctttgctttgtttttttccataacacgtatcacttctcacatgctatgtagtttattcattttattcttttttttttttttttgagatgaagtctcgctctgttgcccagactggagtgcagtggcatgatctcggctcactacaacctccacctcccaggttcaagcgattctcctgcctcagcctcccaagtagctgggactacaggcgcccactaccactgccggctagttttttgtatttttagtagagacggggtttcactgtgttagccaggatggtctcgatctcctgacctcgtgatccgcccgcctcagcctcccaaagtgtcattttattctttattatctgtccctcccactcgaatgtaaggtccataactcaggaatttctgtcactgtttctgttttgtacactgatataaccaaacactgaaaacagtgcctgatgcagttgatactcaataaatatttgttgagtgaaaggaggcaagaaagaatagtcccagggcaaaggtatagaacttgcctttagagagagaaagagcatctctaattggtaacagtaaggagggaggaatggataagagcagatctaaatgattttaaaatttagcatttggagattgagagaattccttttaaatagcatgtgatggttagttttgtgtgtcaacttggctaggctatagtacccagttatttaatcaaaccctaatttgggtgttactgtgaaggcatttttataggtatgggtaacatgtacacttagttgactttaaataaaggagattactcttgataatgtgggtctgttgaaagccttcagagtaaaactgaggtttctcagagaagaagaaattctgcctcaagactgcagcatcgggccaggtgcagtggttcacacctgtaatccgaatgctttgggaggccaagatggaaagattgcttgagttcaggagttcaaggttgcagtgagctatgatctgtactccagcctgggcaacagagtgaggttttgtctctaaaaaaataaaaatttaaaaaagaggaaaaaataagactgcatcattaacttctgcatgagtttccatcatgccagcctgccctacagattttggatttaccagctcccacacatgtgttagccaatttcttaaaatatatgtctttatatgaatatatatatcttattgattctgcttctctggagaatgctgattgataatacagcatctcatttttttttcaaatagaaggtaaagtcatcatctgagaataaagcagaaggaaatggaagatgagagagtacaagaggtttgaaatactgattgcccggaatggaagagtgaactgacaaaagaaacagagttttaggcagtgttgagggttcagcagagcttgctgaacagaattcctttctgtctttgtctgaagagctttgattgtgtttttttgttgtttttgttttttgagacagggttttgctctgttgcccaggctggagtgtggtggtatgaacacggctcactgcagccttaacctcgtgggctcaagtgatccttccacctcagtctcccaaagttttgggattacaggaatgagccaccgcacccacctttttcttgtttcaaggccttaaactttaaggactattgtgactcaggtaccgttccttgcccttttatgaaagagttgtccatgctctttattcatgccctcactgaatcctttgtcttgttcatcgttatgtcaaaattaataacaactaaacacttaacaattatatcaaatgtctactacttaccaggctctattctaaagcattttgtgtgcattaattcacttaatcctcacaatactataaggtagacattattatcttcattttcaaaaagtgaaactgaggtaaaatatcccatgactagtaagtgatgaagttaggatttcaatccaggcagtctgattccagagcccatcttcttactcacaaatgaagattgttatacatttatgtatttttttccatgaatattttctgatcatgtactcatggtgcctagtataggagctggggatagagtaggcagcaatcagaatctctgctaccatggagcttatatttctagtcaggggaaataggaaataaataagtatttatatgaagtggtaataagtgctgtggagagaagtaatgcaagtaaagaggataaggatgttggggagagagttgctattttctgttgggcagttagggaagaactcactaataaggtgacatttgagcagagaattgagagagtaagccttgagagcatcttgaagaagtgttcactcttctactgttcaactagttgtgtaaaccactagtggtcctctagtatccattgtctcctttctttatgtaaagaacctctaaattttctgttggcatatgaccactgaaaatgaagattagattttgtagctttccttacagctaggcttggtcatgtgattgatgtgtgcagttgccaggctgtgcccttaaaagaaagggtatgccttctcctttccttttccctccatctcactagttgggatgggacgtggcacacatggtggtaaattattttggaccttaaagatgaggactacttccttggagaaggcagaacaactgaaggctaccgtggtagcctcagagtacttatatttggatggttatgtgagagaaaaaaataaactatcatgtttaagccatgatattttgggtctttttattacagcatttgtgtggtaggtagaagttttagatcaggggtccccaacccccgggccacagactggtaccagtcatggcctgttaggaaccaggctacacagcaggaggtgagtggtgggtgagcaggtgaagcttcatctgtatttacagccactctccatcgctcacattactacctgagctctgcctcttgtcagatcattggtggcattagattctcataggagcatgaaccctattgtgaatagcacatgctaggtggcatgctccttatgagaatctaatgtctgatgatctgtcactgtctcccatcacccccagatcggattgtctagttgcaggaaaacaagctcagggctcccactgattctacattatggtgagttgtataattattatatattacaatgtgatagtaaaataagtaaagctcacaataaatgtaatgcatttgaatcatcctgaaaccgttaacccctcccctggtccgtggaaaaattgtcttccactacactggtccatggtgccaaaaaggttggggaccactgtctctgagatttcctgctctctagtatatatctccctagtatacgctgcatattccatgggactgtgaatgtgacaaattttacttatgtgagaaggttataatatatggcatagttgactgtaagagcgattgtctgggtgggcctgatctagtcacatgagtcacatgagccctttaaaagcagagtgttttctttatggttgcagaaggggacatcagaaaagtgtgaagcatgagaagggttagaggcactgttgttggcttgaaaatggaggaaccacatgtcaaggaagacaggtggcctctaggacctgagagtggctcctggctaatggccatgaagaaaacagggacatcagtcttagaactgcaagaaactgaatcttgccaacaacaataatagcttggaagtggatccccccacaccccccaccccctagagccaccagatgagtagccccgtcaacatgttgacttcaggcttatgataccctgagcaaagaatccagtaaagtcatgctggacatctgatctacagaactgtgaggtactacataggtgttgtttttaagctgcttagtttgtaataacttgttatgcagctccagaaaacttgcgcgttagtgggggttctccagagaaacagaactgataggctgagaagtcccacaatctgctgtctacaaactagagaaccaggaaatctggtggtggaattcaatccaagtttgaaggcctgagaaccaggagcactgatgtccatggacagaagatgaatgtctcagctaaaacagcaagtccaccagctgcctgtttaaattctgtttaggcaacagattgtacaatgcccatccacattggtgaggatgatctttacttagtctacctattcaaatactaatctcttccaggaataccctcaaagacacacccagaaataatgctttaccagctatctgagcatcccttagctccgtcaaattgacaaataaaattaaccatcacagccgggcataatagctcgcgcctgtaatcccagcactttaggggtgaggtgggaggattgctagaggccagaggctcgagaccagcctgggcaacatagtgagaccctgtctctacaaaaaaataaataaataacagtcataacttgtgtatctcctaactgatacacaagcagacagcacagcttgtatgtagtctgtgaggtgggggtatggctggtgtgattcaggcacagcagtagtagagtgtgaatgtgaagagagaagcctacagaggtagcaggcagttatcagcaatttgtaggccatgataggactttggccttcagctgaaggaattagatgagggggcattagtgagctatgagcagaggagttataggatctgcctatatttgaaaaggatcactggctgctctaaaaagaatggattgtaggggcaatggtgagaagcatgagaaggatctgaggcaaggagaacagttcaaaggctgtggaaaaacccaggtgagaaatgatagcagcttagaccaaggttgtagtacttaagatggtgggaaatagttggattctggatatattctgaaggcacaaccagcagaatttcctgaaggattacttatggagggagggggagagagagaaagagaaagggaaaaagaagagggaaagagaaagaaggggtttggaagaggtctcaaagctgactccaaggttttggtgtgagaaaccagaaagaatggatttgccattgactgaggtgggaaagacagtgaaaggagcagcatttctttggtggggaaagggtggttaggagcctgcttttggacattttaagtttgagatacctataagctctccaggtggagacattaagtaggcagttggatatactaatctgatttcagaggagaggtgggctgaatttctttttttattttaatcatcaacttttttttttttttttttttttttgagatagagtctccctctgtcgcccaggctggagtgcagtggcgcgatctctgctcactgcaagctccgcctcctgggttcacgccattctcctgcctcagcctccccagtagctgggactacaggcgcccaccgccacgctcggctaatttttttgtatttttagtagagacagggtttcaccgtgttagccaggatggtctcgatctcctgacctcgtgatccacccgcctcggcctctcaaaatgctgggattacaggcatgagccaccgcgcccggcctcattcaacttaatttttaaaaattagcccctccataagcccttccccaaaaaatccccctccccccgtgccaaatagatgttgagctccttgagatcaaggattttgttttattcgggcttcttttggggaggtgggatagggtagatggatacgttgggggtggggatgggggagtaccaaagacataccaaagacctggcactagtttagatactcagcgaatggatataaacacctgcttacgacaccctctggattgctagtctcccgagtcaaccgtactgcacgtgcagttcagaccccgcctggtcctctacaggtccctgtcccaggcaagccttagcccacaggttgaacctagttctgcccctccaggcttgggctctgccctctcggccccgcccatatcggaccctggcccctcctctttctggctcccccggatgctcctggcaaagactcggtccttctggaatcttgtaacggttctaacagctgggtgcgggtggagctgcgggtgagtcctcggctccggatccatttctctttgttccctaggaccccctcccacagagtccgcctcctcttccccgctctcccagccccctcctttgcctgttaacgtcttcccctacctgcatcctgaccatcatttgctgtgcctgctcctcggctttctgtcttcacgacctccttaggctgtgggcgaagacgtcatgggactggggctctgctgccttcgagtgacgacctgttaacccgtttttcaggcgatcgccagctcgagtgcagattccttgctgtgaccgaggttcagagtgagctctgtcggtgtgtcagtttgcctcttcaggtgattgcacgtctgtgtgcgagtctctccgtgtatgggtggctatgattagggtgagcctcagactggaactcaagtctaagttcattcactgctccagcaggcactcttcaatgaaacctcatcagcagatcgggctctcttcccttgccttgcctcctaacccccctaggccaggtgagggggacagggtactgggaggtaagaaggaactcttctgcaaggagggctctcacgtctgtcttaggcctgctccttaccagagtctttggggaagcagtagggagggcctgagggtctcaggaaaggctctctgctggtctggctctgctctgtagctccatctatttccctgtcccaggtcctttcttcctcctaaccccattgactctgaccatcccctgcccagagcctgaggtcccttctctggcccctctgctgggctggcccatgcaggtgaggccccgcatctggcatcctggaactggcagttggagcctgagctatgggcaaggtcacttcgacagcagttgaatgcccagctcctcatggtcccggaggagaggagggtaggtttgtcttctgatgagacatcatctgattcccttaagtcttggcactccatatgtgtcttggacagcaaagaacagcccttggcctgccagcagaaacagaggcagttcgtgaagccagtgactgagtcagagcagcccacagtgctggaactcctgctagctgagctccgaactctgttctcagctgtgttgcaggacagtagccctgcagcttggcgctatcttcatgcagtactgggtctactgcctccatatcgtgagttgctagttggccaccttgatttgctgcccttcctggagcagctgtactgctgggcaccctgggtccaaacccacctccatctggacctgctaggtgccattgtccaggcctttcctccagacagctctttgttagacagtgcttcccatgctgactgctgtccccagaagcggaggctccatcacaggcccccatgcccagcttgcccttttgtgcaggcccagtggagcaggcagcaagtaaaggaggagctggccacctggctgcgaccattgacactgcctgagctacagcgctgcctgggcattgttggtgctcaggtggccctagaagaggctgtgtggctggatggacttagtctccttcccttggcactggcagcggacatccctgtacggtatgaaagcagtgacactgacaatgcagaggtggagcctgttggaagaaaagagaccaggtaagtgagggactcagtctagggcttgagcagaggagaaaaagttgctgttttatgggtgcctctggggtcacttggaagtttagatccagctctctgtttatcacagggattagcccaactccacacaaagctagtgtgaggctactttcctcttcctttttctctgcaaaataaacccagtggtgttagtcttaatccccatagagaaatacagaaattaatgaaaatcagaagtcagctatgaggcagccaaagctttagaataacagcttgacttttcagtttccaggtttttttcttagatgatgtcagaagtctccttaattatttttctataattcattcataatcactgaacattgcctgggcctactgtgagttgattcctggatgttgggtctttccctcaaggtacccctggggaatgtgtgtccgagtgtccttcccacatgtctatgtgacttaaaccggctccaaggcagagtggagttggcagcactactggatagaatttcattttgacccttccagagtcttcttcttgccctgccagtgtgggcactctggccccttgagtgatatatttttcttttgtttctttctttctttctttccttttttgagatagagtctcactctgtcgcccaggctggagtgcaacggcatggtctcggttcaccgcaacctccgcctcccgggttcaagtgattctcctgcctcagcctcctgagtagctgggactacaggcacgtgccaccatactcagctaatttttatatttttagtagagacggagtttcactatgttggccaggctggtctcgaattcctgacctcatgatccgcccacctctgcctcccaaagtgctgggattacaggcgtgagtcactgcgcccggccctattgttttcttttttaaaatatctggctatcagagctctctacaggatttcagaatgcttacagagaccttctcttctcagcgttctctaactttcgatttttttttttttttctgaaacagagtctcactctgtcgcccaggctagagtgcagtggcctgaccttggctcactgcaacctctgcctcacaggttcaagcgattcttttgcctcagcctcccgagtagctgggattacaggctcatgccaccacgctcagctgatttttgtattttcagtagagacagtgtttcgccatgttgaccaggctaggtttccaactcctggtctcaagtgatctgctcacctcggcctcccaaaatgctgggattacaggcataagccaccgtgcccaagagagttttttaactttagttttggaattctccttgtcctctggcctcattttctagacaatgctttgcagctgtctgtggcacatttactgttcgggaagaaggctagttttacctttaattaaggttggcttcctcagtttttgctgtaagtttatggctgggtcaagtctttccattaaagcctaatgttagatagataggcaggctcctggggccctaatgggaggtggccaatgccataaatttatggtggccctattggaatcttttcctttttcaaagagctgccctgtgccttgagtacaagtttcctttcctgggagaacttgactgaattggcatgggctgagatgttgggaagggatcaagttctttgccctccctttgaacctggcagtaaacctctgaggtctagctaatatggcttaatttgcattacgttctcccggagtggtttgccaggcattcattcattcaataagtgttggatagctacatttattaggatctgcaagatgctagggatacagaagtgaatgagacagactcaatcccttcacttgaggtattacagtttagttagggagatatagttaagttgataacaagtaaaatataattacaaattgtaataagtgctataaaacaaaagaatactgtcttttgcctggctgcttctctgcaggtgggagagagagagagagggagtgtagttagggggaaagcatgtggggggagtgttcaagtctagattagattaacaaaaacatcaaacagagtttcaaggaggagggagcagtcagtagtattacatgttaaatgagacaagtaagaagaatgaaaatgttcattggatgtagtaacaaggaagaggttaagttttgtggggaggaagctagattgtggtgcattgaggagtgaatggaagatgaagtggaaatcgcattttacgattttttttgtgaagcttagcttgaagggaaaagacaaatagcagggcagcagcttgaaagaattttggtgtctgggtagggattttttttttttttttgatagagagatgtttatatcccttaacacagtgcttgagaagtaggtgctcaataaatattcgtagactaaatgaataaatagactaaggtaagaagaagagtagattaaaaatatatcatagagaataaggggtccagagcactgatggaggaattaatcttacagagaagaaaggatacctcttcctctgaaatcgggggacagataagtgtgtgggggaaggcaactgaagttgagggaattggctaatggctgaaaacttcagctttctccaggcagagaaggagacagagaatgggatggaactgggagctcagcagggcttgcatggggttagggatagcagtttgagaggcctgaaagaggtagctgtctgaggacttgtgtgaagacatcaggcagaatgagcccacagctgattggacaccaggaacccgtagaggagcaaatgtccttggttttgcgatcttctgaatatactatataatataggactttgctgagaaaatgaacctataagagcaattataccatttaagatgtcctgatccaacacaacagttcatcaaggacatatgtataaaggttataaaccatattgttgatatgaattctagaataggattgcactgttatccctggggaaacttgtgttgatctaagtttgggtcagttaatgatactggtatattctgactggctaagtctaagttaaatcattccagagttttttttgtgtgtgtgctctcaggtctccccaactaaaaattattagtcattcacttttgagttattggtaactaatttccataccaattttgttgaccagaatgcagaagagtaagaggatgagtgtattggtgcaggcttgagggggccaccattggatcttggcaggaaaggaaagaatatgaagctagaggttgggtgatggtaggggaagagcagaaaatgtaacaggcatggagatcattcagggttggaaagcaggtataatggaatcaaagataggatattaaatctgaaaggccaagaaggttgagctgggaggggaaatccagtactgtgggcttacagagcaatgagttgggaaaataaagtcttcccattatttgtacacagtattatgtaatactgacttcatggtaattccaatcaatccagaatgattatttgtttatcagaaagggagaggttgctcacacacatgtttgtgtcaatattgttgcctaactgtgttctatgatacgctatatttgcccagtatgtggtatctttgagtatagatggtagtcaggctcgacaatgccacgtcaggtctcctcaggcacctgatctagtcctcctttcactagccaacagtggcaaggcctccctctaaggtacttgacctttttactctgccttttctctcctgattttctgtcacacaggtctcagcttgactatgaagttcccagggaaaaggccttccaaaagagcagcaccggcttttcacctgagacttccttcctggatagccaggtgatgactgctctgaagatggagagatacctgaagaagatccacttcctctatctcaatgtggctcccagccggtactttaggtgatagcctatgtccaggccccttctcctccccctgcctggtttccttctatgctatcttccccctcctctttctccacgtgcgcacccttctccctgtcctttctccacatactcctcctctgactctagtgtccctctctcttcccttctcctcagcctcctcctcctttccactctctacctccccttcactccctgttgcttacacagccttttgtcttacacatccttttctcacattttgctctttcttttttattctatcctagaatgatagaaacatttgttcacagccttagaagtaaattttatggtgatctattccaactccaatggaagaaacatgtgtttgtttaaatctttacagtgtcaggaaaatttttttccaggtatcttgttccttagactgaatcaaaatctgcattcttttaacttctacctcctggctctagtttatctatggggctataaaaacaggtctcctccttccccatgactcaagagacatttattcacttcctctcattagatccaaatcacacctacttttaaaaatttcttcttattattttgaagcaagggctcactctgtcacccaggctggagtgcagtggcacaatcatggctcactgcagtctcaatctctctggctcaagcaatcctctcacttcagcctcctgagtagctgggattacaggcatgaatcaccacactcggccagttttctaaaatttattttttgtagaatgaggtctcactgtgttgccaggctggtctcaaactcctgggttcaagcctcagcctgccaaattgccagaattacaggcatgagccaccatgcctggctcaaatcctcgcctattttaaaaagccctattcaagtccatctcctcccagaaataattgtaataattgcctttaaccaaactcttcaatatattaggcattgtgctaataaactcatgacatgtgttacttaatcctcatctaccaggtaggtgctattattatttctatatatgagatgagtggactgatacataagagaggttaagtaatttatccaaagctacataataaatggtgtaactaggatttaaacctaggactatcttaatccaaaagttcatgctcttaagcagtatctaatacagcctcccaaataaccttatttcctgtgcacactgatctcttgaacttaggtagcactaatgatcaatatcattcattcatttactgatcaattcatttaataaatgttcactgagagcatcctgctggttattaattgattgcctcttgattctaattctcctcctccctctctgctttgtgatactggggctgagattctgcaaactttttctcttttttcagctggccttctattaggtttgattaatggagagtgctgggagactggacagcaagataagaggggaagggacttgctgcttcgtttgcttgctctttctgccatcattgcctcagcaatggtctttcaccctggcagcagcactttctttttgtcttttttgagacagagtttcactcttgttgtccaggctggagtgtaatggcatgatctcggctcacagcaacctccacctccctggttcaagcgattctcttgcctcagcctctgaagtagctgggattacaggcatgtgtcaccacacctggctaattttgtatttttagtagagacagggtttcatcatgttggtcaggctggtcttgaactcctgacctcaagtgatccacccgcctcagcttcccaaagtgctgggattacaggcatgagccaacgtgcctggcccagccagcactgtctgaatcagcctcttcataaccctgagagataccaacaccagctggtagcccctttccttcagagttctttttgttgttgttctttttttagacagtcttgctctgttgccccagctggagtgcagtggcttgaacagagcttgctgtagcctccaccttctgggctcaagtgatcctcccacctcagcctcccatgtgactgggaccacaggtgcctacaaccatgactggctagtttttaaattttttgtagatatgggatctcactttgttgctcaagctggtctcgaactcctgggctcaagctatcctcccttctcagcctcccaaagtgctgggattacagacgtgagccattgcacccggccccattcagagttctgagtctcaactctgcaaggcccctcctccaacctcatagcttctaataacctgaacctcttccatttgttcctctagttctggagctggttttttatttttatttttattatttttttttaagatggagtctcactctgttgcctaggctggagtgccatggcgatcttggctcactttaatctccgcatctccgcctcccaggttcaagcgattctcctgccacagcctcccaagtagctttgattacaggcacttgctaatatgactggctaatttttgtatttttattagagacggggttttgccacattggccaagctgatctcgaactcctggcttcaagtgatccacccacctcagcctcccaaagtgctgggattacaggcgtgagtcaccgcgcctggcctcgacatctttttaaaaacacattctctttattaaattcactttgttgaaatgcctagtatggtttctgttttactgactggaccctgactaacacggtacttggtattatgagtggtcccaggaaactagcctctaatataggatcttctttggtttggtaatgtccttggcctaaaacagtactgaattccttgctaatgggaaataggatactagtaatccatgacacacagtggcatcacaattaattaaattatcacttgtggttgaatgtgatactgacacctagtggctgctacacttgactgtcatggctgtaatgatagtaatggtaacaatgtgggatggaatgcctacaaaccatagttgggagcttacagaaagcaaatgacaagcttagggctttaaactatcagcatcttttataattagagaagcatctcgatcaaagacagttaggcacataaagagataagaaactattgacaagagaactaaaaaggcaatggatgattacagggccaggatctgccaaagaaggaaacccattgcagtgagttcagcatttggtgctgcttttccccaaacagagggacctctcaattcctctcaatataaaggtagttaaatgtcaattttactatgcattcctgagatactgaaaagaggagccaagctttcaacagactcagggaactaaatgagcaaaagttgcagttcaggtcccataccaaaaaggaggtatatttctggttccactttactcctgtgttgtagccatttggggtctcgacccaaaggctgggggattacatttttgggttctctgatgtgttatacagatattatatttcatatattatccagtttcatatattatccagatagttggcctagtttttctagttgttatcaagtgggaatgttggtccaaatttctagtgcaccatcaatagaactctttcacttgctgtttcattatatttatttatttgccatgtaacagatttttttaatgtgtttgaatttatcaaaattttaattgcattttctccagtgtttgatttacatttaggagagaatttattccttcacctcctttattctttgagtctttgctcagctgtcactcccccacccttaccaccccatttaaaattgcacttccttctcccctggcaccgccaatctccctttgcctgttctttttcccccttcctgttgttaattacgtttatcatcttctctagtagaatgagagctccatcagggaggggtttgggtttgttgtgtttaatgatgtatcctcagggcttagaacagtctggcatagagtagatactcagtaatattcgttgaatgaatgagtgaactaattgcccagattagggacagatttggtgggggtagatattgagtttagtacagaacttgctgagtttcaggtgcaagcaagatggagtttgagatgttttggaaacagctgaatctttggttctgggactcaggaagatactgatttcccccatctactctctagtatcatgtcatactccagttgattctgagccctttgaggacaaggactatgtagaagtcatctttatgtccccatctctgaccacaatacttgaacagagggacaacttgataaacggtttaactaagttccataaagtcagggactggatttttcttgaacactgctgtatcctcagtggcttacacactgcttgccttaataagcatttgtagaatgagtgaatatcctccaaaggatattcagcaaaatgcacctatatcccacattaaatgcaatacatatggattgatataataggtgtatctagttacagtaggccagttagcataatgctatgtttagatacatttaataaagcatttatttttatttttcagttttctttatataactcagagctagcaatatttttaagcattacatatatatttggagtatattttatactccaaaggagtagtggccattgggaatgagaagagtactgtataactcctggccctacacagaaacagcagcctccattaagtaggtcataggaaaaggaaatatctcttgggaagagccagggctcagttaacataggcagctacactgtgggaagctaaatggcccactgattaaaggagggggcatgagtcaggtaactttggttttaaatcctgtattcttcccttaactgtcttgggcaaagctttaacttctctttgtttcagttttcctatctgtaatttggggatatgagtactatacttaagaaactttagtaactttgtcaaaaacaaaacaaggtttttgtatgacttgacttagtgtgtccattctggtatctatctaaaagttcttaagtcacttgcttaacaatgttttctagaaagttgagagagatgagagatagaggagagctattttatctcttagacattataggacttaggatacagcttttaaattgctaaaaatatatgtaatgcttaaaaatattgctagctctgagttatataaagaaaactgaaaaataaaaattaataaatgctttattaaatgtatctaaacatagcattatgctaactggcctactgtaactagatacacctattatatcaatctatatatattgcatttaatgtgggatataggtgcattttgctgaagtaagagaacccaagaccaactaagattttaagatggctctgaaggtacttgtctagtacattaggttgcaattttcctctttatttgcctgtttcgaattttctagtcttcctctgcttttctccaatctcagtttttccatcaaataacattctgattgtctctgcatgtctttcagtacccaagtatatgtgtattttatcatgtctagaatgaggatttttcacatttcatcatctctaaaattgtgatgcatcttacaaattgatggaatatcttattagaagcatttttatcttagcatttcataagataatgctgcagcttacggtggacagtgtcttagatctgatgggatgtaagatatctgcatttgaagatatgaacttcttggagctggctaggtgcctttttctttcttcccatctacctttggcttcggtttcttcttaataatatttgtttcatctttctagtttaaaaatcattctgctctctttgcccctttttctcctttcttctgcctgccttcctgttcccctttttcatctcctgtatcctcctttggtctcttaaagtctgaccacgttcccagggccttcactgatcagagctctttttttaaaggccttacagcctgatggtggtgccacccgacaaggtgaatcccgagcactacatcttctctccctttgggatcttgcatgtacatcctgtggaaggtagcgagacgatgacactgggtacctggcaccatcactgtgttctctggcagcagctccagttcattccattctttaagtattgcctcttacgcaagtcctttacctggtaggtaatgacggatatgtgatttggggggaaatggatgacagcaacagtatattatcactgacctctaatttctagttggaagaagaatgtgagattacaggggctgcatcgactccagaaattcctagagaatcatctgctcttggctgtgccccactttggagctgggctactccatattagcaggtgaggtattaaaaacacaacttcattgagtttttaaaaattagttttactaaaggtaatagtatgtttgttgtagaaaatctgaaagatacaaaaaagcactaagaaaaaacctttaatcctaccaaccactatgaacattttgttgcatatctttctagtcttttttctatcacatacacaaaatgtgatcataccttacatactgttaaataaccagttttttctttgaacatatattctgaactagattatattctatttcatgaatagaatatattctctatggagaatatatgcaatattctccaggtaattatatatcttaaaccacttgcactcacgtaattatgtgtaatgtcagatctgggggtctaattcagttgtttgaatccaaactctgtgttctttccaagatattacttggattctatttttcttttttttggaaaaggttggttattcctattttcagtatttccttgctttccctacatgactcctcagctactcttaggtatattctgtgacaggagttgcaaattcagttgcctaaagggcctaagcaggaagtattgaaggaatgcagtggtttaggtggaagacattagggagcatgggaactgcaatctggagactgcatctaaagaggatagtcactactcagttccaactaattactaattgttgctgtttgggaatataggtccagtgtgatcagctaccttacatttcaggatttcctagaaatccacattttgttatgaaatttctcacttttaactcaaatttcaaccaaattttaactcaaaagaatttttttttttttaaatggagtttcactcttgtcgcccaggctggagtacaatggcgcgatttcggctcactgcaacctcctcctcctgggttcaagcaattctcctgcctcagcctcctgagtagctgggattacaggcatgcaccaccacacccggctaattttttttatttttagtagagataaggtttcgccatgttggccaggctggtcttgaactcctgacctcaggtgatccacccacctcgacctcccaaagtgctgggattacaggcgtgagccaccacaccagaccttcaaatttttattaaaacactgtatgctagccaactcttagtgactcattttgaaaaacttttccatctgaatttaacccagtttgtaacttctgctctagggagtttcatcctccagtctggcctaatcatcatggtgtaattaagagcataagggcttgggagacgggacaaatcttatttagaccttgagtactagcaagggactttagtatttgagcctcagtttcctgatcttcaaactcggataaagatttctagatttaattctgtaatgagaattaaacgacactgtgaatacaaagtgccacattcagtacctctcagtagacactgaataaatgatgcccattgtgaccatcctgtctgattattaggagtctttatccttttcaaggatgtttacagttgtggagttctctggggcttgggaggtatggataacaggattgggcttcctcagggatgggcagcccacagagaagttccagtttcatcacatttgatcctaaaacttacctgtccacctagacttttaggacctttagctttctctattccaaggaagaagcctctgctgtctctccttctaagtcagaccttggtatctatttgaccctctcttctagcagagagatcactaggtataagcacttgcacataccccaagccttttctcagcttgtatagctgagaaagcagctttatgggcttatactctttcagagaactctcgagagggagctgtcactattggtcactgttggtaatattacaatctctataaatatttgtgcagtctgaggtaagctaggctgagaagaggtcaaaggtatccaaggaaggattgggatgccagctctgaccagcttagtccttgattctaggcttctgcaggagctacactctgtgtcctggctaccccaggaactggatcggtgctatgagctgctggacctgcagacggctctagccgaggagaagcataaggctctacggctgctccatcgttgcctaaacctctgcacatccattcttcgactggtaagaggctcttagtttattgtggacctcttccccaagttgagctccccagagtttcagcctcctcttagttaagtttctcctggaatccactgtatgacctggactctacagttgaatcagagccattttcctgcccagcaacagcagtttctgctctaggatggatgaatcaataacaggtgtgcagaggcttgaactagacctttccctaagggttgatcttgacctaggagcagggaggagaaggaatgtatcaatgtctattttgtctgttgtttatgctgacctttgggaattagggaatttgagaacaggaatcctggtcttttatgctgctgagcttatttttgaacctatcttgaacctttggaaggccactgtagttagtggaaggatgcaatgatggagtccttcttaattatgcatatgttgcatctgtgatgcacaacccctgcctagagttctgggaggccctcctgtgtactgacctcttgcccatggtctattatcatggtttgttgtcaggtggggctggatattcacacaggactgtggctaattaccatgtgtagatagtccggttctgagagaggaggcccactcagattttgtgaaaataactaattaatgtgaaggaggcataccttgcctggcttgagccaggttttgggttctacatgttgctctaaactccatcagaggaggttaatcacaaaggacagaactctgaagtctcaaaaatggcctcaactgcaaggaatttcttttctttttctttctttttttttttttttttttttttttttgagacggagtctcgctctgtcacccaggctggagtgcagtggcgggatctcggctcactgcaagctctgccttccgggttcacgccattctcctgcctcagcctcccaagtagctgggactacaggcacccaccaccatgcccggctaattttttttgtatttttagtagagatggggtttcactgtgttagccaggatggtcttgatctcctgaccttgtgatccgcccacctcggcctcccaaagtgctgggattacaggtgtgaaccaccgcgcctggccgactgcaaggaatttctgttcctaggaggaaccaataacttctgttgattgctctggttgaaatcttaaatatttaaaaatacccgtaataaaacattttcataaaattttaaatagtcaaattccttccccttctaagaattacctgtcctctttatcctactctgttttcctttttctgtcttccttctcacctttaaaaatactatataagttacttactatttttactaatgtctcatgataggttgtaacctccacaagggtagagatctttgttttgttcactgatgtatcccaggaacctagggatattattgaacgtctttacacaaagagcctctgcatttttacgactttgcactgattggactcttcagtgatatcttctttggatgttttagaagagtggctaaaaaaggaaattcatagtctctctttaggaggtttagaggaaaggggccaaaggcattagcaatgtcaagatcctaaagccaaggtgcaggagtgaaaaggaggcagtggcctttagcttccagacaataaatgctggacctgccattgtaccaagctgaatgaggcaggagatgggggtgagctgctccacagcctttctctacctctcagttcctcaatcccacctttaatgttataaaaatagttataactttttgaaattcagtagtcaattttgtatattaaggtataattcatatacagtagacaaattttaactgtaaagttgttgaattttttgcatttgtatttgtattgctatatatttgtatacctggatcacgatagagaacatttccagcaccccagcaagctccctggtgcctctttcattgatacccccgcagaggtaaccagtactctgacctgtgtcaccacaggttaattttgtctcattttgaatttcatgtaactagaattggacagtgtgtgctcctctttgcctgacttttttcactcaacattatgtttgtgagatttatccgtaatgttctaggtagcagtggtttactctttttgtatagctacgtagtatttcactgtatgaatgaccacaatttatatattcattcttctattgtggacatttgggttggttccagttttttactattatgaataacactgctgtgaacattcttgtacatgtcttttggtggacataagcatttatttttttgggatatatatgccaggagtggaactgctagaatagaatatatgtatgttttatactgccaaacagttttccagagtggttgtaccagtttacgtttccatcagtgatgctgatttccagctgcctttcattcttttttttttttgagacggagtctcattctgtcgcccaggctggaatgcaatggtgcaatcttggctcactgcaagctctgcctcccgggttcacaccattctcctgcctcagcctcccaagtagctgggactacaggcacctgccaccacgcccgactaatttttttttgtatttttagtagagacggggtttcatcatgttagccaggatggtctcaatctcctgacctcatgatccacctgcctcagcctcccgaagtactgggattacaggtgtgagtctggctgtgtctcccaggctggagtgcagtggtgtgatctcagctcactgcaacctccacctcctgtgttcaagtgattctcctgcatcagcctcccaagtaactgggattacaggtgtgagccacaacacccagctaatttttatatttttagtggagacagggtttcaccatcttggccaggctggtcttgaactcctgatctcaagtgattcatctgccttggcttcccaaagtgctaggattacaggtgtgagccactgcacctggcctcagttgcctttcattctcaccaacacttattttttttcttttccctccctctctctctcctctccctcctttcctttcctttcctttcctttctccctccttccctcccttctttcctcccttcctccctttttctctccctccctctcttcctccctccctccctctcttccttccttccttctgtgattttgtattttgatataatttcaaacttattagaattgtaaagatagtaagataaactctcacataccctttatatagattgttatttttcccatttcctttatcatttatgctctttttttataaacatgtatacattattttctaaataatttgagagtcaattgaaggcatcagcccccttacccctgtcttagtttgttttctgttgctataatagaataccaaagactgggtaatttataaagaataaaagtttatttggttcatggttctggaggctgggaagtccaagagcatctggcgagagtctcatcccatggtggagggtatcacatactgatgagacatgaatatgagacagagagaggagagaggaaatcaggcaaaactcatcctttttatcaggaatccattcccatgataactaacccactcccatgatcagaacattgatcccttcatgtgagttaagccctcttagctcattgatcccttcatgtgggttgagccctcttaaagaccccatctcttaaaactgttactatggcaattaagtttccaacacattaacttttgggagacacattcaaatcattcaaatcatagcaactcctgtatatgtcagtatgttttttctgtgaatgaggacatttcattttataactatagtacaatgatcaaagattaggaaatttcactctgatacaactctgttatctaatctccaatctttattcaaaatttggcaattgttctaataatgtcctttattactatattttttcgttcttcaggatccaaaccagaattatgtattgaatttagtgctcacttctgtttagtctctcttatatggaacagttcctcagcctttgtgttttccttacttgcttcaaggcatgacaactctgtaatacgattggaacattccaagcctccttccccactccagatgagaccaaaaatagaatttagctgagatcttgctgggtactttccccttctcttttctgcttttttttttactcctgtagaggctcttgtttccctgaagatcattccttcaataaatcacatttctcccaatccctgtctcagggtctgcttctggggaactcaacctaaaagaatatgtattaggccaagctcattcactgttttattcaaatattctatagacacatttttttttttttttttttttttgagtcagggactcactctgtcacccaggctggagtgcagtggcatgattttggcttactgcaacctccacccccttgggctcaagccatcctctcacctcagcctcttgagtaactgggactacagacatgggccaccgtacctggctaatgtttgtatttcttttatagaggcagggttttaccatgttgtccaggctggtctcgaactccaagctcaagtgatcctcccacctcgccctcccaaagtgctgggattataggcatgagccaccacacccagccaagacacaataattttttaacctccattgtctttcagtttctgagaggtatatgttaaatatcccttcctacctacaactatagatttgttcatttctgcttgctgttctttcagtttttgcaacatgtattttaaaatcatattttaaactcattttaaaatacatgttttcactctcttttgttttgtcatagtactctaatcactttttttttttttttttgagatggagtttcattcttgtcgcctaggctggagtgtagtggcgcaatcttggttggctcactgcaacctctgcctccagggttcaagtgattctcctacctcagcctcccgagtagctaggattacaggtgcccaccaccacgcctggctaatttttgtatttttagtagacatagggtttcgcctcattggccaggctggtctcaaacccctgacctcacgtgatccgcccacctcagcctcccaaagtgctgggattacaagtgttagccacctcgccccaccagtactaaccacctttttatgtacaccataaattatgtatttattatgtttgctgtctctctccctcctcctggaggggcaatgacttgagcactcattcactaatatatctctagtgcttactgtagggtatgccatttagtaggtgctcagtaatttttgttgagtgaatgaatgacaagtatgaatttttaaccatatcgttctcccaagcagaataagaaccttagcattatcatactttcctttcccttctctcttcctccctctattcttcccattactcttatattggtatctcctggaatcttcttcaagattgttatgaacattcttgttttataacctactcctttgtcttagtccactcaggcctctataacaaaataccataatctgggtggcttacaaacaacaaacatttattcttggaagctaggaagtccaacatcaaggtgatgacagattcagactctggcaagggctcagtcctcataggtggcaccttctcaccacagaagggactagccagctctctggggccttttaaaaataaaattgacaaataaaaatggaatatattcaaggtgtacaatgtgatgacttgatagatgtatacattgtgtaatgattaccacagtcaaattaattaacacatccatcaccacacaggctgtacattagattcccagaacttgttcatcttataactaaaagtttgaaccctttgaatagaactgtcatatgatccagcaatcccacttctgtgtatatacccaaaggaaatgaaatcagtatctcaaagagatatctatacccccatttttattgcaggattattcacaatagccaagatatagaaacatcgatgtgtccatcaatggatgaatgattaaagaaattgtgatattaatacatatatacaatgaaatattattcagtcacaaaaagaaggaaataatgccattagtgacaacacgtatgaacctggggacattatgctaagtgaaataagccagacaaggaaagacaaatactgtatgatctaggacttcttttttttttttttttttttttttttttttttttaagggcactaatcctattcctgagactggagacctcatgatctaatcacctccccaaagactccacctcataataccgtcaccttatgggttcagatttcaaaatatgaattttggagggacacaaacacacaggccatagcactacttaaaattaacaatatgtctcacaaatttctttgcccatcaaatcttttgtagaatactttatcctcttggattcattttcctctgcatggaatatattaatactattcctaattgttttaagggagaatctgtggatggaaaattttctgagtctttgtatatctaaaaatgtttttatttatcctcaaactttaatgatattctggctaggtatagaattccaagttttttattgttatcattacttttgagacagaatctcactctgttgcccatgcagtggcatgatcagggatcactgcagcctcaacttcccgggctcaggtgatcctcccacctcagcctcccgagtagctgggactacagcagttgataccgccacgcctggctaattttttgtattttttgcagagatcgggtttcaccatgttgcccaggctggtctcaaacttctggacttaagtgatccaccctccttggtcttccaaagtgctgggattacaagcatgagccactgtgcccatcctaaacatttttttcacataatttggctgttatcacccctagtattggtgctttaaaaatgtatactgattacgttctatggtattagcaattattattgttgtcgttggtatggttttatcctaatggcactcagtaggctctttcaatgtgagattatacattctttttacaaacatttactgtggaactaccccatgccaggcactgtgtcaagcaatagaaaaatgaaataaggtgtaacagagatcgcctcctaaaggagcttacagtgtagtggatgagttatataaataacaaaatgatggtgcattggactaagggttatgaagtgggaagcactgggtattagggagtattgttagaacatggaagaaaacatctcacttagtctcatatacaaaatcatcttatgcatagggcatgtttgtatatgatgtcccgtgcttaggacttaactgtcttatgcttgggtctgagaagactggggcttgagctcatggataccagaagtacaattcacagaaccaatcagttctaatcacaagctctagggagcatcaaaaggaacaggaaagcagggaagacaaaggatccatctggccaagcatagctttctggtacctcttctctgttcctcaacagtaaaagcccagagcattggcaattgtcagcagcctttataggctgaggaacctcccagatctgaaagaactcacaaaaaggctcccaggcttttattccacattccctctcctctaatagaaagtctatatcagtgcccagaaacagcttctattataacataaaccaatatcattctactcagcaggccacatcacctagcctaattattatccagagtccatatcctgaaattattgtttagccttatttatcccatctttttctttttgtctcttctgtgcattgtgaacctctatatttacatatacacaaattttctgagttccaccctgggggttttcagtagacaggcctggcctaccacattagcacactgtgacctctcaatatatgttctctatttcacatcttctctggtcaaataaaatttgagggggtggggtagggtaaactctactaaaaaggagccctccatatgtatatctaggttctaggtcccagactccaagacctgagagtttgcacagactagtgggtggctggtttgctctccatccccctatctggtgagtttccactctatgctcacaggttcacgaggacacataccacatgcaacagtgcctacaggagcgagtacaaaactgtgacaggatcaggacaggccaaggctccatataccttcagagggtacagcacaagcaactggagcagaagctgaagcaagcagaggcctggtggctgcagctgggaaagtttgcccgcctggttgactacatgatttgtcagagcctcatttctgtcttggaagagcagataacctcttttgtggccaacatccttcaagtgaggtggtgggtggcatgtgtggaggtggcaggcagtccagggccagatgctgaggaatgtatactgacatctagcccctcgacctttcctgacccttttttttacaggccccaaggcagaaaccctttctctcatcacagctggtctttgatgatcatggtcaactgtctcatgtgccctgtgttgaaaatatgatccagactctaactggaggcctacagtctgtcaagacctctgccttgcaggtattctgaattgggcagagagctggctgtgggaattcccagttcctatcctctgagtaatcagaagctcacaacctggtttgaatccctcattgctttcccatttctgccccttctccatatcctggcatgaaggtagtgcagtctgcagacctgaagacctcctcggattccctgtattctgaaggtatttagggagacctaggcagggggtaggaaggctgaaggagggaaagggcacaagtactaatggcatgggaagaaggcaggaggtccaggctatagagtcaggcactgggtgtggatggagcagctctaacctgggtactgcacatatgtgttgtgggtagaaaggtcagggaatgtttttgctcacaaattcacgtggttatgtgtatgtgcgtgcaatgagagggtgtatgaaagagtgtgagtacattgtccttccaaacctgattcatcccaaactctgtgaggtttttctccagtgccataattgcatttcatttactactgaattttattgctaagtaaatttgtacttgtttgaagagctctgcttgctcaacacttgctttatgtcatatagctctttttcatttcatatggattaattcattgtattgaaatattttatggttaccaattattattggttatcagtcttcacacttattaaccatcagcgtggaaacacatcttcacatttcccttatttaggatactaatgctgtcacaaataaaatcattaaatgcaatcagtcacatctgactcgtccatactttttaatttcctcattcaacttctatctgttcattaagaagatttaaagacataacgttaattttagggaataggtgacaaggagcaaaaaggttcactgaaaggaacctgtgtcttttacaaattatacaccagttggggcacattgttttctccaaataaatttaggttaattgatagagactattgatatttgttttacatggtgctgtggaaagaagaaaggctctggagtcagactcattagtttactagtctgcaaagtgggaataacaaacatacctaacctgaagaattattttaaagattaaaagagataatatgtctagtatggtgctcagcacatagaaatacatgctacagatgtgccttcttactattattagtattaaatatgtagataaatcagacatttcacagcattttctcattatatgtggtactaattcatgttataaatatgctgtagtattttttgaatggttaaaaggagcaaaaaacaacctcttgcatttttattctaaattctagtgaagctgaaaatattcacctaccatgtcttaggttgtcccttctacttttaaaaaagcacacggattggtatgtttaggggtgaaatgtcataatgcttgtatcttaccttcaaaatgtttaggggaatgaaaagatagaaggaaaaacaaataatgcaatgtgacaaaatgttaataattgttgaatctaagtagatggataagggtattcatagtaccattctttaaacttttctacaaaatttgaagaaaaaaaggatctgaatggaaaatcagattcatataattgagtaatcaaaaccaaagttctttttgttgtttgtttgttttcaagacagggtctcactctgtcatccaggctgaagtgtggtagtgcagcctcaacctcctgggctcaagtgatcttttcgcctcagcctcccaagtagctggaactgcaggaacataccaccatgcctggctaatttttaaattttttgtagagatggggtcttgctatgttgccgaggctggtcgtgaactcctatcatcaagcaatcctcctatcttggccttgcaaagtgctgggattacaggcatgagccactgtgcctagccagaactgaagttctgttgtccttaaattctttaaaaaaattaaaaagttttgatttgcatttctctaatgatccatgatattgagcttttgttcatatgcttgttggccgcatgtatgtcttcttttgaaaagtgtctgttcgtgtcctttgcccactttttaatggggctgttttttttttcttgtaagtttgtttaagttccttatagatgctagatatcagacctttgccagatgcatagtttgcaaatattttctccccttctgtaggttgtctgtttactctgttgatagtttcttttgctgtgcagaagctcttacgtttaactggatcccatttgtcaatttttgcttttgttgtgactgtttttctcacttataagtgggagctaaatgatgagaactcatggacacaaagaggggaacaacagacactggagcctacttaagggtggagggtgagaggaaggagaggaacagaaaaaaacaactattgggtactaggattagtaccgtgatgaaataatctgtacaaaaaactcctgtgataggagtttacctatataacaaacctgcacatgtaccccggaatctaaaataaaagtttaaaaaatggaataaattttgaatacaggtaaataagtagcagttaaaacactaatagtagtctttaagaaacatacatccaactgagaaaactgttacttaaatgaggcaaaatttgtatggccttttaactaaattacaaaataatttcaatagccccacttacacacaaaagtatgaaaattaaccccttttcaatagaaatgtatacattgactagattctaatcactaaaagaatactcaggatattattaataaaatagttgcaacatattctccagtcttaaacggcgttctccaatattttccagagaacattttacaactaaacaagagagtattactgttactatttgatgtccttacaattttatcggaagttttctgcagttcaaaactcagaaagcacgatcagctaatcacttttctcatctgtcaggtgtcagattcaaaaaccttaaactttagtatggcaatatcctaccaagattggaataactttttgatatttgtggtaagataaatctgttacactgaaaagagacaaaggattgcctaattttaattatataatctcttgatgtacgttttggttgggatgcctgaaattagcttggagatacaatgcaaaaatatgaaaactgtgatttttgcaaggggactgcacagggaaggtctctttggagtatgaggtatgagcagtaggactaggaagaggaagtatagagggaagcagtgtgactgtgagtagatttatagatgagagagaaggaaagatttttttttccttgccgctctgtgagaaagcaaccttggaggtatgaggagtcatataaatatgtttaacaagaagctttgctctgtgtggaatgtctgagtcactcattcaaggaaacctatagtaaagatctgtatcattgaagcctttcaagttggattgatattttaaaattcaactccatgttgactcatatgtattatatcaatacatataaattttcaattgaagccccaaatcccttagaaatggcaggtaaattacattcctttgatttagttgatttcaaatttcttcttatggccaggcacagtggctcacacctgtaatcccagcactttgggaggccaaagtgggagagttacttgaggccaggagtttgaggccagtgtgagcaacatagtgagaccctgtctctacaaaaaaatttacaaatcagccaggcatggtagtgtgcacctgtagtctcagctactcaggaggctgaggtggaaggattgcttgatctcaggagtttgaggctgcagtgaggcatgatcacaccactgcattccagcctgggtgacagagataccaaatctaaaatttaaaaaaaattttctcattataagcaaagtttatttcattcttaccttggctatgaagttagtgatttttgttttgttttgttggtatgttcttttaccaaattccattaaaaatagactagcttttctttccattgcttggaatcacaattgactttgtatagcaccatattgcctgagcactctcataggtcttggcacctagaatcactgctcttcaagcttgtcttatattttggagctcacaaaacagacaattactaacttcaaaggtagagaagaagtaacagcacccatcttcacagaatttgaaagtagaatatcaggaagagaacccctgtctctcaaatttctgcttatcccttttttcatctcttctctctgtgtatctttccagttcctctgccctgattcctgagtccagttatctctccttcctttggactttctgttcccttataactacttctttcaaataacttaaactttttatgacaccgactccatccttgactttatatgatatttgagttttcctgtccgtgagactgatttagttcaaacttcaagacaaggagtatgattgattcagcttctcctgtagattgcatgctttattcataagctatggcaaggggatgtgtcatggtgcaaaataactggcttttagctataggcaagggtagatcctcttagaaggctgtgtatggtgggggaggttgcagtcttcagctatgcttgtgtttggctataaacgtctattatatgggcctgagtatgggggttgattttggattaagtaatcttaactcaaaactacgtacgcacctataactaaaaaattcatgatgcagctagattcagctgcagtggcctaaacaaaataaaacaaaacaaaacaagaagtcttgaagtaggtgcttccagagtttgttctgtggctcaaaagtggtcatcaagtaccaggttctttgtatctttccatcactctttcctgcttttagctatatttaagagcagattctgtaagagagttatgtgtggcggaggaggccacaataaagtggttttcattttttttgttttttcattctcaggcttgttgcctcatagttgcaagacaagctgcaatgtcaagcatcccattctcaagcaaaatcaggcagaaaaggagaggcaaggttaacaagagagctctgtgtctgactctcactttttgccaggaaaaggaatcttttccggaaactccccatcagactcacttttacatctcaccatcaaaatctgcgtcatctgtctacctctagctgtaagataggctaggaaatcaaatggctgacgttctcagtgtctcatgggagatggttctacaacaatagaggaagggagaagggaatagctattgagtaatcaaccaatgtaccttcagagttccattcttcaggtaggctctgtccacctggcaagcaagataatcaccagcattctctacatcgtcatttcatactatactctttcccttctatccctcacttaatcttagttctgtaagtaacaatatctttaagcccactagcagcccttgtgttgatgtctttctagtaattttgtttgtctgaaggtcactttttactaaattcctcaggaagggcttgtagggacaaaattctgaagttcttctatgttgataacaatttgtaccttttgaaagttagtgttgctggatataaagttgttggtttatacttttttcctttgtgtatcttaaatatgttactatgttttcttaggacattatgagttgctatcaaaaagccttcgatagtctaattttatttgctttacaaaatcacttgttctttttgcctagattttttttcttttttattgaaatctagttatttttgttagaatatgtgttggtattgaacattctggggaaggattgtcaggtatgttctttcaaaatgtggctttatatctttttttaaatttcagaacaatttttctgaattacggtttttaatatttgttctcttcccttgctttgtttttttcttgggggaatcttgttactgatacattagatccttatcacccatccccaatatttttccctttctcttgaaatctttaaaattgtttatttcctttttagttgtataattacccttattttgccttctatttttcttgagaaattatctgtcgagtttgtttgctcttatgtcccattttagttaaatttccattatgaaattgttttttctttcatttataattctttccatagttctgtcacataatttctgagtttttctaattctgatatgtgtcctctcatgacttctatcatttttctattgtcttttagcttgttttgaaataggctatagttttgctctggtttttgacatgctttcattgtctctggggatttattctatgcctcgctttgtttttttcttataaaagcttggtatggggtttgatgctgatacttttctactgctcatagaaaactggaaattttagcttttcttaactttcaaaagaagacttggttcaaaatagttctctaacctctaagtttcactttctattgtttttctgtattaaaaaaagatggcttactttctgaggttttctggtttccctcccctaccttcatctagacttttcctttttctctattgctgctcaatccttattctactcccagcattttctccatgacgagctctgtcccaaaagggagccctgactgtttggtttcaagagtacacagggcatagattacttaagcttctatagaccttacctcacctgttcttggagggggtaagacccccttccagttttacctgctgttctgaaatgggccctctgcctcccagtaaatgcttgatgactgtttgggggttttcttattcttaggtccatctgttgcttcattgtttccctctgcatcattcatcacaaatggtgatgccatgtgtgttttgaggttgcagatggtttgaccccacctacttgtattttaggatctgtgaggatcccttgccctcatttgttaaaaaatgctatccttgtgtttttggttttattatctaattgttctgtcatttttacgtgggcatttgggggagatttcaaaatgatgctgccattgccatcatcttctcagaatcccttctggcattttttttaaaggatgattctttttcttatatggagcagagactgtaaagtataggaggcaagggccaatgcaggtagaaaagttagaaggcttttgcaataatgcagtaagagatgatggtgacttgggctgggggaggagggcaggtggtggtcaatgtggtgagaattggtggattctggatatatttttaaagtaacgacaacaggatttttaaatgggatgtgttgtatgtgaaaaagagtcaaaggtgactataaagattttgactggagaaactggaagaacagagtttccatttactgaagttggaagactgcagttttggcggggaggaattagagttcattttggctctgttaaatttgaggtgcatgttagacatccagatagagaagtgaattaggcagttctttaaatgggattggagttaagtgagagatctgggctacagataaatctgggagcaaatatatggtacttacagccataaagctggatgagatttcctagagagtgagtacagttggagaagagaagagatcagctaggagtactacagggtttgggtgtggatagtatggctcttattctgaacattttaattctttcctttattttgtgcgaagttttaacacaaatactaaacttgtcaattaaccagttcctaaagagttaatgagtggctaggttcaagaatattctctaagacagataactgaggactggcatgttcaatattcattcccagcaactcctctgttctgcagatgccagagactacaaactacacttcccagactcgcctgcagctaggtgtcatatacaatttaggatccaccagttagatctacaaaagactttgattcagaattgaattaagagggggaaagagtcagggcgtatgccatccgttctgtggatcatagcagaggcagtgtgttctgtagttgatggtgtgacagtgatatcccattttgccaggcagaacacagccctagatgctcaaccttgagtggttttgtattttagctctcctattattctgcaacccatttaatattctgtaataagtccctccctgcttagactagctagagtaaattatgttatttgcacatgaaccctaactaataaatcccctccatgggtctagtattttacgtttgtgatatagatgtatgtgttaactcactcatgagcagcgaatgggtgtgtgtgtgtgtgtgtgtgtgtgtgtgtgtacacacactgagggcaaggagaaaggaagattgtttgtgggctctggagggtactcacggacaattatggcctgtgctccactagaagaagatgaagaggaggactcaaaagacgaatttctgatgcccaagttccagggccagcccagcgatgctgtgagcatcttctgtggcccgaatgtgggattggtgtggccctggaagtctcacccaattgctggtatcttggaggtccgtggatgtcggctgcggggccaatacttcccccacaattataagcagctggaggaagacctggacaacaaccctaagatccagcaggcactgaatatacaacaggtgctgctggaggtgagaacagtggtttaagggatagggcgctgcccaccaattcccattatagccgcatgcctctgccctaaacaccttgtctgcccttagggcgtgctgtgcaaggtgcaggaattctgcagggaacatcattggataacaggcatttatgaattcctgcaatcctgggggcctcagaagctggaagacatgagaggtggtcccatcaagaactacgtgacgctggtgagccgcctgaatgtttggcaggcccgtgtctccagtatgcctatcgagttgctcacaaaaggcgggttgctgctacttagctgccatgatgtacaggcagagatgggtgagtactgcttctcttccctctcctccttcccttttctgtatgtctattcacatggcctgccttggtcctggaatgtcctccggagaccttcggtgcaggcctcttattggacctatgaagccttccaaagcccgaggtcccaggccctttcctttgccatcaaagctatgctcactgcaaaggccggcctctctgttttggctctgctcataccctgtattccttaggaatcatgttcctgtgcttgggctactaagctcagtgtctttacagagattcttgggaatctagggtgctttctctctgcatgtagctgagtgaaatttatactacgatttgcatatgtaaaaagctactctctaactgagcttgtcttactctgtagtcctaacttctactggtagtgaaagaatgtaacctttccaattaaagaaagctcctttcatttaaagcagtcacttttggtctgattcagtctatttgggatatctgggcaattgaaaatttatactgtagttctgggttgtttttactttcaaatgtcttttcctcccttttccttcccaaggtgccacctgtactggggaaggccggtgggctggcttctgaggtgtgatacatccttgcctggtctctgccctcctgacattgctgcttctggtgctgctgtgtcctgggctggtagagctgcgatgtgttttcttggactaatagggacctggagtgtctgtctttgctgacctgtccttgtcttaacatttgctggcatagctgatccttggggttttagtgaatccttcatccagtctctgtcttaggctggctacccccatggcttttgcttcagggtccctagcccctcaacacaggaacttcatctaggccactggctatcaattctctgctatcatctatatcccctgccatttgggagttgtgggaaactggtaagcattatatccgcccctctttttactacaacacataacagtatgatttctactctgctgtgactgtttcatgttagcaagggacaccctaaaaggtggtctttcccaaagttctatgtggaaagtggggctcaagaccattctactacctattttctcctcaacccatctcaggttccctcctcttgccacttctacccctgctaattgaacgcccaattgttgctatccctgggtctctgagaaatctggcttatgacctagtcttttaccctcttttctttcttccttcccatgggaaggatatctcatgctattgtgtactagctagtgcctcagcctaggagttcgccacagagaggctcacagcggggtagatttggaagccagtgatttgttcttttaggaaatatggaggttgttctctttcctcacctagcctcaaggatggcaatagccaatagtatctacttcctgtgaagactagatcctgttggacccgtggcttcccaggcctgctttctttatgaaggttagaagccactggggcctggaaagagtttgcttgtatgccctgcttgcttcgccttccctgtcttggctctcaacagatgaaagcacatgtatcattaggtatccagtgggccactaaaactccctcctcttgtacagggggttcaggcgggcaaggcaggaaccgggaggacgtttgattgttttgtcttctctctggccgtgttttggtcaggctttacttcactgctgctgagaaagcttattgttgtt

SEQ ID NO: 328 - DNA, 39946 bp, Homo sapiens
ggctggtggctgctgttttccctttcccccctctctcaggatcctttcaagggcttagatgttgctgcggcttgtttctgttttcctcgtggccggcctgtctttctccgagaaaattcaaacctgggataaaaggaacacaagggagaaagatgtaatcagtacgggttgcttcaaaacactcacaaatgccatctttgttgtccccaaacaaacctgtgtcccatcctgatcgcaaccgctttaagccgtggctctcaaatgaacccatccatccctatcccgcttcccagatccaacgctctccgcaaaattttacccactagacgacaaagtaggcaaacttacctctaaacgaaccccagaatggcggccgcccgctcgggtggagtcttttatacccggacgccgcccaacgcgcccaaacgtgctagtgaaacgcccttgtcgcgagacattatacgcgaggcgtgaactcattggtcaacccaaatgacaactcgccaactgattggctactctcacttcacctttgctccgcccctttccctggcactctcttccgcctccttcctgcctccctgtcgcgtgcgcgtgaccaggagcctagcacctccctttcctctgcttccgccacttccgccctggagaacatttctcacccaggattggtagaaacctaagagcgcatgcgcactgagaggataccgctaaaaatcgccttcaaaattgcttaaaaggcaaactttaacaatgcgatctaagagtcgtagtgactggccaaaaaaaaccgcaattttggggtctaattcgattgtgacgcagttgaaattagcttctcccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattaaacaccgtgctgaggcggcttcctatgctatctctcttccgaggttctcacagagttcaggtaactcttcgaaagacattttgcacaacctcaagttggttataccttctcgaggttgtcgctccactgtcaggaatccacgagtggagaccttcccacgtgtgtcttagctgtctaggcagtacttcctgcaaccccccccccacaccccgcgcattttctaatcccgagccgaggactaaacgccagggttaggtatcatcctttttccaaaatgccatttcagtaaaataacttaagtgatggaattgacccctgtccaccctcagtcatgcataaccagctttttaaaaattatttaactaattaaggggccatgctaatctctgtatcgttgcaattttagcataacatatgtactccccaagcgagcgccacaaccagctgttaactatgcaagtggtgactaaatctgtgttgctctggaatgtccttggggaaattagggatcccaatttctaccaaccttgctatttctcaataaggtcaggatatattcttacgacctgaggacagtttctcagctctctttattaaatcagtttcttatcggagttatgagagcttaactccgtcctttgaattgaggtttccctccagtcttgtgtactcacctctctggaggttcttggtggggcacggtgagataggaaggcttgcccagctgccactccctaaagtgggactgaagagtggtgacagaggtcaacacagaaataataacagccttggtagctttaaaactagcgttaggactcaagtttgttctgccctgtagaatgttgaccttcagcttttatgaaaatgggcaactcagtgacttcattggattgatttggagactcacctgtcttctgcatcccctccccaccacacatcttagttccaagaacctagatatccttcctcttactttattcttccaccagagtcaatttatttccaaaaagcaagaataccttttatgtactagatttttttttcttttttctttacacgaaatctcactctgttgccaggttggagtgtagtggcgcaatcttggctcactgcaacctccgcctcccgggttcaagtgattctcttgcctcagcctcccgagtagctgggactacaggcgcatgccaccacgccgaactaatttttgtatttttagtagagataaggtttcaccatgttggccaggatggtctcgatgtcttgacctcatgatccgcctgcctgggcctcccaaagtgctgggattacagacgtgagccactgcgcccggccttgtactagactttttatttgtcttctgaaataagattgttttttaggcatatatcccctaacttagcttttctttcaggatccaattgtagaaaaggagagtggttgttgatttatgtcaatttaaacccaacaaaaatacttaacttacatatgcattcctgttatattccattaatgcagtatgtgtgcattcctcctttccaaagtgtgataagcaaaacaatttagtcctttccttaaactcattcttttatttttttcttctcctttgtaggttcccctccagactctttgcaccaaagctccctctgaggaagattctttgtcctcagttcccatttctccttataaggatgagccctggaaatatctggaatcagaaggtacctctaaagggggaaagggagggtcagataggatttgagataagtggacagagccacccactacactcccacccaggaataacttgtatgatctttcatttcagaataccaggagcgatatggttctcgccccgtctgggctgactaccgccgcaaccacaagggtggtgtacccccacagcggactcggaagacatgtattgtgagtttctgagagtgggatgtggagtgcggggaggccacaagtaacagtaacagcagcactttttctgacgtgtttgaacatccttaactgctgttttttttctctctacagcgtcggaataaagttgttgggaatccctgccccatctgtcgagatcacaagttgcatgttgactttagggtaaggagagtcttttctttttagggtaagaaaaataaagattaggggctgggcgcggtggctcacgcctgtaatcccagcactttgggaggccaaggcaggtggatcatgaggtcaggagatcaagaccatcctggctaacacggtgaaaccccgtctctactaaaaatacaaaaaattagccggttgtggtggcgggcgcctgtagtcccagctactcaggaggctgaggcaggagaatggcgtgaacccgggaggcagagcttgcggtgagctgagatcgcatcaccgcactctagcctgggcgacagagtgagactccgtctcaaaaaaaaaataaaataaaataaaaaaaattaaaaagaaaaataaagattaggagcccctttgcagtgccaaagagattactgtaggtgccccacacttcgtatatccaggaggccctacagtccgttttatagtaactgtttctggcattataaaaacatccctccagccttttaccttctactatggattgtactgaaagttttatcctatgcctatgaaatttacagtctaaattggcaggtaagagaaatggctgttttttttttttgagacggagtcttactctgttgccaaggctggagtgcagtggcgtgatctcagctcactgcaacctccgccttctgggttcaagcgattctcccgcctcagcctcccaagtagctgtaactacaggcttgtgccaccaagcccagctattttttgtatttttagtagagacagagtttcaccatattggccaggctggtctcaaactcctgaccttgtgacccacccgcctcggcctcccaaaatgctgggattacaggtgtgagccaccacacccagccagcgaaatggctatttctagtgggagagccaatatccaaagattcgtttgtattcattacagttattaccaaatatattggcccactttcttcctgaggttttctttatttccttgtcaatgttcagtgccatgctggcacctggggctggagggcaggtatatgaagcaagatagagtccattatttttcaaaaagccttcaatatgtgagaaggacaggatttgctccttaaagaatttgaaaacatattggctgggtgcggcggcccatgcctgtaatgctagcactttgggaggcccaggcaggtgcttcacctgaggtcaggagtttgagaccagcctggccaacgtggtgaaaccctgtctctactaaaaatacaaaaattagccaggcatggtggcaggcgcctataatcccagctacttgggaggctgaggcaggagaattgcttgaacccgggaggcggaggttgcagtgagctgagattgcaccactgcactccagcctgggcgaaagagtgaaactcctcaaagaaaaacaaaacaaaaagaatttgaaaacattatatcaataaaacagataatgggaaagtgttcttctgagcttgcagcaaaagtattagagcagaagctatatggctgatcatcagggaagtagtagagcatttggataacagtcagaaaatgggggtatttgactgcaataagaacccttctaacacaggttatttaggagtcccatagataatttcccagtttcaattgcatataattggttataaaaagagattatggccaggtgcggtggctcatgcttgtaatcccagcactttgggaggccaaggtgagtggatcacttgaggtcaggagtttgagaccagcctggccaacaaggtgaaacgccgtctctactaaaaatacaaaaaaaattagctgggtgtgatggcgggcgcctgtagtcccagcttctcaggaggctgaggcaggagaatcactggaacctgggagatggaggttacagtgaaccaagattgcaccactgcactccagcctgagcagcagagcgagactccgtctcaaaaacaaaacaaaacagagattataattaattacataactgagagagagaaatgttacaaatttagtagcatgggtgattctgcttgcattctactctacaatgtacctgcttttttttcaagagtctcatttcctagttaatttgctgagagagagttctatgtaaattgtaaaattattcttagtatataaattatattcagcatactattaaatacattagttgtttatacatacacattacaatatcattttttgggtgatttctgggatttccaatgaccagccccagtttttcacctaaaggctgacgttagaacttaacctctgcagcccaggcgcggtggctcatgcctgtaatcccagcactttctgaggccaaggtgggtgtatcactaggtcaggagttcaaggccagcttggccaagatggtgaaaccgcatctctactaaagatacaaaataattagccaggtgtggtggcaggcgcctgtaaccccagctactcgggaggctaaggcagagaattgcttgaacctgggaggcggaggttgtggtgagctgagatcgcgccactgcactccagcctgggcaacacagggagactctgtctcaaaaaaaaaaaaaaaaaaaaaaaaaagaacttaacctctgcataagagatttctatgggagcacagtgacagaatatgggatgtgcaaggatggattcagtgaattgatgaagccaaactgggacatgaaggaggatggcatctggagagctgtagaggggtgaaggtggtccatgtgggtgtgtagggattgtgtactttcgatgtccaaagatcctgctgctctccctgcctcttttcctcacgtttctctaccactttcccccacagaacgtgaagctcttggagcaatttgtctgcgcccacacgggtatcatcttctatgctccatacacaggttagcccatcatccctgcaccaccagagagcttttccttgtggcatgccttgtttatgtagttggccaataggtatttgttcagtggctcctgcttatagcctaaaaggtctggctgaaccttttggaaatcttggcttgctgggggctaaagtaattaaatgtggacaaaagaaaacaacaaatacagccaggcgtggtggctcatgcctgtaatcccagcactttgggaggccgaggcggctggatcacctgaggttgggagttcgagaccagcctgaccaacatggagaaaccctgtggtgatgcatgcctgtaatcccagctactcaggaggcggaggcaggagagtcgcttgaacccaggaggcacaggttgtggtgagccaacattgcgccattgcactccagcctgggcatcaagtgaagctccatctcaaaaaaaaaaaaggaaaaagaaaaaaacaagtacttctgtaagcaaactatctaaatgtagtttttaattgataaacagtgattaattcctttctatagggtcttttaacttttacaaaagacttctcacaaattgtcacataagttattttatatcattgtcaattggattagattttccaaacttggaatcgtaaatttaacaattcagaattatatttattccctaactacagtcacagggcaaatctggcccactgtcacgtccatttgttttcatattttctgcaattgcttccatgctacaatggcagagttgagtagctgagacagagaccacaggacctgcagagtttaaaatatttactatatgactctagacagaaaaattttgctaacccctgctctgaagcaagacaaatttgcagagaataattttttgttgttttttttttttgagacgaagtttcactcttgttgcccaggctggagtgcaatggtgcaatcttgcctcaccacaacctctgcctcccaagttcaagtgattctcctgcctcagccccctgagtagctgggattgcaggcacatgccaccatgtccggcaaatagagatggggtttctccatgttggtcaggctggtctcgaactccggatctcaggtgatccagctgccttggccttccaaagtgctgggatgacaggcatgagccaccgtgcccggcagagactaatctttgtttttgttttttttgggggggtgtgggtggggggatgaaatctcatttactctgtcacccaaggctggagtgcagtggcatgatcttggctcactgccgtctccacctcctgggttcaagcagttctcctgcctcagcctcccaagtagctgggattacaggcacgtgccactgtgcctggctaattttttttgtatttttagtagagacagggtttcaccattttggccagtctggtcttgaactcctgacctcaagtgatcctcccacctaagcctcccaaaatgctgggattataggcatgagccaccgtgcctggccttgcagagaataatctgaattcaccattgttgggggtggcagtacaatcagtgttcagtttgtcaagagtttcttatagtcaagctgtaaaggctgaagggactattattgttactctctcagattgccttccccaactctgaaatctcttttccctttattgaatctttgtggattgttcaactcaaccctctaattaaccacacttgcccattaaattgtgttctccctgtcttggaggttttaccattaaatggcttctctatagtggctagaccctcctaaatctttatcccagctctccaaaagatgggggagattctttcctttgggcagatggggaaactgaggtccatggaggggtcaggggaaaggggtcattaggtaaagccaatccttcccaatctacccctctgtcaccatatggaagcagttgtgttctattatttactgtgccttaaagaacaagatatttttctccccacaggagtctgtgtgaagcagcacaagcggttgacccaggccatccagaaagccagggatcatggtgagcatgagacggggcacacagcagttttgtttaggtataaggaagatgacttagggctagaaaatggatataaatgctcacacctgttcaagatggtagcacccagcatgttcttcctgacgttacattgtcccctgtcctttctcctgagtgtcttactttatcattgtcctgtctccttgttctttgtctttccatccttttccctcctattttacaactgctggtctcaatgccttaggaagttctttatataaatgtctggccctggactacatggcactgctgcataagttagtaaaaagtatacccctctgctagggcagatgcagcttcatagtccttgttcagcactgcacagctttgtaagcaagagccccagcagtatgtcagcccacacttgccctctgggccggtcacctgtttgcagtatacaacatgcataaatgtacctggtggctctgactggtccttccctttataatcctttttcttacttcatctaaaccaccctcctcattgcctcttaaatttcttttcttttttaatcccttaggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctggtttgctttgggctgtttccgatgaatgccattagcggggggtgggctgagtgatggtcttttcatataagcaattgggtgatgctgtggggagataagtggtcaggcttaagccagccttgcctgtgacgcctgggactagaagccggggatgggcagctgtgccactctgtcaagatgccttgtgggcccccactccacagcatggcccactgttcactgaggggataaaaggttggacagtgagacactgggccaaggaagactacgttgccatggcactcactgccgtgggatgcagggatggaaaggagtggcactgctaggggcacagctggtttggcaagaaaaacgggggccctgtcagttgccaggacgctagggggcaaggtctacaggcggggctcctggaaataaagactccgagaggcggtgcggcgagaggaggggcggaagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccggtgacagctcaaacccaccctctggcccttttctcccggttcctctccaaacctggtccaggcaccacgcccccttctcactgactagtgatcgccccttttgatgtccaggcctgcctttttggtgacctctgaccctgggcctagtgggattgatcagcgcttggatctgtgacctttcaccccgggcccaaaatgtcccaatcaaaggatgtggttgacctggcctttctgcttcctcacaataaccttaagggaggagggagtgtgccaccttgaaaggtgtgacagaagtttgggtttcagaagggtggggtgggaaatcagattggaagactcccaggcaaaggcagggagccttcagtgttaaacctgggttggagttgtggcccaggttcccaggactgactgcctaggacccgctaatttagtgagtatctgactctttatttcttctctttctctagtgttgatctacagcagcaaattatgaccattatagatgaactgggcaaggcttctgccaaggtactggagagtttttagatggagtaaagggaggacctctgtggggatggtatataagggaggcctgggtccttcggagagacttgcagaaagtctgacttaatcttccctgcaggcccagaatctttccgctcctatcactagtgcatcaaggatgcagagtaaccgccatgttgtttatattctcaaagacagttcagcccgaccgtgagtgccacatgctcttccatcccatacttaattccttccttcctcagcccttcccccatctttgactatctcttgcagatagataccactagcctgttcattattttccccgtcctacagggctggaaaaggagccattattggtttcatcaaagttggatacaagaagctctttgtactggtgagtgttattggatgctaggagttcgtataccttggtttctgagaacaaaagtgctggaggttagggggcagcagagatgccggggttcctaaaacatttttattgtttctctcttaggatgatcgtgaggctcataatgaggtagaaccactttgcatcctggacttttacatccatgagtctgtgcaacgccatggccatgggcgagaactcttccagtatatgttgcaggtatcactgacctcttcactggttcatccaaactaggggctcctttgccctgagcccttccagaagccctgcctcccaccccccatgttcccatgtcattctattcccttcccaggcttctggcttcctgttggcatgctttccccatacttcctcctaccctgagtctccttttccctgcagaaggagcgagtggaaccgcaccaactggcaattgaccgaccctcacagaagctgctgaaattcctgaataagcactacaatctggagaccacagtcccacaggttagaggtttcagagaatagatccccactgagcattcccattgaatttatttgttatttatggcaaagaagtagtgacttatttcctatcacataggtttcattttctacaaccaggctctttctttctcttgtggtaccatctctcatcctgtagtgacttctttctcatctattttgatttttttttttgagatggagtctcgccatgctgcccaggctggagtacagtggcgcaatctcagctcactgcaacctccacttcctggtttcaagcgattctcctgcttcagcctcctgagtagctgggactacaggcacccaccaccacacccagctaatttttatatctttagtggagacggagttacaccatactggccaggctggtctcaaactcctgaccttgtgatctgcccgccttggcctcccaaaatgctgggattacaggtgtgagccaccgcatctgactttttttttttttttttcaaagcagagtctcctgctgttgcccaagctggagtgctatggcaggatcttggctcactgcagcccaaccttctgggctcaagcgatactcctcccttagcctcctgagtagctgagactacaggcatgcaccaccatgcctggctaattttttattttttgtagagatgaggtctcactatgttgcactgggtggtcttgaactcctggctcaagagatccacctgcctcagcctcccaaagtgctgggattataggcgtgagccactgtacccagacttattttgattctttaccacaagttgtttcctacacctaatttttctttttttttttttttgtgagatgtagccttgctccatcgtccaggctggattgcagtggcacgatcacagctcactgcaacctctgcctccggggttcaagtgattcttgtgcctcagcctcctgagtagtagggattacaggcatgcaccatcatgcccagctaatttttgtatttttagtagagatggagtttcaccatgttggacagactggtcctgaactcatggcctcaagtgatgtgcccacctcagcctcccaaaagtgctgggattacaggtgtgagccaccgcacacaacccttatgcctaatttttttttgagacagagtcgctctgtcacccaggctggagtgcagtggcacgatctcagctcactgcaagctccgcctcccaggttcacggcattctcctgcctcagcctcccgagtagctgggactacaggtgcccaccaccatacccagctaattttttgtatttttagtagagatggggtttcaccgtgttagccaggatggtctagatctcctgaccttgtgatctgcccgcctcggcctcccaaagtgctgggattacaggcgtgagccaccgtgcccgaccccttatgactaattttcaacccaaacatagccagctcattttcacctccttgttttcacatagttcattactcatctggtcagtcagtatttattaagggtccagaataatatgcattccctgtcctcatggagctttggcctaatatagggaaggaagtcttgtttataactaagtgcagcaaaatgttactaatgctacccattcatccaataaacattgagtgcctggcagtgttctgggcactaggaatggtttactcaatgaaacagacaacagcctgggcaacatagcgaaactctgtctctacaaaaaatacaaaaaaaaattagccaggcgtggtggcacgagcctgtagtcccagctacttgggaggctgaaatgggagaatcgcttgagcctgggaggcagaggttgcagtgagccaagatcgcgccactgcattatagcctgggcaacagagagagaccctgtctccaaaaatgaaaacaaaaacagaaaaaaaggccaggtgcggtgcggtggcccatgcccgtaatcccagcactttgggaggctgacgtgggcgaatcacttgaggtcaggagtttgagaccagcctggtcaacatggtaaaaccccgtctctattaaaaatacaaaaattagcggggcatgatggtgggtacctgtaatcccagctacccaggaggctgaggcaggagaatcacttgaacccgggaggcagaggttgcagtgaaccaagattgcaccactgcactccagcctgagcgacagagtgaggactccatctcaaaaaagaaaaagaaaaagggccaggcatggtggctcatgcctgtaatccccacactttgggaggccaaggcaggaggatcacctgatatcaggagttcgagatcagcatgtggaacatagtgaaaccctgtctctactaaaaatataaaaattaactgggcatgatggcgtgcgcctgtaatcccagctactcgggaggctgaggcaggagaattgcttgaaccccggaggcagaggttacagtgagccgaggtcctgctacagcactccaccctgggggacgaagcgagactcttgtctcggaacaaaaaaaaaaaacagaaaaagaagggaacagacaaaagtccctgtcttagtggtggagcttatattctagctggagagacaaacaaacataataaacaatatggttaataagtgctctggaaaaatgagagcaagtaagggtttgggagtactcaagtaaggtggggatgggagtatgtgggattgcaggttgaaaggggatcatcactgagaaagtgtcatttgagcaataactgaaaggaagtaagagtaaaaactggccgggcacggtggctcatgcctgtaatcccagcactttgggaggccgaggcgcgcggatcacgaggtcaggagatctagaccatcctggctaacatggtgaaaccctgtctccactaaaaaaaatacaaaaaaattagctgggtgcctgtagtcccagctactcgggaggctgaggcaggagaatggcgtgaacctgggaggcagagcttgcagtgagccgagatcgcgccactgcactccagcctgggtgacagagcgagactccatctcaaaaaaaaagaataaaaaccaaggctgggcgtggtgacttacatctgcaatcctagtacttagggaggccgaggtgggtggatcacttgagcccaggagttcgagactagcctaggcaacatggtgaaaccccatctctacaaaaaacacaaaaattagccaggtgtagtggcacgcacctgtggtcccagctacttgggggtctgaggcaggaggattgcttaagcccaggaggtcgaagctgcagtgagccgagatggtaccactgcactgcagcctgggtaacaacgtgagactgtctcaaaacaaacaaacaaaaaaaaagagtaagagccaagaaatatctggagagagagcatcccagacagaaggtaccaccagtgtatggccgtgaggtgggagtgtgcctgaaagagcaaattggctgtgtccagagcagcatgagtcagcggaggagtatggtaggagatgagaccagagaggtaatgcggaggaggggccttataggctactgcaaagactggcttttattttaagtaaaaaataagatcaggccaggggtggcgactcacacctgtaatcccagcactttgggaggccgaggtaggtggatcacctgaggtctctactgaaaataccaaaattagctgggtgtgatggcaggtgcctgtaatcccagctgtttgggagtctgaggcaggagaatcactagaaccgggaggcggaggttgcagtgagccgctgaaattgtaccactgcactcctgcctgggcgacagagcaagactccttcttaaaaaaaaaaaaaaaaaaaaatagcgccaggtgtggtatctcattcctgtaatcccagcattttgggaggcccaggcaggtggatcacaaggtcaggagttcgagaccagcctggccatatggtgaaaccccatctctactaaaaatacaaaaattagccgggtgtggtggcgggcacctgtagccccagctacttgggaggctgagatagaagaatcgcttgaacctgggaggcagaggttgcagtgagctgagatcgcactactgcactccagcctggataacagaacgagactccatcaaagaaaaaagaaaaagatcattttggctgtgatcttgattttttcctttttaacaagatcactttggctgttaagaacaggcaatagccgggcacagtggctcacacctgtaatcctagcactttgggaggccgaggcaggtggattgcctgaggacttcaagaccagtctggctaacatggtgaaaccccatctctactaaaaatagaaaaaaaaattagccaggtgtggtggtgctcgcctgtaatcccagctactcgggagactgaggcaggggaattgcttgaatcagggaggtagaggttgcagtgagctgagattgtgccactgcactgcactctagcctggtgacagagtaagaccccatatcaaaaaaaaaaaaaaaatggaaacggcaataagggagccagagtagaagcaagtagactaattaggcagcaacaatcctggcgaaaaatggtggtggctcagaccaaggtggtagcagtagtgatggtaaagagtggtcaaattttaaatattttgaaggtaaagcaagtaagatttcctgacagattgtatgtggagaaagaggactttaggacaatgccaaagcctgagcagctggaagaatgaagttgctttaactgagatggtaggtagaccagctttgggggaaatactaggagtacatttttaatatgttaattggagatgtctgtgatatgtccaggtttgagtagacagttggatacttccctggagatcagggaggaggtttggggaggagagttttcagcatacatctggtatctaaagccaacagacaggatgcgatcaccatagaaagattatagatagagaagctgcccctttgggccctctttaagaagtgaggacccccaactggctgctctgaaaagccatctttgcattgttcctggttcggtgtcctgctcaccacagccacctccgccatgcacttcctctgctgcctcagagtctggcagcttaatcgacatagtccccaaactctcactttcttcttaatcccttgcatcggatcaccgctgtgccccaccatgtcagaggcagttgtggacacaagctccgtgatcaccaccaaggacttcaaggagaagttgtggaggaggcagaaagtggaagagacgcccatgctaacgggaacgctaatgaggaaaatggggagcaggaggctgacaacgaggtagatgaagaagaggaacagggtggggagaaagaggagaaggaagaggaaggtgatggtgaagaaaagaacggagatgaaaacgaagcagctgaggcggtatggacaaatgggcagctgatgatgatgaagatgacgatgttgataccaagcagcagaaggccagtgaggatgattagacagcaaaaaaagaaaagttaaactttaaattaaggccaccgtgacctattcaccctccacttcccatctcagaatctaaacatggttgccctcgagaggcctgcttgccctccacagacagtgccactgcagatgacaggcactcaccaccacccaacccaaaccagagaatttgcaacagaggaggaaaaaagaaccaaaacttccaaggtcttgctcttttaaaagtactttaaaaaggaagtttgtttgtattttttatttacattttatatttttgtacatattgttagggtcattttttttttctttgagacggagtctagctctgtcgccaggctcaagtgcagtggtgcgatcttggctcaccgcaagctccacctcctgggttcaagtgattctcctgcctcagcctcctgagtagctgggattacaggcgcccgccaccacacccagctaatttttgtatttttagcagagacaggctttcaccaggttggccaggatggtttctatctcctgaccttgtgatccacctacctcggcctcccaaagtgctcgaattacaggcgtgagccaccggcgcccagccaggttcagtcatttttaatgatctcagatgaccaagccagcctttggagggttctctgtcttacttctgactttacttgtggtgtgaccatattcattataatctcaaaggaggaaaaaaaaaaaaaaaaaaaaccttgtttaaaaaaaaaaaaaaagcctgggcgcggtggctcgcgcctgtaatcccagcactttgggaggccgaggtgggtggatcacgaggtcagaagatcgagaccatcctggctaacatggtgaaaccccctgtctactaaaaatacaaaaaattagccaggcgtggtggcgggagcctgtagtcccagctacttgggaggctgaggcaggagaatggcgtgaacccgggaggcagagcttgcagtgagccaagattgtgccactgcactccagcctgggcaacagagcgagactacatctcaaaaacaacaacaacaacaaaaagtctcgttctgagcattccagtagcttctttagtgtatgtagttagttgtaccataagtagttggtttgtgtgagatggttaaaaaggccaaagataaaatgtttcatttatttgccttttttgtctatgaaatggctgcttatttatttaggcctatttgatgtatgtgtgaaacaatattgtgcaacaataaacccaaattttattttgctgagttgttctaacagcaacaaaaagaagttaaggaagagaagaagaccagcaaatgcaaccacagagtgactagtgaagtagatgaaaactgaggccgggtgtggtggctcacacctgtaatcccagcactttgggaggccgagtcgggtggatcacctgaggtcaggagttcaagaccaacatggtgaaaccccatctctacaaaaaatacaaaattagccaggcgaggtggctcatgcctgtaatcccagctacttgggaggctgaggcaggacaatcacttgaatctgggaggtggaggttgcagtaagccgagatcatgccattgcactccagcctgggcaacaaagcgaaactccatctcaaaaaaaaaaaaaaagaaaagaaaactgaaaagtaaggtgacctcaaaggccactgaagaaagtgtttccaggaggaaggaatggtttacttggtcaaatgctgctgatcaaggagcaaagaggtctgagaagttaccattggatttatctgcgttaggccattggtgatcttaatgagcagttttggtgcagcggtgtttggaagcctggatgcagtgggtcttgtagactgagaagctaggaacacagcaagaataagctactcttttaaatcctgctttaatgggaatagaaatagagcaagagctggagagtgaagtggatcaaaagagttgatcttttgcagatgggagaacaaatagcattagaatgattcagtagagagaaaatattattatgtcagagaaagtggggagaactgttgaagtgatgtcattgaatgggcggcgggggcgttgagatttggttgacaagttagccttggataggaacatggacagttaatccattgtaacatgatttgatagatgtgattacagaggaggcataaggacatggatttgagtgctatcttgggctgggggttgggtaaagaaagatgacatgtctaatcttgaaaggcaagtgtttgtcaggtggacaaaaggctaaagtgcatttcatgtagaggaacaggcatgagcaaaggcagaaaggtattaaaccacctttcaggccaggcgtggtggctcacacctgtaatcccagcactttgggaggccaaggtaggcggatcacaaggtcaggagatcgagaccatcctggctaacacggtaaaaccccgtctctactaaaaatacaaaaaaaattagctgggcgtggtggcaggcgcctgtagtcccagctaatcaggaggctgaggcaggagaatggcgtgaacccaggaggcggagcttgcagtgagcccagatcatgccactgcactccagcctgggcgacagagcaagacactgtctcaaaaaaaataaataaataaataaaaataaaccacctttcaggacactacaagcagtgtggtgtggttggagtgctgggcatgtgcttgttggggggtgggggtgatgaggatgggctggtagacattacaacaaggtcaaggcaagggataggcagggtcttcctacagtatatttttccattaagaggcaacagagagcagtggaaggagcacagtttttttttgtttgtttgtttgtattttgagatggagtctcagtctgtcgcccaggctggagtgcagtggcacaatctcagctcactggaacctctgcctcctgagtccaagcaattctcttgcctcagcctcctgagtagctgggattagaggcgcccaccaccacacctggctaatttttgtgttgatgaggtttcaccatgttggccagacgtctcgaacttctgacctcaagtgatccgcccacctcggtctcccaaagtgctacgattacagccgtgagccaccatacccggtcctggagcacagtattcgatatgaaacacattacccagttaacatgtaaggccagagcagtatagagtgtaaataataattcacatttcatgggctctatgtggtatctatatgcatcatctcagtggattcttgcacatctttttgaggtaggtactattattaaacctattttgggtttatacaaattaatgacttaaccaaattcacacagccagtaaatagtagagtccacatttgaacccatagccatttgcacccagtgaactttttttttttttttctttttgaggcaaggtcttgctctgttgcctaggctggagtgcagtggcacgatcacggctcactgcagtctctacctcctaggctcaagagatcttccctaccagcctggccaacatggcgaaaccccatctctattaaaaatacaaaaataagccgggcgtggtggcatgtgcctgtaatcccagctactcaggaggctgagacaggagaagagcttgaacctgggaggtggaagttgcagggagccgagatgacaccattgcactccagcatgggcaacagagtgagattccatgttaaaaaaaaaaaaaggccggacgcattggctcgcgcctgtaaccccagcactttggaaggccaaggcgggcggatcacgaggtcaagagatcaagaccatcctggccaacatggtgaaaccctgtctctactgaaaatacaaaaattagctgggcatggtggcgcatgcctgtagtcccagctgctccggaggctgaggcaggagaatcgcttgaactcaggaggtggaggttgcagtgagctgagatcttgccactgaagtccagcctggcaacagagcgagactccatctcaaaaaagatcttcccacctcaacctcccaagtagttgggactacaggcgcccaccactatggctggctgattttttgtatttttagtagagacggggtttcaccgtgttagccagggtggtctcgatctcctgacctcgtgatcggcccgcctcggcctcccaaagtgctgggattacaggcttgagccactgggcccggcccacgcctggctaatttttaaaaatatttttgtagagatgaggtcttgctatattgcccaggctggtcttgaactcctgggctcaagctatccacatgagccaccatgcccagcccccattaaacttttttttttgagatggagtctcactctgtcacccaggctgaagtacagtggtgcaatctcagctcactacagcctctccctcctggggtcaatggattctcctgcctcagcctcctgagtagctaggattacaggcgcacgtcaccacacccagctaatttttgtatttttagtagagacagggtctcgaactcctgacctcaagtgatccacccgccttggcctcccaaattgttgggattacaggcgtgatccaccacgcctggcccccgagttttttttttttttttgagacggagtctctctctgtcgcccaggctggagtgcagtgttgccatctcggctcactgcaagctctcctcttgagtaaactcttaatggctacactattttcctggctaaaacactgcagctggaatcagaagtctgaaagttgaggcccagccctgccacttgtagctacttggcattggccaagcgaagccatgtctccaaggctgtatttcccccaaccttctttcaaatagtgacttccaggattgtgaaggccaaattaaatgtgaaaatataatgaagtaactctaaaattaatagttactagttatcaaagtagcatcctggcctccagcatgtcttcccctgactttccccaccccttggaaccctgctgaattttttatttatttatttatcctttgagacggagtctcattctcttgcccaggctggagtgcagtggcacgatctcagctcactgcaacctccgcctcctgggttcaagcgactctcctgcctcagcctcccaagtagctaggattacaggtgcacactgccatgcctggctaattttttgtatttataatagacacagggtttcaccatcttggccagaccggtcttgaactcctgacctcaagtgatgcctgccacagcctcccaaagtgctgggattacaggtgtgagccactgaacctggactttagcacctttttatgtgcttattggccatttgtgtatcttctttagagaaaagtttatacaagtcctttgtctgttcttaaattgtgttcttttttgttctgagagtttttcatatattctagatagaacgcacttatcagatgtatgacttgcaaacattttctcccattctgtagattgtcttttcactttctttctttttttttttttttgagacggagtcttgctccatcgcccaggctggagtgcagtggcacgatctcagctcactgcaagctctgcctcccgggttcacgccattctgctgcctcagcctcccgagtagctgggactacaggcgcccgccaccacatccggctaatttttttgtatttttagtagagatggggtttcaccatgttagccaggatggtctcgatctcctgacctcatgatccgcccgcctcggcctcccaaagtgctgggattacaggcgtgagccaccgcacctgacctttactgtaccttttctgtgttgaggtatgtttagatacatcagctgaaccattatgttagaattgcctacagctggctgagcatggtggctcacgtctataatcccaggacttttggaggctgaggcagaaggatcacatgagccctggagtttgagactggcctgggcatcatagtgagacccccatctctacaaaaagttaaaaaaaaattagtagccagatgtggtggcatgcacctgtggtcctagctacttgggaggctgaggtgggaggatcatttaagcccaggttgatgctgcagtgagctgtgatggcaccactgcactccagcctaggcaacagagcgagactctgcctctcaaaaaaaaaaaaaaattgcctacagcattcagtacagtaacatgctgtacaggtttgtagcctaggagcaataggctgtatgatatagtctgggtgtgttgtaggctatagtgtctaggtttgtgtaagtacactctgtgatgttcacacaatgaaatcacccaatgacgtatttctcagaatgtatccccatcgttaagtgatgcatgattgtattttgtttgtttcatcttccaggtgaacaactttgtgatctttgaaggcttctttgcccatcaacatcgtaagtttttgcattttgttggtcacgtagtcggggtgagggaaaggaaagagctggactcttggtcctgccgacccctcactgaggggccccgccgcttccttcctcacagggccccctgctccctctctgagggcaactcgacactctcgtgctgctgcagtcgatcccacgcccgctggtaaagcctgtattgaaggggtggaactgtagtgcagtgatggctacttactctagatgccacggggtacagtgccatctgtgggcaattttggaaaattctaaagcaacccaagtctccagcagtcatgactgtttgcctttgccctcatgggagctcagtgcattttatatttggcaagacttttaactaagcaagctcattgggagcctgtttgacagctgatatcaatggaccctcttgccagttcaggtccgtcaacataggccagagtcaggctcctttgtaaaccccaggcttctgttagccagtgagggacaggctggtgcaaacagcccttccatttgcagtcacagaatagtgacacaaatggcccaaaatttaaatgttacttttagaagataacactcagagtttataacatttccaaccagataatgaaattgatatggagaaaccaaacctcagaggcactaaaatgctgtccagattccccatcccatatacacacatacacacacacacacacacacaaacacacttactgacagtctgagccccactccttcctcttcctcaccacctccaccttaccaacttctgacagctgtacagtgcttgcttgcacagaagagcccccttcctgagctggctctgtggccaggaaaggatgtaaccaccatccaaacagcagtctgtaaccagctatgagcatcacagtgtcaggcactgagaggcacctcaactcgctttggtttccaaggcttctcccatttagcttgttcagaaccacaggctgtgagagggactgagggccaacaaggatggtgaggtctcaggcctgcaggggagggtgctgtggataaagcttaagtgaatttgctgagaagtctttcatttgccacacatacatgatggagaatctcttgagagggaaagccgggagcaagtagagaagtgaggagggggaggctgaactttggacattacatcagcctcctgcttactctgatagctccctttcagatgcccatatttattttcttttttttttttaacctaataaaacttcagtctcttcccattttcgtataggaaggagagattgtgccctccttccaaacctcccctgacctctccagagcaattcctgattaaccaagggctttgtccatctcatccagaggaacccagggtcctcgttggcccggctgggaccattccactgccccagaataccagggggccatgacagcacccactgacagtaagagctcacttcccttggctgcccttctcctgcatctcccaggcccccagagtctccccttcgatctttctccctagctctgtgtttggcctactccttctggctttcctcaacagtgttccacattcccctcaaattcccttttggtgtgctggcattgccatggtgctgctcctgcaagttctcaggaggaactgtggtgtcagggagcagaggtttggggttggggtatagtggctgggaggaggggtgcaaagtatgtctcctaacgcttaccctgcctatgtcccctccactgccagctccagcaaggaagctgccacccaagagagcagagggagacatcaagccatactcctctagtgaccgagaatgtaagaggggcaagggtcgggtgtctgggcctggggtaccttaacacaagggaagagaatgctcaggggacccagggaaaggattcgttctctctaaagactcagatttcttgggctgggcatggtggctcatgcctgtaatcccagcactttgagaggctaaggcaggcagatcgcctgagtccaggggttcaagaccagcctggccaacatggtgaaaccccgtctctactaaaaatacaaaaattagctgggcacggtggcacgtgcctgtaatcccagctacttgggaggctgaggcaggagaatggcttgaacccaggaggcggaagttgcagtgagccaagatcgtgccactgcactccagcttgggtgacagagtgagactccgtctcaaaaaagaaaaaaaaaaaaaagaaagactcagatttctctttttttctaccaaaacctttgctgtcatgactctcttccttttttcttctttttctgtcttgctcttcattctccctgtccccagttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccaggtaataggagttgaagggctaaggagcctcacagctataaaagaggatgttagaaatggcaaagggcaatttgaatccatcagagagatggatcaataagatgggtggcttggggggggtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctcccccgccccccgccatttcccatctcccttcctcccatccataacatccttccacagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaccaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaagttgtcagcctcatttgtgcgtcatcccttattttcctgggatctcaggacctctgtccctctcatttctcacttctgagatctgcacatcttttacccaggagcctcagagctcctgagtctggtgtctgcctatccccatcttcactgttagtcctcctgcagattctgtgtctcctttcatgtaggtgctggatccctgtgtgtgggcttccgtatctactccctcattccctccaggaacctccagctctccccagtgacttctaccctttactctgggcgtgcctttgccaagatgtcaaagcttaccaacatctctggatccactaattacctcctgcctcctgtattcgtcttcccactctgattacctgacgtctgctccactaaaccgctggatctctctcaagacaaacccttacctccattgagagtgcaacacagtctgtcaccctatttacagaggcccccttccttttcctcctaaattcaaaattcagccttgtcacttcctatttccctctggtctaaggaatctttttttttttttttgagatggagtcttgctctgtcgccaggctggagtgcagtggcacaatctcagctcactgcaacctccgcctcctgggttcaagcgattctcctgccttagcctcccaagtagctgggattacagaagtgcaccaccgtgcccagctagtttgtgtatttttagtagagacagggtttcaccatgttggccaggttggtctcgatctcctgatcacgtgatctgcccgtcttggcctcccaaagtgctgggattacaagcctgagccaccgcgcccagcctggtctaaggaatcttatagttaaggtaaccctgttttccaaaccaaacaccagagtacccgatccaacacatttttgaccacatgtgagtctgttcttctgacatgatttggatcacacctagccatagatttaacacattacctcaactagaaagaatagagcaataaatcagaagcactccagaaaatcttgggtataaaatgaacttcccccgcccttttctggggcacagctttgattaaaacctgttaggaatgataattacccccttctctttgttcctgtgctattccttttactcctctcctctgattcctccatacccacccatctttcatccagtagcctcctccccatcatctcccatttcttctacagggggactcccccaggtctggtagcccaaagctgctgctacagccgccatgggggggtgaattcctcatcccccaatacaggtaagtattcactcctccctaccctcaaatcaagtaggccacattcactgtctactcctgccttcccattcacatgcctgatatttccacaggcaaccaagactccaagcagggagaacaggaaacaaagaataggtgaggtctaaacccctcccctaacagcctcccaccaccatctgactcccttcctaacatcattctcagtcacttcctactcttaaatcttattgtatgaactggacaccagctcctcccacaattccttctaccttacatcctgcaagcccctttcccccacaggttcaactctggtacttccctttggaatacggattctctgagaggttttaaatttggacatagcactaatggttccagcttcatacccatcatgtgtcctacattaaaacctggcccgagaccttgaagagtctgtaatcttaatttcctctttagtattcctataacccactctccatctccccacctaccaggtctgccagtgaggagcaggccttgtcacaggatgggtctggggagaagcccatgcacacagctcctccacaggccccggccccgccagcccagtcctggacagtgggtggggacatactcaacgccaggttcattcgaaacctgcaggaacgtcgcagcaccaggccttggtgaccgcagccccgtcaaacatcttcaaagtattatttctccctcactacaggaaagagccaaagcccaaccctcataatagatggatacattcattcattcattcattcagcaggcttatcagattcaagtcatttgtatcttttaaccagaccaataaaagtatttatttttatcacaagagctgttgaaaaatttgactcattatttcagccgcctcacccctcactgtcgttgcacccattcagccttcagccctgtttttgctcagctttttgctcaaaggcctcagctgtgaatacagcgcttgggggggcgggggaggctgtaacttgcgcaagcgcactcaggcagtctccgagcccgcgggcgcaggcgcgcttacagccgacagagcgcttcagccgcttccctcgagcctgcagtgcgcaagcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggtgagcggaggagaagagggagggaggagagggggcggggagagaccctcctcaaagccggtgcgtggggcggagcgcgcgctgggttccgcgcaggcgcagagacacccgccgccccttcccacctgtgccctgcagcgcgtggacaggctaggggtcgcgggagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggtacccgagcggtccgcccgccttccctgcagtgagacgatcccctggggggttccttgggagcggagggactcgggtgaggcctaactttgggtgacctccccttgcagtttcaacgtcggtaaacccaggagagtgaaggccagcctttaactgtctcctgaggttgtgtctgtcattagaggggcccgaaatgataatagcttccatttatgtactgctttctaggtcgctacgttttgtttacattcattatttcatataggcctcataacccagtgaggctttattgttctcatttataggacatttgtaggaagcggaggcatagggaatgagaatgcctaaagttacatgatagaattcagattcctagcttcagctggatattcttttttctctgtacatttgcctcgcacacttaatcatggagatgtacaggccacagcatttaatccacagtacaataaaacctgttattcgttaactcatcaagtatgtattacatgattcttgcgataagagaggtgaaactgcccccagtgttggaatctttttttttttttttttgaaatggagtcttgctccgtcacccaggctgaagtgcattggcaccatctcggctcactgcaatctccgtctcctgggttcaagcaattctccttcctcagcctcccgagtagctgggactacaggctcccgccaccacacccggctaattgttttgtatctttagtagagatggggtgtcaccatattggccaggctggtctcgaactcctagacctcgtgatccgcccgcctcggcttcccaaagtgctgggattacaggcgtgagccaccgcgcccggccacatttctttaagattccaacactgggccgggcacggtggctcacgcctgtaatcccagcactttgggaggccgaggtgggcggattacctgaggtcaggagttcgagaacagcctggccaacatggtgaaaccccatctgtaactaaaaatacaaaaattagccgggcgtggtgaagggtgcctgtaatcccagctactcgggaggctgaggcaggagaatggcttgaacccaggaggcggcggttgcagtgacccgagttcgcgccaatgcactccagcctgggcgacggtgagacttcgtctcaaaaaaagaaaaaaaagtaaaatgtctgctaggttttgggaggtgccggtatttatgtcacataaaacagtttgctcggctgggcgcggtggcccacgcctgtaatcccagcactttaggaggcagaggcgggtggatcacgaggtcaagagatgaaaaccatcctggctaacatggtgaaatcctgtctctactaaaaatacaaaaactagctgggcatggtggcgcgcgcctgtagtcccagctactcaggaggctgaggcaggaaaatcacttgaacccgggaggcggaggttgcagtgagctgagatcgtgctactgcactccagcctggcaacagagcgagactccatctcaaaataaataataaaataaaatggtttcctcctgttttcagtagagatggagatgaatccatcccttttttcctatagtaattccatccattctgtcaggaggaataggtattggaagcctgttgagcatccaggggatcaaggggtgttagacaagtggattcttatctttctcccttctgttctttctccttaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagaggtaagtcagtgcaaaagtggccttcgtctacagtgggaaggatgtgggtaatccttggacgtacagggatagtcaactggattcttttttggaaccatgaggcaggcatagaaatatattataaacattttcctgagaaaatgatgttccagccaggcacggtggctcaaagtgctgtaatcccagcactttgggaggcttaggcaggtggatcacctgaggtcaggagttcaagaccagcctggccaacatggtgaaaccccatctctactaaaaacacaaaaatcagccaggcatggtggcagacgcctataatcccagctactcaggaggctgaggcaggagaatcgcttgaacccaggaggcgcagtgaaaggagatatctccattgtactccagcctaggcaacagagcgagactccgtctcaaaaaaaaaaaaaagaaagaaaatgatgttcctcattttgggttaagggaggttaatcatgggatgagatctttcactccaagatgggagtaaggaggccttaaaaatagaaaactgggcctggcacatggctcacgcttataatcctagcactttgggaggccgaggcaggcggatcacaaggtcaggagttcaagaccagcctggccaacacagtgaaaccccgtctctactaaaaatacaaaaattagctgggcatggtggtgggtgcctgtaatcccagctactcgggaggctgaggcaggagaatcgcttgaacctgggaggcggaggttgcagtgagccgagattgtacctctgcactccagcctgggcgacagagctagactccatctcaagcctgtaatcccagctactcgggaggctgaggcaggagaatcgcttgaacctaggaggcggaggttgcagtgagctgagattgtacctctgtactccagcctgggcgacagagctagactccgtctcaaaaaaaaaaaaaaattagaaaactgaaaaataggattatcttttctttcccactgggttgatgccatcttcttccacctagcttcccaagctcttccttcagtcccacgactacagtctgtattccttggatgtggaattcatcaatgagatcctcaacatacgtaccaagtgagaattggggcacaggtagggcactggggaggaaaagcacccaaaggtatatacatgacccttttcacttcccagagaagttcctagactgcttctcacagctgttccccattccttagaagccagtttggttttctaattctgccatcatgagatttctttcccatcccttcttcacaggggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggtaagagagaaatgagaaaggacccaaactataatcagttccttttttttttttttttgagacggagtctcactctgtcacccaggatggagtgcagtggcgtgatctcagctcactgcagcctctgcctcccggcttccagcaattctccagcctcagcctcctgggtagctggaattacaggcacaccatcacacccggctaatttttgtatttttagtagacagagggtttcaccatgttggccaggctggtctcgaactcctcaccttaggtgatccacctgccttagcttcccaaagtgctgagattacagatgatctagtctcccagacaacccttgacctatcctcacttgactgtttaaggacagggatcctgtttagtttatgttaatgttaaaaaaaaaatagagactgggtatattagaaaaacctctgagcttcagtttcttcctatacagtgcctagcacatggtaggtactcaaatacttactgaacagactgggtgtggtggctcatgcctgtaatgccagcactttgggaggccgaggtgggcggatcacttgaggtaaggagttggagacctgcctggccaacatggtaaaacccaaaaaaatacaaaaattagcccagtgtggtggtacacacctgtagttccagctacttgggaggctgagatgagagaatcacttcaacctgggaggttgaggttgcagtgagccgtgatcacattactggactccagcctgggtgacagagtgaaaccctgtcacacacacacacacacacacacacacacacacacacacacacaaaagtactgaacaaatgaaaagtcctgtctcatatgttgagccttacaacctggtaaatttccgcctgggagtagaatcccaataaattgttagactcagccacaaacattggatataagtttttaaaccagcagttcccaaactgctgcacagtagaaatgcccaaggatcgttaaaaaatattgacgccaaacactctgatttaattgagacagggcacaacctaagcactgagatgtttgtaagttgcccaggtgatctaatatgtagcagaatttagggactactcgtttaaacaaatgcttgaattcagctttgggaccagtcaccttctccctcagtaagcctccctctattccccaggacctatgatgcctactccactttctacctgaattccagtggcctcatttgtcgccatcgtctagataaagtgagtcctaggtagggctgggtggggtaaagggtagaacatttgtgtgcctcccccaactggcattaacctttctccctgcagctgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaaggagctggtgtcaggttctgtttacgtccttctcttaccctagctcttctcgtgttttgcctatttttttgggcattttcttagcatggggatcttctagctccttggccttataataatggggagccacctccagaagccaactgctctcaatctccagtacctaggagagagaaaagatcaatggagttcccttctttccaacatagatcttttgttgttgttatttttttttcttaaattgaaacagagtcttgctctattgcccaggctggactgcagtggcgtatcatggctcaaagcagtcctactgcctcagcctcccaagtagctgagactacaggcacacatcacagtgcaccattaattttttgtatagttggggtctcactatgttgcctgggctgatcttggcctcccaaagtgctgggatggtttacaaaaatgagccactatgcccagccccaacctagatccttatgtgtatggtcaaaagttatctttcctctttgactgcagggctaggtgtaaaggtgcctggctctattattatatacccaaagggcagatacacctctgtatgttattcaagataccaaataagctattcccaagaaaagtctagaacaacatgccaggcacagtggctcacacctgtaatcccaacactttgggaggccgtggcaggcggatcatgaggtcaggagttcgagatcagcctggccaacatggtgaaacccagtctctactaaaaatataaaattagctgggcgtggtggtgggcacctgtaatcccagctacactggaggctgaggcaggggaatcacttgaaaccgaaggcggaggttgcatgagctgagatggtgccactgcactccagcctgggctacaacagcacggaactctcaaaaaaaagaaaagcctagaacataaagactatactctgtgagaccagagactgctttgttcattatagccccagcacctatacagtagccattcaaatatttattgaataagtgtctagttctcagatcttggaagatgctgacacacctgttagaaaggatgtctttgggctgggcatggtggctcacacctgtaatccctgcactttgggaggccgaggcaggcatttgagaccagcctggccaacatggtgaaacctcatctctactaaaaataacaaaaattagccaggcctggaggcttgcgcctgtaatctcagctacttgggaggctgaggcatgagaatctcttgaaccccagaggcagaggttgcagtgaggctagattgcgccactgcactccagcctggacaacagagtgagactccgtctcaaaaaaaacaaaaaaaaacaaaggatgtctttctattttaccctaccttcctctttctgtaccagtcccagcaacttgaacctgggttcttagcttgccaggacaccatctctctacatagtctccacctgcgtgggcacaggatgttctcctcacctgtctcatgaactctttggtggtcaagacaagttcgtggtagagcagccagcgtggctgttgctcaaagagggaggagttgggatgaatgaagactgtctgctgctgtttcactgtgcggtagccactccgagtcaaccgtgccgtgtggtaaaagtaaccagcagtgatggcctaaggagcgggcaggaaagaaaatcaatggaaaaggcagacatctggggaccctaagaatgcactacctttttagttcaggcttcaggaaaactagagaggtaaggaatgcatgaagaacttcccaggaatgaaccttcagtggtctggggaagaaagggccctgggaggacacgtcatacacaaggggaagagggcatgctctcacgctggaggaaatgctgcatgcccccagagaagcttgctcctgggaaggtactgggggtggaaagcaggaggctgaagaaatgctgaccttgcgtacacggatatagtccccctggcaggaactgagaccaacttccacacgttccaagagcccttccagctgttcccgcacatcccgggctcggcgcatcgatctgaactgtacaaagttctcatagcaccactgggaagagtaaccactctcagcccactgggaagacagttaaaaagaaaggagagataattaagtatacagcaggactaaagtcccccagtgtctctcattcccactcacccaagcccagtgacctgtgtgtaaacatttagcagaaccaggtggtcaccgccagggagaaagaagttgacacgggcattgtcagcatggacgaccttgtcctttggtcggtagaagatggagttgttgacagagagcatggcagccactgtcaggatctcctctgaacagctgtacctgggacaggaaggggaaagcatgagttcaaagcaagacacataggaacagatatggtggagtggggagtgatcactgtgtgatggatgtttcctcatgtggggaaggctggttggcataatggctacaaagcagccagcagatagattctggcagcagcttgggggtcaaggaagtaggggccatagatgaaacacagtcacaaaggagggacatccatggaggcaggagcaggaaacaccggggaattctgaggcttctgcagaaagtgtgcattcactatgtgcatttggaaaagatctctgacagcagaggaatggcatttaaaggtcatccctccacagctacatctaaatgttctagttggaaaccttaggaacaagtaagttcctcaaggggccgggcgcagtggaatcaaggataggatcaagtgtcttacccttgtgggcctcaaaagggggcaatcagagttatctaatactttattatgtgttaagggatagtatgatgaacagaaaaagacagacaaaggggaccctggagacagaggaggcctggcctgtttgtgtgctgggggcccaggtggaggcgagggcttacttctcagaggctaagatcattttggacagcatggggtccaccggcagctctgccatctttcgaccagactaaggagaagagagagagagttgagcccagtcctccctcaggtttcccgctactactacaggggtccctggagccatcctgacccctatcatcctgcctccacccatgctgtcccccgactcaccgtggtgagctccccaaggtggttgagggctcccagagcatacagctgctccaaagccagcagcagtgtctcatatggtggagggtccaggaaatcaaagtgcattaggtcatggatccctagaaagaggtgtgatggatggaacagagtcccttcaaaggacagtgactccagcccctccctcctctctcaggtagcccaatcacctaagctcttgagcagcaacacgacattgcccaagctggtcctctggatctcaggcactgtggtttcctcaagctcgtgctgataggcccaggcggtatacaggcggaagcacttccctgcagccacccgacctgccctgccagctcgctgattggctgaggcctggaaagaaaggggaacaggctggctgacaatttggtcagggaaaagaaaaaggcagtatt

SEQ ID NO: 329 - DNA, 25672 bp, Homo sapiens
cacgatcacggctcactgcagtctctacctcctaggctcaagagatcttccctaccagcctggccaacatggcgaaaccccatctctattaaaaatacaaaaataagccgggcgtggtggcatgtgcctgtaatcccagctactcaggaggctgagacaggagaagagcttgaacctgggaggtggaagttgcagggagccgagatgacaccattgcactccagcatgggcaacagagtgagattccatgttaaaaaaaaaaaaaggccggacgcattggctcgcgcctgtaaccccagcactttggaaggccaaggcgggcggatcacgaggtcaagagatcaagaccatcctggccaacatggtgaaaccctgtctctactgaaaatacaaaaattagctgggcatggtggcgcatgcctgtagtcccagctgctccggaggctgaggcaggagaatcgcttgaactcaggaggtggaggttgcagtgagctgagatcttgccactgaagtccagcctggcaacagagcgagactccatctcaaaaaagatcttcccacctcaacctcccaagtagttgggactacaggcgcccaccactatggctggctgattttttgtatttttagtagagacggggtttcaccgtgttagccagggtggtctcgatctcctgacctcgtgatcggcccgcctcggcctcccaaagtgctgggattacaggcttgagccactgggcccggcccacgcctggctaatttttaaaaatatttttgtagagatgaggtcttgctatattgcccaggctggtcttgaactcctgggctcaagctatccacatgagccaccatgcccagcccccattaaacttttttttttgagatggagtctcactctgtcacccaggctgaagtacagtggtgcaatctcagctcactacagcctctccctcctggggtcaatggattctcctgcctcagcctcctgagtagctaggattacaggcgcacgtcaccacacccagctaatttttgtatttttagtagagacagggtctcgaactcctgacctcaagtgatccacccgccttggcctcccaaattgttgggattacaggcgtgatccaccacgcctggcccccgagttttttttttttttttgagacggagtctctctctgtcgcccaggctggagtgcagtgttgccatctcggctcactgcaagctctcctcttgagtaaactcttaatggctacactattttcctggctaaaacactgcagctggaatcagaagtctgaaagttgaggcccagccctgccacttgtagctacttggcattggccaagcgaagccatgtctccaaggctgtatttcccccaaccttctttcaaatagtgacttccaggattgtgaaggccaaattaaatgtgaaaatataatgaagtaactctaaaattaatagttactagttatcaaagtagcatcctggcctccagcatgtcttcccctgactttccccaccccttggaaccctgctgaattttttatttatttatttatcctttgagacggagtctcattctcttgcccaggctggagtgcagtggcacgatctcagctcactgcaacctccgcctcctgggttcaagcgactctcctgcctcagcctcccaagtagctaggattacaggtgcacactgccatgcctggctaattttttgtatttataatagacacagggtttcaccatcttggccagaccggtcttgaactcctgacctcaagtgatgcctgccacagcctcccaaagtgctgggattacaggtgtgagccactgaacctggactttagcacctttttatgtgcttattggccatttgtgtatcttctttagagaaaagtttatacaagtcctttgtctgttcttaaattgtgttcttttttgttctgagagtttttcatatattctagatagaacgcacttatcagatgtatgacttgcaaacattttctcccattctgtagattgtcttttcactttctttctttttttttttttttgagacggagtcttgctccatcgcccaggctggagtgcagtggcacgatctcagctcactgcaagctctgcctcccgggttcacgccattctgctgcctcagcctcccgagtagctgggactacaggcgcccgccaccacatccggctaatttttttgtatttttagtagagatggggtttcaccatgttagccaggatggtctcgatctcctgacctcatgatccgcccgcctcggcctcccaaagtgctgggattacaggcgtgagccaccgcacctgacctttactgtaccttttctgtgttgaggtatgtttagatacatcagctgaaccattatgttagaattgcctacagctggctgagcatggtggctcacgtctataatcccaggacttttggaggctgaggcagaaggatcacatgagccctggagtttgagactggcctgggcatcatagtgagacccccatctctacaaaaagttaaaaaaaaattagtagccagatgtggtggcatgcacctgtggtcctagctacttgggaggctgaggtgggaggatcatttaagcccaggttgatgctgcagtgagctgtgatggcaccactgcactccagcctaggcaacagagcgagactctgcctctcaaaaaaaaaaaaaaattgcctacagcattcagtacagtaacatgctgtacaggtttgtagcctaggagcaataggctgtatgatatagtctgggtgtgttgtaggctatagtgtctaggtttgtgtaagtacactctgtgatgttcacacaatgaaatcacccaatgacgtatttctcagaatgtatccccatcgttaagtgatgcatgattgtattttgtttgtttcatcttccaggtgaacaactttgtgatctttgaaggcttctttgcccatcaacatcgtaagtttttgcattttgttggtcacgtagtcggggtgagggaaaggaaagagctggactcttggtcctgccgacccctcactgaggggccccgccgcttccttcctcacagggccccctgctccctctctgagggcaactcgacactctcgtgctgctgcagtcgatcccacgcccgctggtaaagcctgtattgaaggggtggaactgtagtgcagtgatggctacttactctagatgccacggggtacagtgccatctgtgggcaattttggaaaattctaaagcaacccaagtctccagcagtcatgactgtttgcctttgccctcatgggagctcagtgcattttatatttggcaagacttttaactaagcaagctcattgggagcctgtttgacagctgatatcaatggaccctcttgccagttcaggtccgtcaacataggccagagtcaggctcctttgtaaaccccaggcttctgttagccagtgagggacaggctggtgcaaacagcccttccatttgcagtcacagaatagtgacacaaatggcccaaaatttaaatgttacttttagaagataacactcagagtttataacatttccaaccagataatgaaattgatatggagaaaccaaacctcagaggcactaaaatgctgtccagattccccatcccatatacacacatacacacacacacacacacacaaacacacttactgacagtctgagccccactccttcctcttcctcaccacctccaccttaccaacttctgacagctgtacagtgcttgcttgcacagaagagcccccttcctgagctggctctgtggccaggaaaggatgtaaccaccatccaaacagcagtctgtaaccagctatgagcatcacagtgtcaggcactgagaggcacctcaactcgctttggtttccaaggcttctcccatttagcttgttcagaaccacaggctgtgagagggactgagggccaacaaggatggtgaggtctcaggcctgcaggggagggtgctgtggataaagcttaagtgaatttgctgagaagtctttcatttgccacacatacatgatggagaatctcttgagagggaaagccgggagcaagtagagaagtgaggagggggaggctgaactttggacattacatcagcctcctgcttactctgatagctccctttcagatgcccatatttattttcttttttttttttaacctaataaaacttcagtctcttcccattttcgtataggaaggagagattgtgccctccttccaaacctcccctgacctctccagagcaattcctgattaaccaagggctttgtccatctcatccagaggaacccagggtcctcgttggcccggctgggaccattccactgccccagaataccagggggccatgacagcacccactgacagtaagagctcacttcccttggctgcccttctcctgcatctcccaggcccccagagtctccccttcgatctttctccctagctctgtgtttggcctactccttctggctttcctcaacagtgttccacattcccctcaaattcccttttggtgtgctggcattgccatggtgctgctcctgcaagttctcaggaggaactgtggtgtcagggagcagaggtttggggttggggtatagtggctgggaggaggggtgcaaagtatgtctcctaacgcttaccctgcctatgtcccctccactgccagctccagcaaggaagctgccacccaagagagcagagggagacatcaagccatactcctctagtgaccgagaatgtaagaggggcaagggtcgggtgtctgggcctggggtaccttaacacaagggaagagaatgctcaggggacccagggaaaggattcgttctctctaaagactcagatttcttgggctgggcatggtggctcatgcctgtaatcccagcactttgagaggctaaggcaggcagatcgcctgagtccaggggttcaagaccagcctggccaacatggtgaaaccccgtctctactaaaaatacaaaaattagctgggcacggtggcacgtgcctgtaatcccagctacttgggaggctgaggcaggagaatggcttgaacccaggaggcggaagttgcagtgagccaagatcgtgccactgcactccagcttgggtgacagagtgagactccgtctcaaaaaagaaaaaaaaaaaaaagaaagactcagatttctctttttttctaccaaaacctttgctgtcatgactctcttccttttttcttctttttctgtcttgctcttcattctccctgtccccagttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccaggtaataggagttgaagggctaaggagcctcacagctataaaagaggatgttagaaatggcaaagggcaatttgaatccatcagagagatggatcaataagatgggtggcttggggggggtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctcccccgccccccgccatttcccatctcccttcctcccatccataacatccttccacagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaccaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaagttgtcagcctcatttgtgcgtcatcccttattttcctgggatctcaggacctctgtccctctcatttctcacttctgagatctgcacatcttttacccaggagcctcagagctcctgagtctggtgtctgcctatccccatcttcactgttagtcctcctgcagattctgtgtctcctttcatgtaggtgctggatccctgtgtgtgggcttccgtatctactccctcattccctccaggaacctccagctctccccagtgacttctaccctttactctgggcgtgcctttgccaagatgtcaaagcttaccaacatctctggatccactaattacctcctgcctcctgtattcgtcttcccactctgattacctgacgtctgctccactaaaccgctggatctctctcaagacaaacccttacctccattgagagtgcaacacagtctgtcaccctatttacagaggcccccttccttttcctcctaaattcaaaattcagccttgtcacttcctatttccctctggtctaaggaatctttttttttttttttgagatggagtcttgctctgtcgccaggctggagtgcagtggcacaatctcagctcactgcaacctccgcctcctgggttcaagcgattctcctgccttagcctcccaagtagctgggattacagaagtgcaccaccgtgcccagctagtttgtgtatttttagtagagacagggtttcaccatgttggccaggttggtctcgatctcctgatcacgtgatctgcccgtcttggcctcccaaagtgctgggattacaagcctgagccaccgcgcccagcctggtctaaggaatcttatagttaaggtaaccctgttttccaaaccaaacaccagagtacccgatccaacacatttttgaccacatgtgagtctgttcttctgacatgatttggatcacacctagccatagatttaacacattacctcaactagaaagaatagagcaataaatcagaagcactccagaaaatcttgggtataaaatgaacttcccccgcccttttctggggcacagctttgattaaaacctgttaggaatgataattacccccttctctttgttcctgtgctattccttttactcctctcctctgattcctccatacccacccatctttcatccagtagcctcctccccatcatctcccatttcttctacagggggactcccccaggtctggtagcccaaagctgctgctacagccgccatgggggggtgaattcctcatcccccaatacaggtaagtattcactcctccctaccctcaaatcaagtaggccacattcactgtctactcctgccttcccattcacatgcctgatatttccacaggcaaccaagactccaagcagggagaacaggaaacaaagaataggtgaggtctaaacccctcccctaacagcctcccaccaccatctgactcccttcctaacatcattctcagtcacttcctactcttaaatcttattgtatgaactggacaccagctcctcccacaattccttctaccttacatcctgcaagcccctttcccccacaggttcaactctggtacttccctttggaatacggattctctgagaggttttaaatttggacatagcactaatggttccagcttcatacccatcatgtgtcctacattaaaacctggcccgagaccttgaagagtctgtaatcttaatttcctctttagtattcctataacccactctccatctccccacctaccaggtctgccagtgaggagcaggccttgtcacaggatgggtctggggagaagcccatgcacacagctcctccacaggccccggccccgccagcccagtcctggacagtgggtggggacatactcaacgccaggttcattcgaaacctgcaggaacgtcgcagcaccaggccttggtgaccgcagccccgtcaaacatcttcaaagtattatttctccctcactacaggaaagagccaaagcccaaccctcataatagatggatacattcattcattcattcattcagcaggcttatcagattcaagtcatttgtatcttttaaccagaccaataaaagtatttatttttatcacaagagctgttgaaaaatttgactcattatttcagccgcctcacccctcactgtcgttgcacccattcagccttcagccctgtttttgctcagctttttgctcaaaggcctcagctgtgaatacagcgcttgggggggcgggggaggctgtaacttgcgcaagcgcactcaggcagtctccgagcccgcgggcgcaggcgcgcttacagccgacagagcgcttcagccgcttccctcgagcctgcagtgcgcaagcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggtgagcggaggagaagagggagggaggagagggggcggggagagaccctcctcaaagccggtgcgtggggcggagcgcgcgctgggttccgcgcaggcgcagagacacccgccgccccttcccacctgtgccctgcagcgcgtggacaggctaggggtcgcgggagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggtacccgagcggtccgcccgccttccctgcagtgagacgatcccctggggggttccttgggagcggagggactcgggtgaggcctaactttgggtgacctccccttgcagtttcaacgtcggtaaacccaggagagtgaaggccagcctttaactgtctcctgaggttgtgtctgtcattagaggggcccgaaatgataatagcttccatttatgtactgctttctaggtcgctacgttttgtttacattcattatttcatataggcctcataacccagtgaggctttattgttctcatttataggacatttgtaggaagcggaggcatagggaatgagaatgcctaaagttacatgatagaattcagattcctagcttcagctggatattcttttttctctgtacatttgcctcgcacacttaatcatggagatgtacaggccacagcatttaatccacagtacaataaaacctgttattcgttaactcatcaagtatgtattacatgattcttgcgataagagaggtgaaactgcccccagtgttggaatctttttttttttttttttgaaatggagtcttgctccgtcacccaggctgaagtgcattggcaccatctcggctcactgcaatctccgtctcctgggttcaagcaattctccttcctcagcctcccgagtagctgggactacaggctcccgccaccacacccggctaattgttttgtatctttagtagagatggggtgtcaccatattggccaggctggtctcgaactcctagacctcgtgatccgcccgcctcggcttcccaaagtgctgggattacaggcgtgagccaccgcgcccggccacatttctttaagattccaacactgggccgggcacggtggctcacgcctgtaatcccagcactttgggaggccgaggtgggcggattacctgaggtcaggagttcgagaacagcctggccaacatggtgaaaccccatctgtaactaaaaatacaaaaattagccgggcgtggtgaagggtgcctgtaatcccagctactcgggaggctgaggcaggagaatggcttgaacccaggaggcggcggttgcagtgacccgagttcgcgccaatgcactccagcctgggcgacggtgagacttcgtctcaaaaaaagaaaaaaaagtaaaatgtctgctaggttttgggaggtgccggtatttatgtcacataaaacagtttgctcggctgggcgcggtggcccacgcctgtaatcccagcactttaggaggcagaggcgggtggatcacgaggtcaagagatgaaaaccatcctggctaacatggtgaaatcctgtctctactaaaaatacaaaaactagctgggcatggtggcgcgcgcctgtagtcccagctactcaggaggctgaggcaggaaaatcacttgaacccgggaggcggaggttgcagtgagctgagatcgtgctactgcactccagcctggcaacagagcgagactccatctcaaaataaataataaaataaaatggtttcctcctgttttcagtagagatggagatgaatccatcccttttttcctatagtaattccatccattctgtcaggaggaataggtattggaagcctgttgagcatccaggggatcaaggggtgttagacaagtggattcttatctttctcccttctgttctttctccttaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagaggtaagtcagtgcaaaagtggccttcgtctacagtgggaaggatgtgggtaatccttggacgtacagggatagtcaactggattcttttttggaaccatgaggcaggcatagaaatatattataaacattttcctgagaaaatgatgttccagccaggcacggtggctcaaagtgctgtaatcccagcactttgggaggcttaggcaggtggatcacctgaggtcaggagttcaagaccagcctggccaacatggtgaaaccccatctctactaaaaacacaaaaatcagccaggcatggtggcagacgcctataatcccagctactcaggaggctgaggcaggagaatcgcttgaacccaggaggcgcagtgaaaggagatatctccattgtactccagcctaggcaacagagcgagactccgtctcaaaaaaaaaaaaaagaaagaaaatgatgttcctcattttgggttaagggaggttaatcatgggatgagatctttcactccaagatgggagtaaggaggccttaaaaatagaaaactgggcctggcacatggctcacgcttataatcctagcactttgggaggccgaggcaggcggatcacaaggtcaggagttcaagaccagcctggccaacacagtgaaaccccgtctctactaaaaatacaaaaattagctgggcatggtggtgggtgcctgtaatcccagctactcgggaggctgaggcaggagaatcgcttgaacctgggaggcggaggttgcagtgagccgagattgtacctctgcactccagcctgggcgacagagctagactccatctcaagcctgtaatcccagctactcgggaggctgaggcaggagaatcgcttgaacctaggaggcggaggttgcagtgagctgagattgtacctctgtactccagcctgggcgacagagctagactccgtctcaaaaaaaaaaaaaaattagaaaactgaaaaataggattatcttttctttcccactgggttgatgccatcttcttccacctagcttcccaagctcttccttcagtcccacgactacagtctgtattccttggatgtggaattcatcaatgagatcctcaacatacgtaccaagtgagaattggggcacaggtagggcactggggaggaaaagcacccaaaggtatatacatgacccttttcacttcccagagaagttcctagactgcttctcacagctgttccccattccttagaagccagtttggttttctaattctgccatcatgagatttctttcccatcccttcttcacaggggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggtaagagagaaatgagaaaggacccaaactataatcagttccttttttttttttttttgagacggagtctcactctgtcacccaggatggagtgcagtggcgtgatctcagctcactgcagcctctgcctcccggcttccagcaattctccagcctcagcctcctgggtagctggaattacaggcacaccatcacacccggctaatttttgtatttttagtagacagagggtttcaccatgttggccaggctggtctcgaactcctcaccttaggtgatccacctgccttagcttcccaaagtgctgagattacagatgatctagtctcccagacaacccttgacctatcctcacttgactgtttaaggacagggatcctgtttagtttatgttaatgttaaaaaaaaaatagagactgggtatattagaaaaacctctgagcttcagtttcttcctatacagtgcctagcacatggtaggtactcaaatacttactgaacagactgggtgtggtggctcatgcctgtaatgccagcactttgggaggccgaggtgggcggatcacttgaggtaaggagttggagacctgcctggccaacatggtaaaacccaaaaaaatacaaaaattagcccagtgtggtggtacacacctgtagttccagctacttgggaggctgagatgagagaatcacttcaacctgggaggttgaggttgcagtgagccgtgatcacattactggactccagcctgggtgacagagtgaaaccctgtcacacacacacacacacacacacacacacacacacacacacacaaaagtactgaacaaatgaaaagtcctgtctcatatgttgagccttacaacctggtaaatttccgcctgggagtagaatcccaataaattgttagactcagccacaaacattggatataagtttttaaaccagcagttcccaaactgctgcacagtagaaatgcccaaggatcgttaaaaaatattgacgccaaacactctgatttaattgagacagggcacaacctaagcactgagatgtttgtaagttgcccaggtgatctaatatgtagcagaatttagggactactcgtttaaacaaatgcttgaattcagctttgggaccagtcaccttctccctcagtaagcctccctctattccccaggacctatgatgcctactccactttctacctgaattccagtggcctcatttgtcgccatcgtctagataaagtgagtcctaggtagggctgggtggggtaaagggtagaacatttgtgtgcctcccccaactggcattaacctttctccctgcagctgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaaggagctggtgtcaggttctgtttacgtccttctcttaccctagctcttctcgtgttttgcctatttttttgggcattttcttagcatggggatcttctagctccttggccttataataatggggagccacctccagaagccaactgctctcaatctccagtacctaggagagagaaaagatcaatggagttcccttctttccaacatagatcttttgttgttgttatttttttttcttaaattgaaacagagtcttgctctattgcccaggctggactgcagtggcgtatcatggctcaaagcagtcctactgcctcagcctcccaagtagctgagactacaggcacacatcacagtgcaccattaattttttgtatagttggggtctcactatgttgcctgggctgatcttggcctcccaaagtgctgggatggtttacaaaaatgagccactatgcccagccccaacctagatccttatgtgtatggtcaaaagttatctttcctctttgactgcagggctaggtgtaaaggtgcctggctctattattatatacccaaagggcagatacacctctgtatgttattcaagataccaaataagctattcccaagaaaagtctagaacaacatgccaggcacagtggctcacacctgtaatcccaacactttgggaggccgtggcaggcggatcatgaggtcaggagttcgagatcagcctggccaacatggtgaaacccagtctctactaaaaatataaaattagctgggcgtggtggtgggcacctgtaatcccagctacactggaggctgaggcaggggaatcacttgaaaccgaaggcggaggttgcatgagctgagatggtgccactgcactccagcctgggctacaacagcacggaactctcaaaaaaaagaaaagcctagaacataaagactatactctgtgagaccagagactgctttgttcattatagccccagcacctatacagtagccattcaaatatttattgaataagtgtctagttctcagatcttggaagatgctgacacacctgttagaaaggatgtctttgggctgggcatggtggctcacacctgtaatccctgcactttgggaggccgaggcaggcatttgagaccagcctggccaacatggtgaaacctcatctctactaaaaataacaaaaattagccaggcctggaggcttgcgcctgtaatctcagctacttgggaggctgaggcatgagaatctcttgaaccccagaggcagaggttgcagtgaggctagattgcgccactgcactccagcctggacaacagagtgagactccgtctcaaaaaaaacaaaaaaaaacaaaggatgtctttctattttaccctaccttcctctttctgtaccagtcccagcaacttgaacctgggttcttagcttgccaggacaccatctctctacatagtctccacctgcgtgggcacaggatgttctcctcacctgtctcatgaactctttggtggtcaagacaagttcgtggtagagcagccagcgtggctgttgctcaaagagggaggagttgggatgaatgaagactgtctgctgctgtttcactgtgcggtagccactccgagtcaaccgtgccgtgtggtaaaagtaaccagcagtgatggcctaaggagcgggcaggaaagaaaatcaatggaaaaggcagacatctggggaccctaagaatgcactacctttttagttcaggcttcaggaaaactagagaggtaaggaatgcatgaagaacttcccaggaatgaaccttcagtggtctggggaagaaagggccctgggaggacacgtcatacacaaggggaagagggcatgctctcacgctggaggaaatgctgcatgcccccagagaagcttgctcctgggaaggtactgggggtggaaagcaggaggctgaagaaatgctgaccttgcgtacacggatatagtccccctggcaggaactgagaccaacttccacacgttccaagagcccttccagctgttcccgcacatcccgggctcggcgcatcgatctgaactgtacaaagttctcatagcaccactgggaagagtaaccactctcagcccactgggaagacagttaaaaagaaaggagagataattaagtatacagcaggactaaagtcccccagtgtctctcattcccactcacccaagcccagtgacctgtgtgtaaacatttagcagaaccaggtggtcaccgccagggagaaagaagttgacacgggcattgtcagcatggacgaccttgtcctttggtcggtagaagatggagttgttgacagagagcatggcagccactgtcaggatctcctctgaacagctgtacctgggacaggaaggggaaagcatgagttcaaagcaagacacataggaacagatatggtggagtggggagtgatcactgtgtgatggatgtttcctcatgtggggaaggctggttggcataatggctacaaagcagccagcagatagattctggcagcagcttgggggtcaaggaagtaggggccatagatgaaacacagtcacaaaggagggacatccatggaggcaggagcaggaaacaccggggaattctgaggcttctgcagaaagtgtgcattcactatgtgcatttggaaaagatctctgacagcagaggaatggcatttaaaggtcatccctccacagctacatctaaatgttctagttggaaaccttaggaacaagtaagttcctcaaggggccgggcgcagtggaatcaaggataggatcaagtgtcttacccttgtgggcctcaaaagggggcaatcagagttatctaatactttattatgtgttaagggatagtatgatgaacagaaaaagacagacaaaggggaccctggagacagaggaggcctggcctgtttgtgtgctgggggcccaggtggaggcgagggcttacttctcagaggctaagatcattttggacagcatggggtccaccggcagctctgccatctttcgaccagactaaggagaagagagagagagttgagcccagtcctccctcaggtttcccgctactactacaggggtccctggagccatcctgacccctatcatcctgcctccacccatgctgtcccccgactcaccgtggtgagctccccaaggtggttgagggctcccagagcatacagctgctccaaagccagcagcagtgtctcatatggtggagggtccaggaaatcaaagtgcattaggtcatggatccctagaaagaggtgtgatggatggaacagagtcccttcaaaggacagtgactccagcccctccctcctctctcaggtagcccaatcacctaagctcttgagcagcaacacgacattgcccaagctggtcctctggatctcaggcactgtggtttcctcaagctcgtgctgataggcccaggcggtatacaggcggaagcacttccctgcagccacccgacctgccctgccagctcgctgattggctgaggcctggaaagaaaggggaacaggctggctgacaatttggtcagggaaaagaaaaaggcagtatttatgcaagaaatctggaaggatgcaaactgctcatcccggttccctaggaagcccccaccctgcttctgagttggaccttctctgtgggccaactccacctcccccactcccatgcatccccaggctgaccttgctgcagggtgtgacagtgagcgattccatgcctgtgcgggggttgtagctcttctgcttacagaaccctggatccagcacataaatgatgccctcaatggtgagtgatgtctcagcaatgttcgttgccacaaccacctgagtgataggatatggggtcacccagtgaccccacctacctagttacccagaaaaagtaatcttggaaagttaggagtagtgaagcagttgcagtaaggggcaggagctgagggaattagtagtatccaaggtcaggagcaggggacaaggccagaagacaggggacagggaagtgggggctgggagtcagcagggccataggaggaaaggaaatggagaagaggatttagggttttttttttttttcagagatgggaaatgggggtgttcaagttcctgcccgatcctccccatcaccgctttcgtcttcacacaacacttcctgtaagagcctcctaacgtgtatccctgcttctgctcctagcctctgtcacatggcatccaggatggtccttttaaaatacaaacctgtcacatcactccccatccttcagtggcttcctatcctactctagaattcaatccaagccccttaaaagcctggatcacctaccccagctgcctttctgacctcatctgctagcactccaccacctccctcactcctcccacacactgctttgctctgcccaagtaagtgcactcctcactggatcatttgcatcagctattccctctgtctggcatactcttctcccagatatcagcctggctccctccctcacctggtttgggtctctattccactttccccttactgaagaggccctccctacaccccaaggaaaataccttcatgccagtcctcactcccaccccacagagtcaagttccatcctactatgctgccttgtatctcttcatagcactggccacaaattgacaatatgtatttatgcatccactgcttccccgatagaccacaagtgcaagtttgttaggctaaggactttgttttgttcatcactgtatcatcaacccctgtgtacctgacacacagaaggaactcattaaatatttgttgaatgaaagttatatctctgctcaaaatcctttgactgctactcagctgtctaaagtccaaacttcgccaagcacagtggctcatgcctgtaacccagcactttgagaggccaaggcaggcggatcacttgagtccaggagttcaagaccagcctggccaacatggcgaaaccccatctctactaaaaattagctgggtgttggccaggcatggtggctcacgcctataatcccagcactttgggaggccaaggtgggcagatcacctgaggtcaggagtttgagaccaacctggccaaaatagcgaaacctcatctctactaaaaatacaaaaaattggccaggcgtggtggagggcacctgtaatcccagctactggggggctgagacaggagaatcgcttgaacctgtgaggcagaggttgcagtgagcagagttggtgccactgcactccagcctgggcgacagagtgagactccatctcaaaaaaaaaaaaaaaaaaattagcttggggtggtggtacacacctgtaatcccagctacttgggaagctgaggcacaagaatcacttgagcctgggaggtggaggctgcagtgagccgagatcttgccactgcactccagcctgggcaacagagcgagactctgtctcaaaaaagaaaaataaataaagtccaaactttcctgtcatcaaaggccctccctaatcttagccccaaattgtttttagccttgtctcctactccttcaccacatgaacctcccactaagcctactagctcacactctgacctcaaacataccttgggccttcctctgatgacttctcagccatttttcttttttgagatggagtctcgcattgtcacccaggctggagtgcagtggcacaatctcagctcactgcaacctcctcctcctgggttcaagcgattctcatgactcagcctcctaaacaggtgggattataggcgcacgccaccatgccctgctgatttttgtattttcagtggaggcagggtttcaccacgttaggcagcctggtttcgaactactgacctcaagtgatccgcccacctcagcctccgaaagtcctgggattacaggcgtgagccaccgcacctgacctcagacatttctcttaaaggtccatatcaaatcccacctcttagcacatcaaggacttcccttctccactgaatctactgtgcatactttccagatcacatatttggctctctcttggttcacaccatatttctcctctcttcagtcccaggaacaagggactggctgctcctcagctgtgtgcagcagtgcgcaggactcaccttgcatggggcaggcacacagctttttcactactagttgtgggaagcataggggtgaagagtgtgggtttctccaactgacctttcgtgccccaggtggtgtgggctggaagatacgggcctgcatgtcagagggcagattggcataaatgggcagcaccaggagctcccggattttggagcccaggcggcggcagcgatcctggagcatctcacaggcagcctcaatctcctcctggatagagggtagggagagcagcaggggtcccagagtcacagaaggccaacatgccggccctgtcttcccctgggatacatcatcccctctccccaccatgtcaggcacctgtcctgtcaggaacaccaggatatccccagggggctgggtcacatggatctgcaacacagatactacacaagcttccaagtagtcagcctctggagcctggagagcagaaagagatggggtcacaggagggccacctgcttaggcaaacctttcctctcctcccaattcaacatacactttatcctagttcccctttgaaccttccattccatctttccctccacaggataaccttctccaaaggcctcagcttttctgccacagacttaagcccatcctccctgagggggcaccttggtgtagaagatgtccacaggaaacctgcgtccggggattcgaaacacaggggcgtcatcaaagaaggtggaaaaacgggcagtgtccattgtggctgaagccaccaggaccttgagctcaggtcggaagcgagcaacatccttgatcaatccaaagagaatgtctgtgtgtagggtcctttcgtgtgcctcatccaccatcaccacgctggggagggaataggagagcaatgagggaagagcgctaggcaatgcagtatcagacaccagagttaactggatgagaggggagtaatggacacaaagagttcaagaatgactgttgacggagggggctctaaggagaagtcagccatcccacttatgtagagcaacagaaagtcagagaaggccagggccccatgatctgcaacctatcccagcctcagcagataataggagacaagatgtagaggctgcacactgaggccaggacaagttagccataccctctagttcagtcaagagtctgcttagactcagcagctgctcttactagaaaaagttgaaggatatgttttaggctgggcatggtggtagctcacgcctgtaatcccagcaccttgggaggccgaggcaggtggatcacaaggtcaggagttcgagaccagtctggccaatacagtgaaaccccgtctcttctaaaaatacaaaaaaaattagccagatgtggtggtagacgcctgtagtcccagctacttgggaggctgaggcaggagaatcgcttgaacctgggaggcagaggttgcagtgagccaagatcgtgccactgcactccagcctgggtgacagagcgagactccatctaaaaaaagaaaaaagaaaaagtggaaggattttttttttgagacagtcttgctctgttgcaggctggagtgtagtggcatgatctcagctcactgcaagctccgcctcctgggttcacaccattctcctgcctcagcctcccaagtagctgggactacaggtgcctgccactgtgcctggctaattttttgtatttttagtagagacggagttttgaaacagagtctcactctgtcgcccaggctggagtacagtggcacgatctcggctcaccgcaagctccgcctcctgggttgcgttcacgccattctcctgcctcagcctcctgagtagctgggactacaggtgcccgccaccacgcccagctaattttttatattttttagtagagacggggtttcaccgtgttagccaggatggtcttgatctccttacctcgtgatccgcctgcctctgcctcccaaagtgctgggattacaggcgtgagccaccgctcccggctgatacgttttaaaggaaaaaaaaagtggaaggcagggtccctttcaataagggtgggccagcaaggctgactgggggtaatagacctgagctgctgtgattcaaatagcctagaagctcctggtgtcctgtgggacaactgctgctggcatcattcttgactgtttcttcttttggagacaggagcaagttaagcctttctacctcaactctcacaggactctgcatgctccttggtttcctcctaactcagttatgtgcatgacaccttctttctctttgttctttggcttttctgggtggcagccaagtcccaggaactcatccccatcttcccctacccacctccctgacctcaactctttgtgcctaaccctaactgtgatggtgaagtccccagccattccacaaagcaggctggctcgatgggcaaaaacatctgcatcagacactcttgcgctggctggctctccatgggttcttagagatcttttgcaagggatatgaaggataaaatcctatctgtccaattgctccactgtgatcttccaagaccagaaattcacagcctctgaagagtcaaaaaggcacatattgttcagctggcctgaccccacccccattacattcatgaatcccttttccccctcaacacatgttcaaccaacccctgcttggccatttccagcactaagagctcattattcacagaccaagctacccaagacttgtgtggagggccaagacccagagtccaaccactctgacaggccctgcaatctccaccactctgagggttactcagccattggtattgagttggaatctgtctccctgtaacctccccatggctcctagctatgtcgtgtagggtcacataaaacaatctgatccttctttccatgtaacagccttcacatatttagagggaaccaggatgcttcctgtttctccctctgagctgagcattccaagtgttttcaaatggtcttcacacggtatttcaagtctcggcagcaatgctctgctatcctggttgttttctaaaccctggagatgaatggggaaagaagaggctttctctacaatctcttctgtcctccagccccatctccgtggtacctggaggtcagttcaaggaccatttgaaccacaaagattcaagaacgggtggattaatcagaagacaatggctgaattggctgggtgggaagaagggagagaaaggccagagattagagatacctgtaactcgccaggtcaggctcagagaggaactcccggagaagcatcccatctgtcatgtagcggaggacagttcgctctgatgtgcagtcctcaaagcggatgctgtagccaacctggtcaagggaaccattagcaaccaagtgtgggctggtgtgccctgaaaggaacttggggaaaggtgaagtggggcagcaccaagacttctgctgtagggacctgagggaactgtagactgagtcacagaccccagactctaccccccggttccctagaaatctcacctcattcccaagcttcacacccatctcccgggccactcgggcggccacactcatggcagccactctccggggttgggtgcaggcaatcttcatacccttgtttgtataaccctgaatgacaaagaaaaaagaagaagtttgccctttactaaatatgcaccctgggaccaggtacatttcagagaaagaagt

SEQ ID NO: 330 - DNA, 49935 bp, Homo sapiens
ctccaactcctgggctcaagcaatcctccagcattggcctcccaaagtgctaggattacaggcatgagccaccacgctgggccagactaatttttctttatgtgtaaagaaaccatctttatttgtagattaagtcctgctggttttgaattctaagtgctacatatttgtacactctgcaccacactgatgtcacttctgcctctaactagtctttaagctcatcctcttgctccactccagtcaacatggaagccagcatgatccttctaaaacacaagctagtctctccctaagcctccttatcccctgtgagaaggtgtcaaagttctttactatgatttgcaaggtcctctgtgaacaggaccctgctcactctgcctcacctctccccatcctcacttcatcctttatcctctggccttgtgatgctaggaataatgacccccaaaggtaaccaagtcttaattcctggaacctatgaagcattaccctacattgcaaaaggcaccttgcaggtataattaaggatcttgagatagggaaattatcctgggttatttcagtgggccctaaatataatcacaagtatctttatcagagggagattagactacagaagaaaagaaggtcatctgaccagggagacagagactggagtgatgaggccacagcctaaggaatttggtcagctaccagaacctaaaagacacaaggaatgaattctattccctggagcctccagaaggaaccagccctgtcaataccttacatttattttttatttatttatttattttgagatggagtctcactctgtcacctgcactggagtgtagtggcacgatctcagctcactgcaaactctgcctcccaggttcaagcgattctcctgcctcagcctcccgagtagctgggattacaggtgcctgccaccacgcccagctaattttttgtatttttagcagagatggggttttgccatgttggccaggctggtctcgaactcctgacctcaactgatccaccaacctcggcctcccaaagtgttgggattacaggtgtgagccactgggccccgccaccaataccttaaatttagctgtgtaagattcacttcagatttctggcctccagaactgtatgaaaatgtatttctgtagttttaaaccactatgtttgtggaaactgttttcaggagcaatagaaaactaagataagccttgtcagatgacaatggttccagaatacatcctgctggtctttcgtctgaggctgttgggttgttctcccctttcttggtgatgcccctgtacaccctttgcctaacatatttctacccctttgttttaatcaatttaggcttctcccacaaattaccacagacggactggtttcagcaacaaaaatttctttctcatggttctggaggctgggaagcctgagaacaggcgccagcattgttgggttctggtgagggccctcttcctggttcaaagatggccagtttctcattgtgtactcacatggtggagagtggagaaaagaagcaaattctctcctgtctcttcttatatggacactaatgctattcatgagggctctaccctcacggcccaattacctaccaaaggctccatctccaaataccaccacattggggattagggtttcaacatatgaatttgggaggaacaaatgttcagtccacagcaccccttccttaaggttcacttcagtatcaccacctgctttcctagttgccccaggctgggtgaggacctccactcaggtttagcatcagacctgagcttttccttaccactgaattcaccacaaggtactgtcatggtgtgtgtttgactctccaaacaggcccccagggtgagccccagggtgggggcagaaatcaagaactgttcttcctagagtcctctctgtgtaatgtctagcacaaggacgagcacataagagtcttcgataaatatttattgtctgggtgtagtggcttacacctgtaatcccagcaatttgggaggctgaggtgggaggatcgcttgagcccaggaggttgaggctacagtaagctctgatcgtgccactgcgctctggcctgggtgacaaagaccctaaaaaaataataaataaataaataaataaataaatattgattgattgaatgaatgaatgaatggttaaagcttcttaacctcctggacgcaggtggctctcatgtccattgcagttcctctgtctcttcttatagcttatcatctgatccttgtacctgcgactgagccctaagaaatctccaagtcaaacattagccaggatcagatttgatagctgggctgtccactcaggatactgcaaaataaatactacacggaacaagcagaatactaaacaaaggacaaaatatttgaattttttttttttggtgaaaattagagctttgaatgcagaatgtggtaatgcctgattcttttttaacatgccattccttgatcttctcaagctagcccctgtagtactggcagctcaacgacctccctggtgattcattatgctctacaactaaactctaattattctcaaaatattatatggtttagttgccaataatgctgattattgaaattcttagagctagccatgtgcaattaaccaactgatacacttgaaatgggattataggcctccattcactacctaataaagtattaaaccaaagctataaatgtaagattattttacagattgtttctctacgggaatttttacctgatgacagcaaaatgattttcctctttgtcagacaagacaggctatcgtcttctccaaggtctatagattcagggagaaatgagagtgactttactgatgaaagatttaaaaccagaaacagaaaagaaaaatgcaccagagcaaagcaataaggaattataaactaactttaattacatcaacaggaagaatttcaaactatgttgtaattcttattttaaagtttaaatctaattaatatattctgactaacataatcatccaaagataaaagtatttgtgatggcaaatggacagaacaatcatttaggtagcatctaggaatattgctacaattactttacataaatagaaatccacgtctttattagtaatgtgccacacatcttagagtaaaaatttacataagataggcttataaatatacataaatctcaaaattaatcacaaacattaggtacacaattgttataaaacaaatataacctatcaatgtctatgtaaaggcatagtttttacaaaatagtattttgtagacagtctcaaaaaagtatattaatactcctggagccagattgttccagcatatcagcatgtctgtggaaataaggcatccggagaagctgcattcactcttccccatggccagggccttctatgtgatgaaacaggtaggattctagtgacctgggtgaatgctacacccactgcagcaccccattaccttagagaatcaattactctccagaagaatccaaccaaatggctatcagcctaatagcaaatatccaggggaaaactgaacacattaatcaagcagcagtgtgttttatgttaaaaatcccaaatagcttgatgaatccattacattttgagttgccagacatacttaaaatcacactagcctagccactattttcatgaagaggaacttatatgcaagtcttttattaaatataaaaacaaagaaatctaccttgaaactaaataactggatacttgaataactgaataaggaacctaattaaatacaaaacctgtataggttgcatcaacatgccagttactcagctaacactagtcttggtttcttaactaacagtatagaaaagtcacattcaacagtggtactttatatgttcttaacaattcatataatgttgaatggaggaggaaaggcttagtaaaacatccaggaatcctttctacaaactacattgctataaactcaagcatagttttgcctgtaatatgcataatgttctacctcttgggttttaaagtaggcaagagatcagaaacagaaacaaccttgacaaagaccttcaaatgctcatggtgtgtatattcaggcctttgtgtataaacacacaccatcatgtatgtacaaatatacacatgctcctcaagttacaagagggttatgtctcagtaaacccatcaattgtaagttgaaaatatcataagtcaaaacaattatgggacataaccccattgtaagttgtaggaatgtatcaaatgtatatcactttcatatcatcgtaagtttgaaaactcttaagttgaaccatccaaattcggggatcgtctgtgtatataaacacatggagaaccacctaactgttcactaaacataaccaattccgtttagagaacaaggacatacaattatacacggcagcaaagtatacacatcccagcctttggcctagtgcagtggttctcaaacatttttccattatggtacataaggtagatgccacatcacatgtgtaaaacactcccatggtgcagcagattttgatacaacttttattttattttattttattttatttatttattttttagacggagtcttgctctgttacccaggctggagtgcagaggggcaatctcggctcattgaaagctccacctcccgggttcacgccattctcttgcctcagcctcctgagtagctgggactacaggctcccgccaccacgcccagctaattttttttgtatttttagtagagatggggtttcaccgtgtcagccaggatggtctcgatctcctgatctcgtgatccgcccacctcggcctcccgaagtgctgggattacaggcttgagccaccgcgcccggccgatacaactttttaaaacatctctaggttaatgaattactctgaaacactgaaatccttaccatgaagagcagttcagcgcaatggttgtccatgatcaccacagttacttaagacaaaactgctgcttagccggctctgtactttactgccaccacttttgcatcaattccagaaaatatattagaatgcaagagcatgagatgccctgtgccatttatttataaaaataaatcaacaataatttattttaaaagcaaattattcactaactttgatattcttacaactaaccagtaataatatgttactggcagtatcctttacaactaatcatgatatattggtgtgtccctatctaagaacaagggtgggaaagccacagtccataagcaaaccccgcctgcttcctgtttttgtgcagcctgcaagctaagaatggtctttggatttttttaatggctttctgaaaaaaatcaaaaggaaaacatttgtgacatttgaaaagtacatgaaattcaaagttcagtgtcaattaagttttattggaacatagccatgctcattcatttatgtattgtttatagcagagccaaacagagactgaaaagccaaaaaactactatctgacccttaacagagaaagtttgctgacccctggagtagagataagaatgacacacaacctcagtggtcacgtctcttatgcacaaaatcctgaatatagacagtaaacttaattccagaaatagtagtaaataccatctaggatggaaatccattcctgagttgtccaaactttctgatttctttaatgacaaaagccaacttaattaaatacagcttctgcattctatctgaaatcatgtttatatattcaccttttgactcagcggagcaataaaaaaagcactgggctccaagttagaagacctaggttttaggcaatttcttttaaattgttacattgttaaaaatgtatttaagtcttgtttgatctgtgtattaaacctattaaaagaactaaaatgactggtaaaataaagaatcaaaatgcttttaagcagaaaagaaagttgatatagagtaaaacatgctcctttcctctaaatataactataaaaagtcctccaattaattgtaaattactaaatgggggaaaaaaggcacctagctaattggagtatggatagtgggttccatttaataaaagttttaatggatgtgcacgaaggtgcatgaatgtgtaggaaatcatatcacctccttaggcttcagctgcacctctgtaaaataagagcattggattaaatggtctctaaagtcctggccagcactggtaatttatgtcaagtgaccagcctcagttttttcatctgtaaaattggataaataatagaatctacttcctatggttgcggtgaggattaaatgagttaattcatgtaaagtgcttagaacagcactaaatatatttcactagcattattattaatctattcaggtactttacgaaaaacactggttgggcatctcctctgtgacaagtagtatattagaaaatgggaatacagacataaaatagaagttgattctcttatatttaagtagggatgaatgaaactgaagtttttggaattatcacttcagcatgtctatcgactgctagttctctgagataatggtcaaaggccattctgtatcactggtgtgaattcttatttctgaaaaatgattactgttagtactgttactaaggatgtttctatttatgtttcaaaagacaaagttcagtgtttgctaacataattatttatggtttgagcataggaggaagaatataaaaatgttggccagtctcccaatatacatgaaatgcaagccttctgaaccaaacaaacttgccatagaagtatagtttcacatatagattcattccacaaatgtttgctgagtacctgatatggataaatatctgctacaatgatgagtaatggtctctgcattagggagataacaaggaggacaagccagcaattctagaaaagtataacgagcatgttgatgaggaagcccaatgtgctatgggagcatttgatgggggcctggacctatgtagtccagagatttggaggaaaaaatatttaagttgtgacctgataggtgaataggagttcatcaagcacaagaggtggagaatatgaacaaaatgagaggtgagatagagcaggtctgaagaactgagagcctctcagtcttgctaagacatagcaagtgaggaggagtggcaaaagatgatattgcaggtcacagaaatggcttgcattttaccttaatggcactgagaagtcattgaaagttctaagcataaataagcaaaatcggtaatcaaatgagaaatcactagtgaaataattagcttgattagaaatgtaagcggaaggaagctgcattcacttcttccttccctgcctgctactaagctgaagtctctcttttgttttaacctgtttgtagctcaaatattatacacataagagagagaaatataaaaatatttgcttcttatttacaacatggctgcctgcatatcagtatcttcactactaaacagccactagagctgagaagatgagacacaggccagacttagccatgcccagagtggagtcaaggacttgaaccaggggacttgagtttgaatcctacccagttccattatgcacttgatgtcatttaatttctccccatctgcaatgaacagaatttctcctccatccctccttggaagcttttggtaactgtgtttgttgatgttttccttattttggttcaactccaggagaatgtgaaagctctccccacaggcagactttcacctgtgacatgaatctggagggtggtattagaaatcacaatcaccagtgttgctcaatcataaagcccacgaagttggaaccagctttaaagcaacaagggcaagccagagaactctagaatgccagagtggaaatgtctcagcagcactaactatacctgcagacttctctcctcaaaatgggcagttagcacagacatttggaacaaagaacaaaggagtcctttggggcgcctaatgtcaaggcattactatgaattatgctgactacctgtctagtttataagtctgaacattttattttacttatttttttgagacagggtctccctctgtcacccaggctggagtgcaagtggcacaattttggctcactgcaagctctgcctccaaggttcaagtgattctcgtgcctcagcctcccaagtggctgggattacaggcatgtgccaccacacccggctaatttttgtatttttagtggagacaaggttttgccatgttggccagactggtctcgaactcctgacctcaggtgatccgcctgccttggcctcccaaagtgctgggattacaggtgtgagccaccgcgctcagccacaagtctgaacatttaaatggatattctaggtgaattcactttatgggtcattttcccattttcaattattttttaaaaagccacctcataaaaaaaattctactcaaaatctctacagtctcaaaaactgttggcttattattaaaatgccctaaatttttactaagatgttttgtctgatataacacatttttaggccaggcacggtggctcacacctgtaatcctagcactctgggaggccaaagcaggtggatcacctgaggtcaggagttcgagaccagcctgactaaaatggtgaaactccatctctactaaaaatacaaaaaaattagccaggcatagtggcacatgcctgtaatcccatctactcaggaggctgaggcaggagaatcacttgaacctgggaggcggaggttgcagtgaagctgagatcacaccattgtactccagcctgggcgacaagagggaaaattcatcgcaaaaaaaaaaaaaaatacatttttaatcacacttaaggtatgctggctctgacaagagaattcactgtaaccacagatgaataccttagttttataaaattcagtggtagaaaagttcaaattctaactgctaagaattccctttttttttttttttaatatcattaacacaactttacatcttcaggaatgctcacagtttggtctccaacctttgcaaatagcagtaaaaatgttttcccatagctgctctctaactgagaagaaatttcaaataaatattatttatttagttagttatttttgagacagagtctggctctgtcacctaggctggagtgcactggcacaatctcggctcactgcaacctccgcctcctgggttccagcaattctcctgcctcagcctcccgaatagctgggattataggtgtgcaccaccacgcctggctcatttttgtactttttaatagagacgggggtttcaccacattggccaggctggtctcgaactcctgacctcaggtgacctgcccgtcttggcctcctaaagtgctgggatcacaggcgtgagccaccatgctcggccaaaatttcaaataaatatgaactattttcatatcattgtattttcctccaatctccccattggctgtgtaaatatccaaaagcacttctgctttacggaaatttgaaatttcttctgcccaaaaggctgactgtgaacttatgacattcagtaaagttctccctagtaatattcaaaataactctctgtgctatagcactcatagtaaagactgttttgagacatgatttctatacttagttccttctctgcctttctatttgtcatttctagccaaagttatatggtatgtggatcataaaaaggcagtctttttgggtctcaaatcccattcaggaagatggcaatcacaattttcatcaatccaactcagagatgttgtgaagttaaataagaaaacatatgtgaaagtgcttagaaaaggtgtaagtatgttccaaaagtatagggtcattattaaacaatcttctttgactacaaaagaagcttgttctttcttccaaaaagctgaaattatatgaggttttttttcttaaataattgaagctaaaattatactggatattctttaaaaaatatatttatactaaagacttcccaatccatgtaatctgttggccctgcagctgtggttagggggttcccatcaataggtagaaggtcagagcaacaatcagaagcaaacaaaatggagatgagaaggtttgataggcagctgatggcataaaaatgtcttcatacttgtaaatactgacaacacgctctgaagccggcggtgagtctatatcatgtcgagtgatagagcctttaagaaaaaaagagaagagcaggggcaattgaaaaaagaacagatttataatggtataggcaaacaatggaaaaatcaaaagtctatttagtgttgaatacgtaagcagtggttacaaagatctggattcaggtatttgagttatcagaattctctatcattgtacatataataaagaacatagaaattagttaaatttatccaaaaagactagttcttattaatctgcactcccccatcagaacaatgctgttgatctgtttcctgccatctcaattttaaaactactagttacataattttgtgtgattattgtatgattgcctcctaaaacggctctatgagttttgtcttattaatacccaaatgggcaaactatatttttatttcaaacagcagagactactaactttttccctcaaatctatcttgtatatatatggatcatcaacaactcctgacaacactactaacgtctcccttacagatggaagccctcctctactgtctgtgggacacttagtagcctgcccaggccatgccagagggagtgtggtatactggatgtgtgtctgtgtgtgtctgtgtgtctggcagattagggtagaatggtatagaaagtgggatgattaaagtaccaaactagtctttggatgggaaactttcttttaattttgttacaagtggaaagaagtacagactgtgtgtaaaatatatttaataatcttcagttgattaaaagtgtctgacctcctgaataatccatttgaaacttgggttagggagactaaggcatatacattcagtgcaaaggtctccttaggaatagggctcagagtgagggtttttaaggtcctatctgctagggaagccctgccaaacttgacatgtcaggtccctgcttagtgtccgtgctggccccagttagcaaaaatcaaacttctcaggtttgtatgcctgtagtttcagacacttgggaggctgaggtgggaggatcacttaaacctgggaggtggaggctgcagtgagctgtgattgtttcactgcactccagactgggtaacagagcagacttttctctcaatagatcccagtcacctctcctacctaacctcagctcactggtcacctgcaagggctgctcaacttaactatgcgcctacagttcatgccttctttgagtgaaatccaacctcatacccctttcaagccttagttcaaagttttcccccttacagggaccttaggagaataggtaggatataatcaattaaaagggcattcaggaggccgggtgtggtggctcatgcctgtaatcccagcactttgggaggctgaggtgggcggatcacaagatcaggagtttgagaccagcctggcaaacatggtgacacagcgtctctactaaaaatacaaaagttatctgggtgtggtggtgggcatctgtaatcccagctactcgggaggctgaggcaggagaactgcttgaacctgggaggctgaggttgcagtgagccaagatcgcgccattgcactccagcctgggcgacagagtgagactccgtttaaaaaaaaataaaaataaaaacataaaaaaaatagaagggcattcaggaaacaagaaaagcagaagccagtatatggggtaggaatgtgcctgttttgcttagagttagtgagaagaacagaagttttgagagagcttatcaggtaaagcaggaccagatttggagaaggctttgaactttaggctagtctgccatatatgtaaaaagatgaccttctgaaaatacagctttttccaattggtaaagcaatttcaaatacttgttttcacttaatccttacaatatttccatggaataggaagtattattatccccactttagatataaggaaatgaaattcagaaattaaataataggctaaatattatacagctaccaaggggcagaaccaatactcaaactcaaatttttagacttcaaatcccactattttagattactccatttctccaggctgagatataatttatttcccagggtaccgaaagtaattgaagttataactgcagagccactgttggtaatctgggaaattagcaaatggaaaaggtgtcaccaatctggagacagtcaagtgtcttcccaattggcaacaggcaaaataaaaggtagattatgtcatctctgggctgattggtggaaacgaattgaaggaaaaaaacaaccagatcagattaggcagcaaatagttgatgagcacacagtaaagaaagatgcaattaccaggagccagaatgaattctcagtgcaaggactgcaaaccacactcacttccattcttgagcaggcccttaggctaatcaaccagaaggaatgctcaagactcagtgtaacttgattttagcagtctctaaaaggtctcatgatatccttgggtctttgctgggcaaatgctgcagagacttgccacccaaaatgaggtcatcaatgaaccagcatgaccagggagcttattagaaatgcagaatcttgccaggcatggtagctcacacctgtaatcccagcacttagggaggccaaagctggtggatcggttgagcccaggagttcaagaccagcctgggcaatatggtgaaaccctgtctctactaaaaatacaaaaaagttagccaggcatagtggcgcatgactgtagtcccagctacttgggagcctgaggtgggagggtcacttaaacctgggaggtggaggctgcagtgagctctgattgtttcattgcactccagcctgggtgacagagcaagaccctgggagaggagggaaggggaggggagaccagtagaggggaggagagaggggaagacctacagaaaactgcactttaacaatatagccaggtaattcctatacacataaatatttaaggagtaatgggttaaactatgggataatttggtagatttgtgactaacagaatagtcacaaagtgggccctaatgaaatgcttggtgtcaatctctggagaagtctccagaagcccttcctgttcagtactttttattatttctttcttcttcttttttttttttgaatggagacagggtctcactatagtgcccaggctggtcttgaactcctgggctcaaaccatcctcccaaagtgctgggattacaggcatgagccaccacgtctggcccccgttcagtctttttatatttacagcataggagttaagagtattcatgggctttggggtcagacagacttaggattgaattttaattcttctactaattagttgtatagccttgaccaagtttcttaatctctctaaaatcaggacaataatacctatacctctcaaggacatggtgaggagtaaataagaatgctgtgagaattgaacagagccctacatacagcagatacatgatctgtttcattaagcacatcactcatgacatactatcttgtactgctgtagctttgcatgtgtgtaactgttcatttgtttgtccgtataataagtccattataataagtccattataaccttctgaaggtaggagtcgcatctccttttcctttaaatgatccagagtgcttatcgctctcttgtgcacacagtgtgacttcaattaacaatgaacacaagcacagtggtgtctggcgtttaatccagatgctgaaatgtaagcttaccctgaatggctggaccccaagcaaacagataataccaactcaaatgcagatcaacaattgtttcatctctgggaacattcacagggcgtttaaatctgcaggtgacgcgattgttctcaaaaactccttcttcatctctggcagggtttctctgaatctcctttgcccactggcctacattatagaagtgctgtatgcggaccctgccattgtcatcatggacgcaggccatgacatcatcaccaccctaacatgagaaatgattgagaaaaaaaaaagtcaaaggttcatcttttgcacactggtcactagaaatatacattccatcatctctgcaatttgaaatcccaccaaaaaaattcttttaagtgccattaaaaagtctcaaccaggagaccaaagttaccatcacaataagtgacattcagtgcctcctgactgatgtttggagaagacattaccacctatgtggtaatcctgcccaaaacacaaaccaacctaatcaagaaaaaacaatcagacaaactcaaactgaaggtcattctacaaaaaaaattaaaaaaatacctagcctataatcttcaaggagtcagtgtcataaaagaccaaaaaaagaaaaaaaaaaaaaaggctaagaaactatttcaaaatatacatgacaacaaaatgcagttctaggtgttcctacatagaaatttgggctataaacccaaaatttccctaaggacagtattgggacaagtagcaacatatgaaaacaaacaatatatttaataataccatcatatcaatgttaaacttcctgaatttaataaactatataataaaagagaacattcttgattttaggagataacctacttaagtatttagggttaaaggattatgatatttgctatttaaatgccaaaattccagaaaataacaatcaaaaaaataataatcagtagtagtagcagtagcagtagcagtagcagcaagcagtacagagaataaagcatgtgtggctaatgtcattatttatgaaaaagttctggaactagggagtagtgatggttgcagaacactgaatgtggttgataccactgcattgacactttaaaatcataaattttggtgctactgcactccagcccggatgacagagtgagaccctttctcaaaaaaataaaataaaatggtcaattctggccaggtgtggtgactagtgcctgtcatcccaacaatgtgggaagtcaagacaggaggatcatttgagcccagaagttcaagaccagtctaggcaatacagtgagacactatctctacaaaaaattaaaaaattagctgggcatggggctcatgcctgtagtcctagctactcaggaggctgaggtaggaggatcgctggggaggttgaggctgcagtgagtcttgtttgtgccactgcactgcagcttgggcaatagggtgagaccctgtctcaaaaaataaaaataaaaaaaaaaatacacaacaacaaaaaataaaatggttaattttgttatgtgcgttttaccacaataaaaaagttattattttgttaatctaagtagctgtagtcccagctacttgggagcctgaggtgggagggtcacttaaacctttactatccttcctgcttgcctacagtttacatttttttcaaaacaagtttaaaaaagttaaaagagtttggtcgggtgtgatggctcacgcctataatcccagcactgtggaaagctgaggcagaccacttgaggtcaggagttcaagaccagcctggccaacatggtgaaacctcgtctctacttaaaatacaaaaattagctaggtgtggtggcaggtgcctgtaatcccagctacttgggaggctgaggcaggagagtcgcttgaacctgagaggtggaggctgcagtgagccgaaatagtgccactgaactccaagcctgggcaatacagtaagactccatcacaaaaaaataaaaagttacaaaaaaaagtgttaatcagttgtaatgcatgtaccatcctgtgcaggatgttgataatgggggaggctccccagggggtatatgggaaatctgtaccttcggctccatttcactgtgaacctaaaactgctgtaaaacgtaaagtctaattaaaacacacacacacgcacacaataatgcaccttttttttttttttttccccgacagagtctcactgttgctcaggctggagtgcagtggcgcgatctcggctcactgcaacctccgcctctcgggttcaagcaattctcctgcctcagcctcccgagtggctgggactacaggcacccgccaccatgcccagctaatttttgtatttttagtagagacagggcttcactatgttggccaggctggtctcaaactcctgacctcaggggatccgcctgcctcggcctcccaaagttctgggattgtgagccactgcgcccggctaataatgtaccatttttaaaaagttaaacgcttttaaaaaggggttccattttgtttttcctatacattaggttctcaaaaaaaattaatctgtgctttttcttggaataatacaagaaaaaaagagacctctactttcacagataatatgacagtagatactttataggcctttagataccaaaatatcaaacaaaatttgaatgctcctcactctgcctcactcccctaatcttaacagccctaccacgagtgcaaatgcatttaggacaggaagtggtcactttcaatgcaagccagcttctgggtgtggcatgccctgctgtttctcctgctgcctctagggcaggagataagtagactaatatctatccatgcagtcttaccagtggtacccattgtcttactacttggactggaactcattgaaggctattctcctggtgacctctccaagaataaagccaccagaccagccactgcttagactgcttatcagtcttttcctacgacacacctacaacccatatatccaatccacttgcaaatcctgtcagtcagtgctactttttttctttttttgagacagtctcgctctgttgctcagggtggagtgcaatggcgccatctcagctcactgcaacctctgcctcctaagcaattctcatgcctctgccttctgagtagctgggattacaggcacctgccaccatacccggctaagttttgtgtttttagtagagacagggtttcaccatgttggccaggctggtctcgaactcccgacctcaagcaatccacctgcttcagcctcccaaagtgctgggattataggtgtgagccaccatgcccagccagttagtgctattttctttttctttttcttttttttgagacggagtttcattctcgttgcccaggctggagtacaatggcacgatctcagctcgctgcaacctccgcctcctgggttcaagcgattctcccgcctcagcctctcgagtagctgggattacaggcgcccgccaccacacccagctaattttttgtatttttagtagagacggggtttcactatgttggccaggctgttctcgaactcctgacctcaggcgatccacctgccttggcctcagttagtgctactttcaaaacattcaaaatctgagccctcagcactgtcactgctggaactttggtctgagccgccctcctctctcccctgtagccccacacaagcctcagaataggccaggtgaagagaagggcggggtgctctaggcagaaacagccacaagggcaaaagcacagaggactgagaaagtctcatagtttgggaacaagcctggcccagtgaagtggcaaaagaatggggctccagaggaaagagagaaaaacgcagcaaggcacagggaagagcaggggccagtgatgacagctgcctgtgcacctgaggccccgcctgtgcctggccacagtcctgtctgaggtccagaggttttcttgcccctgggtacagaggaagataaaactgttgaaacaaattcgtaacttccctgatgtaatccaacatgccttttataatgaagcctccacaaatattcaaaaagaggccaggcacggaagtgcctgtaatcccggcaatttgggaggctggggtgggcagattgcttgaggccaggagttcgagaccagcctggccaacgtgtgaaaccccatctctactaaaattacaaaaattagctgggtgttttttgtattacaggtgggattacacctgtaatctcagctatgttgggagcccgaggcagaaaaatcaaacttgaacccaggaggcaaaggttgcagtgagccgacatcatgccattgcactccagcctgggcaacagagcgagactctgtctaaaaaataaaaaaaacccaaaaggacagggttcggatgagcttctggattgctgaacagatggaggtgcctgaagggtagcacacccaacagggtgttgaagctcctcactcccttccccatgccttcccctaagtgtctcttccatctaactgttcatctgtatccttcaaaatagccttcataataaatgagtaaagtaggtgggatacggtggctcatgcctgtaatcccaggactctgagaggtcgaggtgggtggatcatctgaggtcaggagtttgagaacagcctggccaacacggtgaaacctcgtctctactaaaaatacaaaaaattagcagggcgtggtggcaggtgcccgtaatcccagctacttgggatgctgaggcaggagaatcgcttgaacctgggaggtgcaggctgcaatgagccaaggtcacaccattgcactccagcctgggcaacaagagcgaaactctatctcaacaaacaaacaaacaaacaaataaattaaataaataaataaataaatgagtaaagtgtttctctgagttctgtgagccactccaggagattaactgaacagaagagggtggtggcaccccagatttatagctggctggtcagaaatacaggtcacaacctggggcttgtgacgggtgtctgaaatgggggcagtcttgtggttttgaacccttaacctgtgggatctaatgctatctccaggtaggtagtgtcagaaacaaagtgaattagaggacacctagctgtccactggagaaatgcttggggtgtgggggaacacccccacacatctggtcacagaagtattctttctgtagtgagaatatgagtagagacggaaaaaagttgtttttccctcttataagtggttctttcacttctgcctctgccatgaaaaaaatatgccttggatgactagtgaaaacacagagaaaacctgaatccaactcatggacaggcgtcaagtccagatgaaccccacctaaaatgagctgcaccccagtcaatccatgaacatgtgagcaagcaataaatgctcattgttataagccatataaggcttataacatgggggcctcttcttgcagccttactgtggaaacagctgatgaaaagaggtgccacaagacagcttggattctgatagccaaccctttcatttaagctagcctgaattttttttaacttgcaatcagagagccataactaatttgatcattatactgctttgatcaattaacttgcttctaaaatcaaaatagcacagccaactaaagagaaaaaatcagcttctatcatgttttgcatcttaccattttcttgtctgaagagaatccaactgctacccaaccatctgtgtctgcactcagctcaaattctacatcagcccctatcatccggtagctgaggaaatagtcacaggtctctgcattacagcctggtttgccatatctagaagagatatcgaaagagactttactgcttctacttacacaaaagacattaagagagcatctaccatgtatcatgtgggatgctaagcaatattattaaacacattggatttttgctacctggaatcttaaaaacacagtttcactctcttaggaggaaccttagagatgatctgccccactttgtacacaagaactgcagtcctgagatgggaaggggcttgcccgaggttgtatagtgaagtcagcggttgcaacaggacttgaatctgggtatctaaactcccagccagtgttctctacattatattagtattagagtcttttacatgttagttactactgaattatttctgaatcccttttaatggaaaaagattctccaagttaaccatttaaattgtttctgttaattaaatgtataccaactctttttaacttacaaattttcatataatcaaactaacacaaatttacaaattcaatataaattaaactaataaaccaggaacattgaaattcacagcactcatgcaacagataatggggctttactgaaagtaaatttctgcttatgtgcatgtggtatccgattagatcgtgcagggtctttggagttgagagcatgttcttactactctctatagcatgatggctcaactcttcacttttatctgtttgaactgctgcaaaatccttatttatgcgatacaccaaatgaatacccccatctggtactcatgaaccatgaatgaatgcaatatttatttacaatttttttttctttttttttttttgagacagtctcactctgttgcccaggctggagtgcaatggcgggatcttggctcactgcaacctccacctcttgggttcaagcagttctcctgcctcagcctcccaagtagttgggactacaggcatgggtcaccacacctggctaatttttgtatttttagtagagacgggatttcaccttgttggccaggctgatcttgaactcctgacctcaggtgatccacccacctcagcctcccaaagtgctgggattacagtcaagccactgtgcttggccttatttataaaatttgcctttgttctgttgggctacttgctgctaatataattacaaattcagacactaaaacatacaacaatataaggtgattatccagatagtgagattatgcagacattcatgtttttttgagagcaccactgaaatgaaaacacaaatttaaattttcttacagagcacttgtggatcctttcagaactggcaagccctggtttgaggaacactgtattacaccatttgcagaatggtagaaagttgaagcaatgggtgggacaatatacgcgcagatggaaggtatctaaaggaacagggcacaggggtgctaagtgttgaggaggggacagaaatgtactactatgctggcagaaatacccgagcagtcaggaagagatataataggatcaaggcaacagggcactggggtgaaaaagatgaaaaggagcaagggaagttaaaaaaaggagtaaatggacaagaaaacaagtcactttgaagccagtagagtactaaaattccctcccttctcaaaatatcccccaatcaccaggtttatacattgctgaccatcttcctcaataagaacatttttggctatttttattcattccttagaagtggccttgtaatccaaagaaagctcaaagcccctgtattcaatttttccttcttagaccttaagtactgaacaacagcaaaatcagaaccttcagtacagtgaccatcaaaactttgcccctgaccatcaaattattcaggggcaatttgttttaggaagtaaagggttcaaaggaggaggctttcccaaagaagctgagctgtctagatgggaggcccattgtccacatgactgttttctagcccagcccgtcatgtcgtgatactactaataatcatgtagagactcaccatgcctgagataacaagctagcaacaatgaatgcttaatgactagttagaatcatacagatatccataggtcaggactatttactaaaaaaggaattgggtactaaacatgtctatcattgcctgtcctgcccacagcccctgctgaataagcacagacacgttctgtgtcacatgagtcttctgcatatcagcaattggtgagtaggagacacctggagcaatggtggtacagctagaaaagaaccatggaagaatggtcccgggcccaggacatactaaagttaaaaggcctttaagactgaaaagcgggatggccgttacgaaacttcataaccctgctgaggtgatcaaggagctcaggccccctgattagaaggaactgcatgcaatttaaatactaccctgagaagtaaatcagtcttagccttaaagttatccaacctgcagttccaccaacctaaagcatcccttagtttttccacagtcgtccactttgattttggcaaatggatccacaggaggagcagtagggaaggggtaacctgggcagtgagaataaagaagggttagaaaatccagtaacaactgttccaatgagaatttttaaaaatgtgttgactgttttttctcacacatatcgagaaatgtttggggactcagaaaatggctttgatgaaggctaatcatccccttcatgggggagggtgtaggacacacacctttggacctaatcttgcatgtgaactgagagtaggtgtgtccttttctcactttacaggagaggaacctggggcactgagagaggcacaatttcatataaccacgggcttaccgctgtcccctgggagtttgagaatcacacgtttaatacaatatacatgttctaagagaaaaaagttaacagtgatacatttatatacttgatagtgggatttttccatttatatacttgataacaggatttttccattccattttcaacttccattttgcgttaacctgtaggtaacattttcttaggtcactaaattctttgtttttgttttttgttgtttttgagacagagtctccctctgttgcccaggttggagtgcagtggtgccatcctggctcactgcaacctgtctcctaggttcaagggattctcttgtctcagcctcccgagtagctgggattacaggcgccggccatcaaacccggctaatttttgtatttttagtagagacagggtttcaccatattgcctaggctggtctcgaattcctgacctcaagtgatccacagtcctcagcctcccaaagtgctagggttacaggtataagccaccgcacccaacttgtcgctaaattctttaaacacataatttctaacagttgtctatctttcttataagattacttaccaccataatgcatcaaaccatacaccataatgcatcaaaccataccatacccaacttgtcgctaaattctttaaacacataatttctaacagttgtctatctttcttataagattacttaccaccataatgcatcaaaccatacattgaagggtaaggctgcattatgcctccactttgtgagagaaatcttttctcctaggctgtttactccacgtacacaggaatcatgtgagacttatcttgtattctctgcccagcatagtgcttggcactggacactgaataaatgattgtcaaaggaataaataaaatcacccacagacattaggaaatgtaaatcagtacaaacttttaaaaatcattctattttatgagtttttttcttgttatttttaagttttttctttgggatttgtaatgctactttttttaaagtgaggctttgctaattttgtccattagatttattatactttaaaaaagccaccaggtcacacttttctggcacacttctgtgcactctgaatagtccatttttactatcctggaccttgatcacatcataaagtacaatcctaactttttaccaccaaagtagttggatcaaatgcattactttttctagttttatgcttattttatgctaagtcctatatctgcttcagtactagagaccagggatccccaatccctgggccactaaccagtaccagtccatggcctgttaggaactaagccgcacagcaggaggtgagtggcaggcaagcaagcgaagcttcacctgtatttatagccactccccatggcttgcataactgcctgagctccacctcctcttagatcagcagtggcattagattctcataggagtgcagtccctattgtgaactgcatatgtgaaggatgtaggttgtacgctccttatgagaatctaatgcctgatgatctgccactgtctcccatcacccccaaatgagaccttctagttgcaggaaaacaagctcagggctcccactgattctacattatggtgagttgtataattatttcattatatattacaatgtcataataatagaaataaagtgcacaataaatgtaatgtacttgaatcacccaaaaaccttccccttgacccagtccatggaaaaatcgtcttccactaaaccagtccttggtatcaaaaaggctggggttcactgctatagactgagtcctgacttgaacgagttttgtttttttctgaatagttattgagccactacaaactactgtatgttaagcagcttcatatatcttcttcctgttacttctcactacagtcctgaggccatttgtctcagaatatttatccaggaattcaatgattgttcacttacatgtttttgaaattctagagttcactgacaaagacaatctcttttaatgttgcatctgactcaggttccccatcttcttccattttcaaacatatcatcctcactacttcctggcatctagaataatacgttagcatacagcagatttccagctcaataaataccagttactattactactggattattatcactattttttttttgagacagagccttgctctgttgcccaggctggagtgaagtggcataatctcagctcactgtaacctctgcctcttgggttcaagcaattctcctgcctcagcctcctgagtagctgggattacaggcacccacgaccacgcccggctaatttttgtattttttgtagagacggggtttcaccatgttggtcaggctggtctcgaactgctgacctcgtgatccgcctgcctcagcctcccaaagtgctgggattacaggcatgagccactgcgcctggccctattaaattttgtaaactggcctgagaagtaataaccattgggtacgattgtctctttaagaacaacaagtttcagctgggcatggtggctcacacctgtaatcccagcactttgggaggccaaggtgggcagatcatgaggtcaggagatcgagaccatcctggctaacacagtgaaacccgtctctactaaaaaatacaaaaaattagctgggcgtggtggtgggcacctgtagtcccagctactcaggaggctgaggcaggagaatggcatgaacccgggaggtggagcgtgcagtgagccaagatcgcaccactgcactccagcctgggtgacagagagagactccatctcaaaaaaaaaaaaaaaaaaaaaaaaaaaaaaaaaaaaagaacaacaggtttctaaactccaaatgaaagcaaattttggaacaaagctagctcataaatgttctgaactagtttattcatgttggcaaatggcttctcaggacttttctagcactaattttctattatcatatatgcttctaaaacttgtaataggaacttgtgttctgtcaaatgcacttggacatgcctttaataacattttcctcttatattgcaaactgttgaaaaataaagaatttggcctttgtccctggtttctgggagacaaactctaaaaccttggaatttcccaagtaatgggagtgtttttgttcttcatgagccccttggattacacctgagtttatgctgagcaacgggatgactaagaatagaggctggtcactggaaaaaccatgtaattagaaggttggggctttgtgctagacctacctatagggagggttgtggggctggagattgagtttaaccatgtggccaaatgattaaatcaatcattccaacatagtgagaccccaataaaaactctggacactgcggcccagtgcagcttcctggttgaacacatcgatgtgctgggagggcaatgtgataatcccacgaggagaaggcatggaaactctgcctttgggagcctctcagacctcaccctatgtgtcttttcattgactgttcctgagttgtatcctttataataaaactgtcatagtaaaaatagcacttttttttccctgagttctgtgaaacattctagcaaataatagaagctgaagtgggaagcttcttctatcttgtgggaagaccccacatttatagccagttggtctgaggtgtggacaatcttattgtgaactgtgccctttcacttgtgggatctgcactaactctgggtcattagtgtaggaactgaattgcagtacaccagtcgggagttgatactggaatataagcagagcagaattagatttttttcctgaaattaaatgatctctatttgatataaaataagtttggaccatgtgccaatatttaagctcttgtctctcagctacaacccagccttctataggctgagtactctgcaaaccatttctcctttgccaggtgcttagactctgccaatagcaagcattagaggaaggcaggaggagggaaagaggactgttccttcctgtgtgattgctgttccaataagcaagttctcagcaactctacttcatcctggcagttggcctgagttcccagttcggtgctaggctcccagaaccaacctcatcccatgctgctctgaggcatcagcagcagctgagcacagcctcattctcaaaggatgggtcacagctctgcgaggtcctggtctgggacctttttataatctcaagcccttctctttgcaactccagccccaaggatggtaactttcctgaagttattttctgcatgctatcttggtactccctttttgcttctccagtcccgcaacttcttgcttagacaattccctgggctggtcttttgtttaaacagctagtatgatttccatctttcttactggaacttgattgatgcagactaaatggattaacctttcaatactgatacaatgtgtttgccaaaactgtagcttattagtacttatccgaaggctagaaaataaagacattcaataggatctatgttttacatgcattagacaattctaatgggaaattattttaattgtacaattctaagtaccctaggtacacagaattaaattggtatttcttgatttatggaacactcattatcagtctatacaaagccaatcttatatttttccaccaatccatcactaactccattttcttccccaccttagacacgaggtccagcatatttcatgcataaccttctcccaaggatggaagttttaacaaaaaatgaacactctgacacatacgtcttagaaaagcaatattttactatgataaactgaaaggacacattagcgataatggataacagacaatttggtggtggggtaaggttctcatctcagtccattctatgtagcatggaattctgcctgtccagggtaaagtcctgccaggttgcaaaaagtttttcatattcccaagattatcatcctgaaactcttgcatgattaccttacacgataattaccaaactgccttcagcagatcctggatctaaggttcaggttccaggcacaatttctcactctgccaacagcaccccttgccatgctgcccacagctccactgcattagcctgttcatggccaggcacaaagcctggaaatgcccaaacagagctgaccagtgagggcccactgaaacttaccattcacctctatgtttatttttacataggtgtgctcttaatatatcacttgtgtatgttttaatttgcataaatgacactgtgcagtacatctcattctgtttattatttccctttggaaatctatccacatatgtaagactgaatattattcagtcataaaaaatgaagtactgatacatgttacaacatggacgtaccttgattatataatctcatttacatgaaatgtctaggataaggctgggcacagtggctcatgcctgtaatcccagcactttaggaggctgaggcaggcagatcacttgaggtcaggagttcgagaccagcctggccaacatggtgaaaccctgtttctactaaaaatacaaaaataaaaaaagcacacctgtagtcctaactactcaagaggctgagacaggagaattgcttgaacctgggaggtggaggttgcagtgagctaaaattgcaccactgcactccagcctgggcgacagagcaagactccatctcaaaaaaaaaaaaaaaaagtccaggatacacaaatattgaatcagaaagattcgtggttgtctcgagctggggtggggaggagggagatgagggactgcagagtagtagctaaaggtataggatttctttgggggatgatgcaaatgttctaaaattgattgtggtgacagatgcacaaccctgtgaatatactaaaacccactgcattgcacattttaattgggtgaattgcatggtatgtgaattacatctcaataaaactgttgcagaaaaaaaatggatgcttgcatcccattccctcccttcacataacccagttctgactccagtgtcatgtacatgattcacagaatcaaaattgtatccagaactcaggattcccggtaataatctagcctccggatcaggggccggcacactagagagtctgggatagatgcagagggagttcattcaccgtatttgtcaaatttctcctttttaatttcatacacagtttatctgtattttcactctttcccttgattggtcatgccagaaatttgtgtatcttatgagagttttcaaaacaatccacattcagtttgggtcatcactcattttcacatgtgttttccatttcatttatttccacccagatctgttatttccttcctttttgtttccatttttaattgaatgcttagcttactttcttttttttgagatggagtctcactctgttgcccaggctggagtgcagtggcacgatctcgcctcactgcaacctccacctcccgggttcaagcgattctcctgcctcagcctcccgagtagctggaactacaggggtggaccaccacgcccggctaatttttttgtacttttagtagagacggggtttcaccatgttagccaggatggtctcaatcccctgacctcgtgatccgcccgcctcggcctcccaaagtgctgggattacaggcatgagccactgcacctggatgtttttttttttttttttgagacggggtcttgctgtctcacccaggctggagtgcactggcacgatgactgtaacctccacctccccggctcaggtgatcctcctacctcaccccgggactacaggcatgagccaccacacccagcaactttttttaaattttttgtagagacagggttttgccacgttgaccaggctgctctccaactcccaggctcaagctatctgcccctctcagccttccaaagtgcttaaattacagttgtaagccaccacgcccagcgtctaatctttcttattttctgataaatgtattcaaaactgtaaatttccctctaagctctcttttagattcacgccagatattttgacatgcagtgctttgatggtcattatatgcatatcttaattttctttatgatttttctccttaacatataggttaatattgtttttatttacagacataggtgattttttcccctaaacttttgttaatttcaaatcttacagcattgtaatcagaagacatctgtatgaggtagactgttttgtaatttgttgactttcttatattctggtatatggctgattttagtggatcttatgtgctcaaaaagagtatgattctgtatttgtgggttttacatatctatttaattgaacttatcattcatataattgaaactatctatatattttatttttattttttggagacagggcctcactgtgtcacccaggctagagtgcagtggcacaatcatggctcattgcagcctcaaattcctggactcaagccatcctcctgcctcagcaccctgagcagctgggaccacaggcaggtgccaccatgcctggctaatttttaaatttttttgtagggaatatgttgcccaggctggtctcaaactcctggtctcaaagctatcctcctgccttggtctccctatatcttttattttaaaaatgtgtttgatttttcaataccaagggtggtatgtccaattacaaatgttggtttatattttgctgtacaccatttccatcagttactgcttttatttggatactatactgttacaggtaaacattcctgattagtttcttctatcgatatacgacataatttgctccttatgttttatcttctatattttgtccgatgttactgtcatcttggttttcttatggttcatctttgcctaaaatatcattttccattccttcagaaatattttgtatagtacttatgcatatgtacgtgatcaaaactcttctgtaatgttcctttctcattgtgtccttgtctggttttgctaataaggttatgttatcctcataaacaagctggaaactattccttctttgagggtcctttgaaataatgtgtttaaggttagcatcagctgtcacttgagtgtctggtagaactgagcctggagctttcttggttggaagatttttttaactgattcaatttctttgatgggtaaaaaatttttcagtttttctaatttttcttgagtcagtttttggtaagttgcattttttttctaggaatttgtccatttaaattttcgagtgtattggcataaaactgttccttgtatttcttattagcttatctgctttcatttttagtaagctctaattcacataccgtaaaattcacctttttcaagtatacagatcagtgttttttaatatattcataaggttatgcaaccatcaccactatctaattcacaaacacttccatgattccaagaagaacccctgtacctgttagcagtcactcccaattccccctcctctcagcccctggcaaccatgaatccactttctacctctatggatttgcttattctggacattttatatcaatggaatcatacaacatgtggtcttttgtgtctgacctccttcacttagcataatattttcaaggttcattacatggtagcatgtattggaacttcactcctttttctggctaaataatattccattgtatggatcaaccacatgtgtatatccattcatcagtttgatagacatttgggttgtttccactttttggctattacaaatgctgctgctatggacaagtttttgtgtgaacatatgtttccaattcccttggagtagaaatgctgcatcatatggtaattctgtgtttaactttttgagaaactgccaaactattttccaaagtagctgcaccatttcacatccttaccaacaatgtatgagaggtccaatttcttcacctccttgccaggacttgttattttccttttaaaaaaatcaaccatcctagtgggtgtgaaatggtatctctttatgatttggatttgcatttccttaacagcccatgatgttgggcatcttttcatgagcttgttggcaatttgtatgtcttctttggaaaaatgtctttttaaagcttttttctgtttttaaattggattatctttttattaagttgtaataattacaatttaattagctttttaatctctgctatgtctaaggttccccctttgtcattcttatttctttttttcttgattaattttgccagatggttaattttatatgtcaatttggctggccaaagtgcccagatatgtggtttaaagaacctgaatgtttctttaagcgtgttttaggagtggattaacatttaagtgggtgggccgggcgtggtggctcacacctgtaatcccagcactctggccaaggtgggtggatcacgaggtcaggggttcgagaccagcctgaccaacatggtgaaaccctgtctttactaaaaatacaaaaatttgccaggcatggtgggacccacctgtaatcccagctacttgggaagctgaggcaggagaatcgcttgaacctgggaagtgtagtgagccaagatcgcgccattgcattccagcctgggtgacagagcgagactctgtctcaacaacaacaacaaccaaaaaaacatttaagcaggtggcctttgagcaaagtagattgccctccataatgcaagttggcctcatccaatcagtcaaaggcctgaagagaacaaaaagagtgacctccaccaaccagtgtagcagcagatggcctttggacctgacttgcaaacatcagctcatctctgggtctccagcctgccgacccaacctgcagactgtggaacctgccagcctgcataatcatgtgaaccagttccttaaaataaatctgtctacatagatacatatcctattgcttttgtttctctggagaaccctgactatacacttatctgtcttattaatattttcaaagaatcactttaggctttgtggatcccctttactgaatatttggtttctatttcattaattctgctatatctttattattttgttatttgtttccttctactatctttagatttattcccttctttctgtcacttcacagttttcggcctttcttcttttcttctatcagtttaaacccaacagccaactgcctccaggggtttctccctggatattccacaagcaaatcaattccagatgagttcctccgcctcccaaaagctatcgtcctatgtttcttatcttagtggataatcccactagccacctacagtctcacaatcctgaaacctcagtcctaagtttctccctttccccaacctggcacatttactcagccatcacttcctgctattccttttatttatttattttgagacagggtctcactctgtcacccagactggagcacagcctcgacctcctaggctcaagtgatcctcctgcctcagcctctcgtgtagctgggaccacagctgtgtgccaccatgactggctaacttttttatctttttgtagagatggggtatcactttcttgcccaagctgatctcaaactcctgggctcctctcaaagtgctgggattacaggcatgagccactgcacctgaccacttcttgttattcctacctcagaaaccagagcctgacttttggctgtagttctgtctcttatctggttctctggcttctctctcactccttctgccctgccgccatctttctgagaaagaaatcttttttttttttttttttttagacagagtctcgctctgtcgcccaagctggagtgcaatggcatgatcttggctcactgcaagctccgcctgccaggttcaagtggttctcctgcctcagcctcccgagtagctgggattacaggcacccgccatcatgcccggctaatttttgtatttttgtagagacaggtttcaccatgttggccaggttggtcttgaactcctgacctcaggtgatctgccgcctcggcttcccaacgtgctgggattacaggccgcctcacccggcctgaagcagaaatctaattctgtcatcccactgctcctgacactactccccagcattccatctcccctacacctacctgtcctccttagtcttgagacatatgtgttgaaccacccagacacaaccagcttttccctcttcccttcgctctgtccgttcccccatttttcatcacttaaattgttttggcttgttcctttctctccattttccattttgatgctatttttttccctctaaaataagaacctgaatgagactacattaatattggcttgggggttttttaaaaaagggtgtatcaattcttctccttccttttctttccttctgctgacatggactctataagctctttcagtaaattctgttttggagaacaattcgagccatttttttctctccctcctttcctctctattattttataatcccttcatttattgctgaaccatgaaaggtgcttattttcttggttgattttttaggttctcaattgggctttgtggtttccattcttgtctaattcaagaaactatctgttccttttttgcaatcccttttaccacactctactgggtggttaatggcttctggtttgctatttattgcttctaattaatggcttggctcacagcctttagctattaatttagtacttgattccttgaagtttaagttttaattgtctggccacaccattcagtttcatctgagaactactgcatcagtctctttcccgacggcctcaatttttgttccttctcttttcagggtcgtattatgaagtaaaagtatcgaggggttttataaggtgtaaagttccacacagaagcaaactcagccttcatggtggcactccactgcttaggaaactgtagtccctaactgtctaccatatcagttccaaactcttcctctcaagttcactcacaaaaatacccaactctaggccagacatggtggctcacgcatgtaattccagcactttggggggccaaggcaggcagatctcttgaggtcaggagttcaagatcagcccggtcaacagggtgaaaccctgtctctactaaaaatacaaaaattagccaggtgtggtggctcatgcctgtaatcccagctacttgggaggctgaggcatgagcatcatttgaacctaggaggtggaggttgcagtgagctgagatcgcactactgcactccagcctggatgacagagcgagattctgtctcaaaaacaaaaacgaaaaagcaattctacctgtccaatccatttcctagtgcaagtcaacagggaccctccattccagatgggcaggacaccttctaccactttatccattaagtccatcaacaaatccacacagttctctgctactttctagctgtgtgactttagctaaaatagtcaaactttctgtgggtcagtttctttatctctacagtagcaataatagtagtatttaactcacagtgttgctataaggattaacattcatatggacaaggtaccctaaagcggggcctgctgcgtagtaagcacatactaagagttgctctaattggtattatgatcaggctagattcatgaaggatacaaagataaattagatgtaaattgttacccttaaaggacttccagattagtagagtggtaagttatatatccacataccgtccaaggtagatgggggaaggatataggaagatgactaaacttctgccctttgccccatgttctgtccttctttctacctctctggctctttcccaagaaaaattgtgatcagaactcaatggtcagaaaatccttgattgagccacattttacgagtagtcagatgactatgccttaaagataagtgaccataaatgatgttctgtcttttccttcttaggcagggtatggctccaagggtcaggcggttaacatcatccatgtagctggctggattaagactgagggtctgcttcccaaacctggccatcttagcagcagggagaagcaagcttcatttgggacttaacccttagccaacatccaactcagttttgtttgtttttccccaaagaaccctcagaagtgagcatttgcccataatcaaatggtaatctgtttcacattctatcattgctctgaatatatagactctgggttaagaacctcaagggaaagaagtatgagtggtaggattcaagcactaagatcctatctgaactcctgaccatagacagcaaagagggtcacggcagactgtgtgctgtggaagaatatcttctgtgggagaaggagaaaatcagggaaggcttcctgaaagaggtgacatttgagctgagactgtaagcatgagtagtataggcttagacagtgggaccctcaaagaattctgaacactagcataacttaagtttttaaaaatgaccatgttagggggtgatcattttcttgagacagcaaattagccagcatcctgcctctggatttgagggttttgggcaatctggatactggggaaatagtctctgggtagggtaggtaatggtcagtaggctctctctcagtttcagtggatttccattcccacctccactattcaaattcctttttttctgatttttgaactcagtttcatgactatttgagacataagaagggggtaccctgcacagagggaacaagtagcctagtcactagaaatggacaacctcaagtgtattgatagaataagtcaaaggcattaccggcacttcttcacttgccacgtcctccaaggtcagtcaggttccctccttccttctccactgaatctgtcctaggagagttccacccataacctctcatctcctgaaaccatcgataattttgagccttcatgctatcaggccacaccttggtaggaaacaggctcttttcctttgccttctgggacacccctctctcctggttcttcttccctctctctggcaacccctcctcagcccccgcttttaaggcaatgtcactgtttatttctaagcgtcttgggaaagtctctattcaggacccacagggatgaagcctaggcccagggtaatctagcagaggcactgcctctgatagccccacgccacttacatctcaactagcacccaccggatggtggtagaatctgtatgcaaagaggaaatgaaactgtcagagagaagagggtaggagaagaatggagagtaaaagctcagggtgagggaaggggagatatggttgtaaaaggaagttgagccagggaggacatttcagataaagcagttgaatattcattcagggagcaggttgattttttttttttttttttgagaccgagtctcactctgttgtccaggatggagtgcaatgatgcaatctcagctcactgcaacctccccacctcctgggttcaagcaattctcctgcctcagcctcctgagtagctgggattacaggcgtgcaccaccacgcccggctaattttgtatttttagtagagacggggtttcaccatgttggccaggctagtctcgaactcctgacctcctgatccacccacctcagcctcccaaagtgctgggattacagtcgtgaagcaccacgcccggccccatcacagacttttgagtgcaatgccaacaggttagaggcagacttcaggagggttaaaccagttttatgtgcagaatggtgggggcgcgaagcagacacactagggatcggtacaaagccctgctgcctgctatgtgatcacctcacctaaatgccttccctcttctgtgtcactgaagtctttcctacttcatggcttgactctataaaagctgtccttgatggctgtggcccacctgatgtccacattcataaaactttctggactatacaatgaacatatcattctctctgcagagagactcaaaggacgtacagaatctgagcttatccttcatttgttagatgcatgagcccaatcagaatacaagttctcacataccacatttaagtcacctggcagcactaggctgtgtacagtgtaaagatacattagatgctttcagaaacagacgggcttcggaatatttattcttttccagagtgacagattccgccacatggctctccagctagaagactacatttcttagtctcccttgaagctaggtcattgtaactatgtttttgccaaaggaatgtgaacagcagtaatgtgggcagccagcctaaaaggtaactacttgccctgaacttctctttttctttccctcaatcttgaacaaggacatgcaacctggcttctactgtactgatgaggacaaagcctcagggggatggcagagcaacaagatggaaagaacccgggtccctgaatgaccttgcggaacagagtcatcccaccagccccagaccaaccagactcttatcagagagaaaaataaactagcttatttaaaccactatatgttaaaatctctaattcagcagttaagcctctacttaatacatttccccaaatccattctctccatcttctttaatacaataattctgatttttgaactgggcatattatgtctcagctaataggctctattttacatcctcctttgtacctatgtgcaaccatatgattaagttgtggccaaagaagtataaaaattgttatatgaaacttccgagtaatccctttataaagtagtcagtgaccttcttcctgcttcatttttcccactgtctagaatgtgaacataatggctgtagctcaagcagttattttgaaccatgaagttacatgctaagaattgtgaagaaacagaagggcaggatccagagacactggtgaccaaggagcctccagaccagttctggattacctatttctagttttctttctgtaagagagaaacttctatcttgttgaagctattaatgtttgcttgttgtatacagctgaacttaatcctaacaacagacacatccactaacagatatgagctcctgggactcaacacttcaaaccccagcttgatggttggatatccctcttagcagaagaaaaggaaagtcactacttcccaaagttgcttaaagaggccagtttccattccttctgaccaccatccgcttggcttttgtgctcgttgaagcagctctacagggaggcccttggctgacaaactcccagtctgcgggcccagcaggccacaacaatggtggctcgcactaggggaccataacatatgtggcgtcataaaagaggagggatgggagtggggaggctgatgtgacccagctctgacgggtcagtgagcaggaacagaatgctacgaggtgggcgctggtcactgcaaatttaagtcaatacagacagggaggaaataaggcaacctctctctttaggttggggtttttctgcttccccctagctgccctggccagatggcggcctcctcccctataacccaaccccaggcggcaaaggtggaagccagatctaagaactgggggagcttagactcagcacccacccctatccacagccttgcagaacttggatgacccctccctctcccagcctcactctccccatctgtaaagcgggcggcaggcattgacagctctttgggcctttcctccaggccggcggaggcctgggcactgcgctccccatcctggcctcgcctctgcaagagctgcctccacggacatcttttccgaccccctccccctccctcgccccctctcctcgttcccccgatcctcggtcccccacccccggtctcccctcccgcaacccctcgccctcccgcagcctcaccctcctccgacaggtagcgcaggtcgtagaactcccccgcgaaggtgccgtaggaggagtcgtggcgcggcaccgcctcgtcggcgcccgtgtccccccgcgcgcgtccccggggtccccggccccccgggcccgcaccgtcgtccgcggggctggctgcgcaggcggcgggccccgtcagtagcagcaggagcagcgacgcccagacccccgggtgctgccggggcggccgcgccatccgtgcgcacagatcccgcagccaggccgctcgggccgcagcgggggcgccgcgggcgcgggccgggactgagcctccgccgaggccaccagcacgcgcccgcgcagccgcggagcctcccgcacccccgcctccctgcctcggtctgcgcatcctcgctccagcaccgcagcctcccccttcttcttggaacccccctcctccccgcaccgatctctccttcctagcagcttcccttctaccgtccttctttccattctccccatctccccgacttccctccacgcaggcagatttggcccttctggccccttgctactccggagtgtggtccgcggaccggcagcatcagcatcacctggaagcttgttagcatcgctgaggccccactccagacccatgaagcgggatgttcatttcatcaaaattcccaggagatcccaatgcacgttcaatttatgaaacgctcctctagagagtttaccctggacacacctggtcagtgctgcctcctcaaccttgtgccggcactttttggtttacataaagcacttgctagacctattatttcttggatcatcacagaaggaacttgaaattgcaagacccccacaatagagctaggtaaactgaggtgtttagagacagagaaaactggattcacctgcttcctctccaggctcttgcggtgtgtaatcaacagaggctggtgccagtaggtaacctgttccccttcaaaactaggcttctggtttactctctttccctgcagcaagcacgcgcaggccttggaaggcccacaccgtatctgagggccatgctgaattgttgatttttctcaaatccattcctgctgcttgcagttcacttttggctatttactcagccatccattgattcacaccaagcatttgctttatggcaggtcccagggttctcttttgatgatggttgttggggtgatatattcgaattgctaagctgttttccatcagagaggcggacgcaattcctttcaggctggtgttgcagagccagcattttaacctgcttttcctattttattattttattttattgcataaacaaaataattatggaggcagaaaagcatagaggtcccaaatgcagacctagaagtcagactgcctgatctctcatgattagtcattgacatgatgcaatgaagattagggaagatcatagaggtaaggatcaatagggttcagtgctgtaagtggcatgcacacatgtacacaatattgtgaaatgttaatattcaaaaggaaactagtgatcttaaccctttatggcctgattggctgagagataagggtagtgctgttgaaacaggggagacatgatgggggacttagaagtcaggtattttctattaggtatcagctaacagtgggctgtccaactggaatttaaacatattaatcctgatggctgaattgaggtgtaattcatgaaaaccttgggcttcactaggtcccccaacatagcagttgtcacaaaaaatagatcagattatttgaaaaaggtaagatgaactatgattactttaaaaactcaagagacttcttcccaaaaagcatagcgtggcaatgcataacattctaaaaaagctgatccaacagattgaaaatctgttaaagtgtagtccttcaaaaaaaaaaaaaaaaacaaaaacaaaaacaaaaaccttaaacctttcttaaaaattaaaatttctttattttcttttcttctctttctgttcaccagggaaggtatggtcaacttagaatggaccaaagtttagccaaaaaaataaagcattagacttttgatttcagtgtagattctctggtttgggaatacaagcttttacctcttactttcctttttattcccttcattttggttactgaaattaacaataacggtgcccaaatagaaggcaaatgaaaaccaggccattcttctccgagtaaattaatctgatataaaaacacgtgggcagccgggcacggtggctcacgcctgtaactccagcactttgggaggccgaggcgggcggatcacaaggtcagaagatcgacaccatcctggccaacacggtgaaatcccgtctctactgaaaatacaaaaaattagccgggcatggtgtcgggcgcctgaagtcccagctactcgggaagctaaggcaggagaatggcgtgaacctgggaggcggagcttgcagtgagtcgagatcaggccactgcactctagcctgggcgacagagcaagactccatctcaaaaaacaaacaaaaaacaaacaaaaaaacaaaacaaaacaaaaaaaaccaccaccacgtgggctttctatattgtttttatgggggtatttgggtattttggggacggtttacaactacagcctaaaatgaagtttgcaggtaaactgtggatttcaattctctctctactcatgtagactcacagggggccacagataggcttcaggggtgatatgaggaccttatgaaagtgctggaataatgttgtgatgtatgggtttttctagggagaaaacccatagctttttttatgaattattttttccatgttcaactttttttttaatttactttaagttctgggatacatgtgcaaaatgtacaggtttgttacataggtatacatgtgccatggtggtttgctgtacccatcaacccgtcatctaggttttaagcctgcatgcgttaggtatttgtcctaatgctctccctccccttgcctcaccccccacaacatgcctcggtgtgtgatgttcccctccctgtgtccatgtgttctcactgttcaactcccacttatgagtgagaacatgcagtgtttgggaaaacctatagcttttatgggtcactcaagccttatgccttttcagggcccagcaacctattcggctccttccatttcatgagattctctcccatccactcaaattgcctttggggattttctttctcttcatgttttctgacacgatttaagtcctggaaagagtggaggcagacctattccaaccttaagcacatgctcccctcttagttacatcctaggtttgcagagaccctctgttccccaccaatgtgactctacagaacagctaagaaatattgtagtttcctctactgtgcaaattttctggggaggaactttgcctgaacattctgagaccactggctgtacaagagctggccactcaaacaaaaacttagagatgaaccagatttaaattcattttcattttaaaaagaaagacagtacctttattttctctccacctcaaagcaatttctctgacacaaccttttttgcgattaaaaactcccaaaatcattgctgcatcttggtatctgatgagtaaccgatttgcccaggcttctgactgtctagtatatataatttttcactttggattttgtaagaaataaaagctgtgattgtggcagttccttagaaagttaaacatggagtttccatttgacccagcaattccaagagaatttaaaacagatgttcacacaaaaacttgtacacaaatgttcataacaatattattattattattttctaagacggagtttcactcttgttgcccaggctggagtgcaacggtgtaatcttggctcaccgcaacctctgcctcccgggttcaagtgattctcctgcctcagcctccctagtagctgggattacaggcatgcaccaccatgcccaggtaattttgtatagtagagatggggtttctccatgttggtcaggctggcctcgaactcctgacctcaggtgatctgcccacctcgacctcccaaagtgctgggattacaggtgtgaaccaccgcgcccagcctagcagtattattcataatagccaaaaagcagaagcaacccaaatatctatcaactgacgcaactgatgactggataagccaaatatggtatatccatataataacacattattaagccataaaaaggagtgcagttctgatacatgctacaacatggatgaaccttgaaaacactatgttaagtgaaagaagccagtcacaaaagactacatattgtatgattttgttcatatgaaatttccagaataagcaaatccatagacggaaagtagattagtggtcgccaggtgatgccaggggtcagaatcagtagtgactgctaacagacatggggtttccttttggcatgatgtaaatgttctggaattagatagtggtattgtctgcacaacattgtgaatgcattagaaaccactgaattgtacgctttaaaatggttatagtgatgaattttatttgagtttttaaaactgtaatttttgagatggtgaaagataaatatgataccagaatattcctctgctatattcctggggaatataaaattctgggtgcatgcaagtgggatcttctgaatgccctaggatctcaaactcttcaaacatagaatttcctatgcagtttacaatccataaagctgtgggttgcaggtttcccagaccccttgcaataaccttccatgcctactgggaatctgcatcctacagtttggagccctagctctggaatgactatgtcagtaagctgattgtttcccccggacataaggtgtgtgttgtgtgcccatatagtgctgttgtttgggtttaaaatatataaaaaatgtgaaacaattgcgccaattcattttcatccctatgaatccatccagcacaatttcatcttctcagtcacaatgccaagcacccatcattcacttaaataggcaaataaccaggacaactgctgaaaccatggaatcctcttattttactggttagaggtgagctgccaaaggtactgggtttcaaatacagtaacagccaacttgtttgtggtcagacttccagtgacgtcaaccttcagaaacttcaacatctgtgaactctgggggaagcggggaagaagcaggaagcccagagcctcctggaaacactggccaaaaagcccatgcatcccttcttggaagccaagcagatctgacacataggaaatactggctttcctggcttccccaagaaaccttcagctttgccctggaggtttccatcagcgagcaggaggtgaagagcagaagcctcagaaagcaggttagaagaggaagagggtgctgggttggcaagaagtgacagccccatattgtacgggaacatattttgtatcatgtgcacaagataaagaacagctaaagctgttttaaaagtatagccgggggacataggggtaaaaggacccaaacgctacaattgccccggatagctccactgacagagcagagagcagtaaaaaaccatcagtgagaacagcataatatcctataaaaggccaagccaagccctacacatattgatagctcttaatgatatcactgcaccgtaccaaggtataaaaggggctgatgtttataatcatgaccatgactcatcaagaaaaggttaaatactctccagtatactctgtttactaaggcagggaagtgcgtaatacattttagaaagatttccctcaaaaaaaaatatattaaaattttaaagattcagcacttaaagggttaatcctcggttatctgaatattcacatacattcctcattttacaacaatactagtaaatgaggcattacctttttttgtagtcattagtatcaaattattggcaccattcagttttaaggagaggggcaggagagcaaactatacaatataacataaaaatacagttctgatacaaatatatgagatcagttcctcttaacaagtggtcataagaaatgaatgaacattttacacacaaggaaatacaactagtaaatcatcacatggaaaagtgctcagccttgctagcaattaatgaaataaaacaactcttcaagaacaactatacatacctattaaactagcaaaaataaataaaaatggcaaaacccaatactggcagagctattggtaaacagaaatgcttatacattgctggtggcatcataaattgtcgaggggattcaagcattcagagggggtggggaggctaaactagatgacctttaaggtccttccaacccaaagattggatctttctagaaagcaatctggcaatataaaacaagagctataaaatacttcatgctctttgaccttgtaatccctctttggagatattcctaagggaataatccaaaagaaggagcagttttttttttttacagacattcatagcagcactatttataagagtgaaaaattagatataactcaaatatctaataatggggtgaagtgaggttacccatgttacatggatataaagacatttaaattggtgagagtagaatctgtgttgacaagaggagacaagtgttaggccgagaagtaaaacaaaggagaatgtacacaacgatcatagctatgtaaaaatatgtgtgtattcattgagaaagctagggaactaatttagagggatattttgtggttagggggttgctttattcctgcaaagttgttcaagtgcattaataaaaatttaaaaacacatttcttgaaactatataaaaagagcaaaatttcttctggtcaagattctatcaatacgacatgaatcgatcaactttagaaataattttctgaatcttcttgatattgaatcatcttaaccttgtaaggatttttagacaatgtaagctatcatttcctactttgggttcaatgataaattctgtttattccaaataatatcatatccaaggagttcacaagttaaattatatttcagattaagctgaagtaccttcagtcatagtgatatgtaactttctttttttagttcttctactcacatctgaatacaaatgaatgttaaagactttataagatctgtgtatttatcagtgtaaatgaaaaaccagcaataaagaattattctttcattaaaaatgactctttaacaaacagtcaaagctcggtgcaagtttcaatcatacaaaatcaaatggttgaaattgatagtaaaagatcctacatcatattaacccctgtggttattaacagatacacacaggtacttctgaaaaggaatcccgttttcccatctttcttttcctagacttatcaaatcctgtctcaactacatagagtaatagaaaaactctaatgcttaggagacataaaataacttttcccataaaagtcaagccagaaattggcttcaactaaccatggagacctgggcgaacagagcacacacttgtatgctgtgctagagtgagcacacaaagcccgaagaaagaagacggacagaaggcaccatgccatcttccaggtgacaaggggagaatttcacagttcggtcatcaacagtcttttcatcatcttctctctctccagttcctgccggagtgtctctgcactaaaaaaaagtatgtgacaaaatagtgagacaatccctcaaaaattgcagaagcagacagcttaagtatcatctcccaggttctttcctgatctcagtgttggactttcttttttagactccttgaggactatctacatttgctagcatttcagtgatctgaaattggctacttactggtttctcagtcccaccatgctgagagttcctggctgactatatgtcattcatctctaaacctccagagccttgcgcagtatctggtgcatggcagccactcagtaaagtgttttttttttttttttttttttgagatggagtctcactctgtcacccaggctggagtacagtggcgtgatcttggctcactgcaacctccacctcccaggttcaagcgattcttctgtctcagcctccagcatagctgggattacaggcacgtgccaccatgccaagctaattttttgtattttagtagagacggggtttcaccgtgttgcccaggctggtctcgaactcctgagctcaggcaatccacttgcctcgacctcccaaagtgctaggattacaggcatgagccaccaagcccggccctcagtaaagacttttgaatgaagatgtccaggggttagatttatttaaatcatgctttaaattggtttcatgtgcattttctcccaggctttcatttgatgaatatctgagggaatgttgtaacaaataattaattatattttaatgaatcaaattgaatgaagtaaaattggctgttttgagaagttgcctctgactttttggacctcaggtccagttgcatatctatgtaacctgtctccactgtttaaacacacacacacacacacacacacacacacacacacacacacacagagtaaatacacatcttttcattgtttttagttagagatggggccttgctatgttgcccaggctggacttgaactcctgaactcctggcctcaactgatcctcccacctctgcctcctgagtagctgggatgacaggcacgagccaccatgcctggcaaaatacacatctttaaaggcactaaccaagtttaataatttcattcagggtagaaaacaaagtttctactgtagccaacaaggccctacgcagtctggccttaacccacaacttcacaggcctcctctattgtcattcactctgctctggccacgctggccccttaaacttccgtaaccatgtcaggcacatgcttcctcaggagccttagcactggctggttgctctgcgcagtactcctcccaggtatctgcagctttctctatagcccttttcagggctctgcttaaatgccacctcattgaggccatcccaggataccttattgccattcacaatttcattttcctccctatcccttgtcaatatcacacacacgcacacacacacacacacacacacacacacacacacacactcatttgttgtctatctcctctaacagcctacccttgtaaacatttttttttttttgaggcaaagtctcactctgttgcccaggctggagtgcagtggtgcaatctcagctcactgaaacctccacctactgggttcaagtgattctcctgcctcagcctcccaagtagctggaattacaggtgtgcaccaccacgcctggctaattttagtagagatggggtttcaccatgttagccaggctggtcttgaactcctgacttcaagggatcctcccttgtgctgggattacagatgagagccaccgcacctggcccctttatagacatttcaataaatacttacagaataaatgaaagaatgtaggaaaggcctgtacgtgtcacaaacacaatgaacctagagtctccctggtttccctgtcaccagaattacctgtcggaacctgctgacctgacctacctggctgccagagaaacaggtttccgggtggtgtaaatggtctgcactgtggagacggtctctgtcaaaggcctcagggtcgctgctgggatcagcggggaagtcgggccaggacagcactgtaatttactgtctctgaagtctgcctggagaagaaacaggaaagaggagatcaatctcaatttgggttccattttcacactgtcagttgctccctaagccttactctacagttcctgttccttttcactaccagctaaaatcgattgtcattttaagtgattttactttgtgccagacaccatgctaagtacttgacacatattaactcttgacaaccctttaaggtagcgattatatttcctcacatcttaggcaccatcagttgtaagatgcaccatttttgcatttgccaatcagaaagaaacatgtagccatttaaactttgtcatgcccactatcaaactttgtcatgcccagtagtaaacattctgatatcgggaaatgttaaaaggtgaaaacaaatgtatattttaaaactgattttatgggggaaagtgaggctcagagaggttaagtaatctgcccaaggtcacacagttagtaagtgttaagaacagtactgagaaccagggctagctgacaccataactggggtttttcattactgtagcagtggttcccaaagtatgggccccagactagcagcatcagcattatcttaaaacttggtaaaaatgc

SEQ ID NO: 331 - DNA, 99890 bp, Homo sapiens
tctcatttacatgtgaaatcttttaaaaagaagaagaagaaagtcagatacaaagaaataaaaacaaaacagtggccaccagcattggggtgaggggaggaaataagaagatgcaggtcagagaatacaaagtggcaaatatgtagggtggacaagccaaaagatctaatgtacagtgtgaggactatcactaataatagtatattgtattcaggatttttgctaaatgagtacattatagttgctcttgccatgagggaaaaatgggtaactatgcaaggtcatgtatatattgattttttccactatagtaaccattttactatatacagttggccctccatatccataagttccgtatccatgggttctgcatccatgggttcaaccaactgcagatcaagcatatagtatttgctggacgtgggaccagtagaaatggagggctgatttttttgcattgatgattccacaggacctacagtgagacttgagcatccatgaattttggtatcctcagagtcctggagccaagccccagtggataccaagggatgacaatacatgtatcttataacatgttatataccttaaatgtacaaagaaaattttatctctaaaaaatacactcttttagcagttttgaaacatataagatattattatgtcttttagttaggaaatttaatccatttaaatttgggtgtaattgggttacataaaacatcttataacactattaaactgataaaaatttaacttcacatacaaaaaccacacttttactccatcttccatcttccatttttattttttgatgtcacatattacatctttttatattgggtatcctttaacaaattattgagctattcttatttttaataggtctgccttttaacctttatactaaagatataagtgatttacacatcacttttacagtatcatagtattccaaatttgactatgcacttacttttaccaatgagtattatactttcatgttttcatgttactatttagctctctttcagcttgaaatttttcctctaatatttcttataagacaggtcttggctgggtctggaggttcacacctgtaatcccagctacttaggaggttgaggcacgagaattgctggaaccctgtaggtggcggcttcagtgagccaagatcatgccattgcactctagcctgggcaacagagggaaactctgtttcaaaaaaaaaaaaaaaaaaaaaaggtctggtagtgatgaacttcctcggcttctgtttggctgggaaagtctttaattttcttcatttcagaaggacagctttgccaggtacattgttcttggtaggcagatttttctttagtgcttggaaaatatcatcccaccctctcctggcctgaaagagctcttctgagaaattctctgctagcctttgggactctcttataagtgctttattctttccttttgctgctttcagaattctctctttgtctttgttgcttgatagtttgattataattgtcttgatgtcattttatttgaattgtatctgattagagacctttcaccttgctcctgggaatttatatctttactcaattggtaagttttcagctttttttttttttttttttttgagagagagtctcgctctttcacccgggctggactgcagtggcactatctcagctcactgcaagctccacctgccgggttcatgccattctcctgcctcagcctccctagtagctgggactcaggagcctgccaccacacccggctaattttttgtatttttagtagagatggggtttcagggtgttagccaggatggtctcgatctcctgaattcgtgatccgcccgcctcggcctcccaaagtgctgagattacaggtgtgagccactgcacccagtcgttttcagctattattttaaaaataatctttctgtccctttgtctctctttcttaaattcctataatttgaatatttgcttttacgaggctgtcccataaatcctgtatgctttctctattcctcttcattctttttactcctctgactgtatattttcaaatacctgtcttcaagttcacagattctttcttctgattaaccaactccctgttgatgctttctattgactttttcattttttattgtatttttcaggtccagatttctatgtgtgtttttaaataatttcaattgctctattaaagttctcattttgtttattatttttctgatttcattgaattgtttgtattttattgaagttcactgagctttcctaaaacaaatattttgatttttttgttagaaaattcatatattcccatttatctagggtcagaaactgaaaaactattgtgttctcttggtagtgatatgtctttttgttttttcatgtttcttgttgcattgcattgatgtctacacatttgttgaaacagttatctctttcagacatttgggctagtttcactgtgaaaaggccttcctcaacagggaggagtaaaggctctggatggttggagtgtggctccttggtagtagccacatagttccgtcagctaagatcagtgttgttgaagattacagaatcctcagcagcgaatgctgtgaatgtccacagtagcagtgagggttgttagggttttcatgacaatggcttctacagtcctcccaatctttttcctcctgccagggaagttgtagattggggcaggtccctcttggcactgggaccagctttcaggcccttttgcagtaatggtggctctggtatctgatgagtggcacccatggagcagccacagaggttagtcctaaggcataggcacacatcctggcactatagctctgggctgtaggcagtagtggcactggtgcccagggagcaggtacccccactgctgtattggtaatggtatgtgttgcacatatgcttgtgaaacagctggggagctgagaatggcagcacaggtgtacatagagttatagtacttgggagctggggtaagatctagctctctatggcagttgagcctggggcataggcatgctcagagtgaccttggcactctaaagcccagaatgtgaactagcttgctatagcaatggatccagtgtctaagatgtgttcagggcggttaagccacagaacacagctctagagtgtgggcgctcataaggcagctgctgcttgggagttggggcacacagggttaaaagaggtggcagagggaagtgcagctatgtcttcctctctgagagtggtaagaatggctgttgggtaccttagtatcaaaagacgctggtgtcctttgcagagaatgctgctggggaccacaacagttaatttggctaataccaaaagcatctgtcttccttctttgttcctgtcttctggaatctcaggtatacaaatctcaccagtgatcctttctaagtggatagtttccattttattttgctctactgtgctgctgcagattctttaatggcccttgagctgtctcagggctatagtggtttgtggaaatagctgtccatgtttgtgtgtgcgtgtgcatgtgtgtgtgtatgtgtgtgtgtgtgtaggggaggattgaaggcttatatctcctactccactatctcgatgatatcaatctctcaacttctaccatgtttttaaacctactaaatatattcttctgcatattgtaatatttcaatcaagattaaagttttgatatctatctttttaaaatgcatgtagtttcaaaagtctagcaaaatcaggtttgctgattgaacaatttagaaagtactttggcttttaaaagctctttattatgaaaaactgtttattatgaaaatttcaaatatgtacaaagtaaacaaaacagtataaagaatcctcatgtcctacattatacaactgcaatggctatcattatttttgtcattcttttttcacctgtatctctcatttatcactatatacctatatctatcactacatatataacataccttgaaatgcctacatattagctttacaattttgacaaatgagtacaccagagtaagccacatctttattatgatataaaacaattctctcttcccagataacttcccagataacttcctcatatctctttctgatcaaccctcaacccttagggtaggcactattctgatacaattagatttgttttgctttaaacttcatataaatgaaatcataatgcattcgcttttaatttaaaggagagtttgccagaactggtctttcatcatgaaatcagattaaaaagtgacaagtgagaataaaagttggacattgaatagtattgaagcaactcaagtgtgtaatgagtgtgtttagaaaaagctagtctaattaaaatcatcactgatgtatacttgagaacagtaggtaagagtgtaaatatgtaatatgcaaagctctgaatttatagttagatttctggcagcatatgatgtttaatttaacaaaataattcagcaggaacattataatagaattttatgaagttcttctttgctcttagataatatccacactgatgggagggataagaaacattaagataaagaaacacaattcaacctgctaaagtgggctttatgcttagaaatgcaacaaagtcacagcagtgaaaaatacatctacttcttggtcaaaagacattgtactttttatttaatgtattgcaacttagaactgtttctaacaggtttccatgatgctgtgcaaataagcagctagagtcaggttaaaagagatcgagcatttcctgtgagaggtccttagaaggagagattaaggtgggaccagagatgagcttgaaggcaagttgtgtttcctgtgggtctggtttcctgtcccactccaccacacctttcctccagctatgaccaatgagctacttgaaatgtttccttttcctaaaacactcctactctaataggaaattgataatctgtttgagagaccatgtccaagtctgaaactgagcagaacccctttgcttacctagatttttaggatgcttcagaggtgtcaggctttgcaaaaattcacctgtgacctgtcctaagctgtcagttcagagaagaaaactggctgcaaggtcaatccagtgccctgtgtcttccacagctactgaatttgagagaagcaactattcatcagcacaaactttattccaaccccaagtgtctttttattatcactagtttgaaatagatagcatcagttggtctgcttccaaaattcttatttctttgaagatgaaaagaaaaacattccagagaccaagttttctctgaagtattttaaggaagtatgaaactgttaagtgcctcagaacccatcttgggttcttagcttatctttcttcaaaatcaccttagtggataaagttggtgctaccttcaagtcaagtcaaatgtttatcagcagtaaattaatggtgtgggaatggtgggaagagaaggaaaaagtcactcgtatttctcaaagtctgatcaaattattttaacattatcctgacagcctttcacaggtctcccttatcacacttcaatatctaccactatctctaacccattgactttcacatacattcaatggccatttacttccttactattttttgaaaccttcaccaagctacagtcctagatttctgatccttcctacaacatggactctgttctcccaacaccaaatggcatgcttaaactaactccaggtcagggtctacctccacctcaagtgcagagaagaaaacacccatggaatgctgctgaccacagatggagtccttcgagaaaaaaaataaactaactaaggctaacactccatcactgaatccttgacacttgtggaccgagaaattttgaggcagaaatgttatccaaacctcagacttagtgatgccactgagttcttatcagtgggatacagtttccagttgcttttattcagtggtaatgatgaatttgtgctgccccagccacacttcggtcatttgagtaaccagaggaacaagttaacacagcaaaataaactggcctgtgagggatcccattggtggctttggtctttggattgggttggtgggttcagctcccccaaccaagccaggagctgaaccctaacaggcattcttgggctgtctactgtcggaggcagttgagtcagctccatcccattcttccttggcccccttcttattttccagacttttctcacttcgcctccttccattctgcctgtgtctcttagtacatctgcagcccagatactgctccagacagactcagagttatcattagaaaaatcagtggagatgctaaacagccagacagtgatgataagcagggtacttcctgaaatctcctgtgggcatccacaaggccaaatctaagggagcatttccaatcctctcacaaaacagacacactccaaggtcaagagacaccacaatgcctgaccaatgtgctttatttaattatattttctcagtaacaatttattcctttccaagaatggtggggcagaaaaagtatcaaggttctggcttgtgtttctagaatatcacacttgaacattcatatattaaaattgtggaagtctataaaatatattatcaatttcagatggcttatatttaggttacattggtcatagattatttttgcaatctgtgtctattccttctcacttctcttctaaccaatgcccttctaaccccaccctaggacacttcatatggctctgagactgaatgtgtgtgataatttttttaattatatttgattttgactttgacactattttttcttgatcaggcagcatgttgtattgaaaagaatcctgccagggataccaaatacaaaggttttagtgtaactaccattactagatataaaactttaggtcaatcacaaagggcctcaattttttcaagtgtaaggtgagggcttagactagactatttctaagtgtcttcccttctttaaaatccttgatcataacttcactatttgtcattaaaacaacttcggcttatgggaactttctcacagcctttccaaagtgcaatgagtaccacaccataaaggaaccttcaacattacccataaacacaaattcagattggttgaacaccatataaacttgatttatttgtaaatttcagaccctgatatgttatttttgtttaactgggagaacaattctctcatgtaaatgtgaataagaaacattcaaaacacttaggtaacgcaatgttataaactgcatttttactattatacagtgattgtcaagaacagtctttctgttgcagagaatctctggatccatatttatatcccttaactatgacagactccacatatacttagcagtctctgcattgctttggctgagccaagaatgtcttgggaagaacagaaccacatggagtgtagataagttttcctccaactttattcctaataattgacaaagagattgagtgaggttatcattattttaatctctaaatctttgttcataatgaaacctgtttcttatccttctcctaatatactttctcatatttatttcctcattcttcttgcaatatcacaaaagtttgtgatgattataagctagtttcttatagaagaccatataagtttcagtatttggaaacatcagatgtctagttggtaattagggattaatcataagcataaataaatatttaattaatataaatgaagaaatagctcagaagcatcacagcagaaatgtttttcctttcaacaaaaggacaatgtaataatgagaggaaaagctttggataatcagcagttataacactgaaaaatgttacaacatacttgtgctgcatggtcatttttaatagctccactttgatttttgcctcactatacaattgggagcaaacaacagtatgagtgtaagtgtgtgcgtatgtttttcagcagggcctctactgaggtagaattattaataaactcagtgtcagtgccagaggaagaagccaagaagccaatacaattgaacagcctggtgttcttaagggggcccagggcctggctatgttgccagcaatgaaaatcccagataaggtcttgagccgatcagcctttgcagaggcatcaaacctactcttggtgagctctggctagactatatcaggaacatttgaatagcatgattgaattgtggggaaagaaatacaattccagattctggtgtgacctacaaccagcactaggtcttgggcattcatgagtccaccagtgttcctcccagtacttcttctttcccatgttctctaggggccttagataatccacacagattaaaaatgcagggaaaacaactcccactctgtgacctcaaactggtttcctggtactgctattctctattttcataatcttgagtccattcccaaggctgtagccttaattcaggccactggtcagcactcagatggatcattgcagctcctcattacttgggatctgggatctttcccctctaatctacaaatttgggtaaaaatcccgttttgcattctttcactgctatcaccctcaggaaagagtccaaactgcttgctgttacatccaaggctcttcaggaattgaattgtacttccaccaggatcatttctgaaaaagtctcccacatgaggaaccccttgctgcagccaaattgaatgacctgcagcaattccttggatttggcttgcacggtcctgcctttgttcaagctgcttctcctgcttggggcacccttcctcttcaatgtttaccttcatggagaacttctatgcatccttcaagacttggctcaagtttctctaaagctaaaattgtaacaaaacacatgttgatacgttgtcagctccttgaaggtagggaccacatcatattcatgcttgttcctaccttaatatttaatctcctattattcttcctgggcttctttctattatttggccatgccatgtctcagttcaaatgtcacctctgcaaagaggcagtgtctgcagtaccgatctaaagtagcaccacctcattaacccaatcattctcttatcactctgtttcatttccactgaagcatttgccaggattagaaatgatcttatttatcttgatgttaatttgttgcccgccccaattatcccacccctcactagaatatattcctctgcccaggatataggacattgtctacttattcaccgatgtagctctagtgtctacaacagtgcctggcacaaagtagtatcaataaatctctttggaatgagcatattatatgtagggttcgcatctgaagaaatacttatatataggagtattttatgaggagttttcccagtgagtctaaataaaaaggcagtcatccaaatctacctctctcttgtttccacctctctagcaactatgccctgagtcattatttgaatgttgttaccttttcccttttatagcttttctttgcaggttaagcatcagttaaggccttgtcaaggccttttagagcacagccactggagccacacttgttcaaatccaagccctggccaagtatggctttggcccagccaaattggatgacctgcagcaacttcttggatttggcttgcgtgcttctgcctttgttcaagctgcttatctgtgcttcagtttccacatttataaaatgattcctgcttcataaaattattgggatgattacaagaatttgtacaaaacactcagaacagtgccagtcatagaaaatgcagtatatatgttagtcaaacaatactgttttctgtcatgtaggggcaggacacaattgacaaatccaaaatacagaagcatctgtggaaatggaatgtggtatggaaagtatgtgtgacagagaaatgagagcagctgggcatttgcttccaggaattcaaaacaatttattaattttacacttagatattggtaatgcacacagagagaggaaatctaaaagttatttagagcacctccatgattttgtgttgaatgttataaattttattttaaaatagctcaaaactatcttgcattttaatattttaaaataaaatctataatatcaaaatcttgagcatttaaaaaactgtaaaaaccatgattcaagtcaataattctgtgctttgagatttgattggtaagcatgatttcatttgtctatgaagaatctactctgttcctttctggctttttcaatgctttcaaaagtgatcattcctcttggcagctgcaatttactcttttctgtttccagtatgtcctcagcttcaccttaaataaagtacagaaatacacaaggtgacaaaggggtcatcagcaatttgtgacaaagcctgattgctatattccttgacaggctctaacaccgtatgagccatgtccccaatctcacacttaaacattttcctcaggagaagtaatatacttcccagaggaaacacagtgatgaattctgaacacccataaataaatcaggagctacagatggtatttttgacatgtagaagagaaagaacatcaagataagtaattttttcccttgaaccaaagtcaggattcgtattaattctgtttggagggatttgggtagagaaaccacacatagtctttcccattgtcctttaatataagtgacaagagagaaagtaaagtttactacaaattctaatttttcagaaaagctaatcttcaacctgacattacttgtaaacacttaaaataatattaaatgttcttcagtctgtatacatacaaatatacatatatacacatctttataaacaattcctctttcaaagagctacacaacgcagtaatttcttgggcccagtgacatttgccaggttttattgtcgaagactacttagcacattgtaaaaaattgtattacagtacatgtttacattttataagcctcccttgggattaaaaggtaacactttctgtgagtactcctcttttaacacactattttattttttttttttttttgagacagtgtctagctctgtcgcctaggctggagtgcagtggtgcaatctcagctcactgcagcctctgtctcctgggttcaagtgattcttgtacctcagcctcctgagtagctgggactacaggtggtgtacaccggctaattttttgtatttttcatagagacaggatttcatcatgttggacaggctggtctcaaactcaagtgatctgcctgctttggcctcccaaagtgctgggattacaggtgtgagccactgcacctggccttcctttaacacactattaattgtactccaaacccaacagaacagaccatagttttcaaattataagagcatttcaatcatctgcaaatgtcttattttttttacctctgtctcaaatagcaagtaaaattcattataaaattatatgtaattaggttggccattgatgacagactagatgttttccacgtgagagagcctttcttccagttggtaaattctcatcatgtgttaaaagaatggctgatgataaactcagtcgaatagggattgtatattttagggtcatcactattaacatggaaaaaaactataatctacattttctaatgtgataagttttctgatgaatttgacttttttttaaacaggaaattcccacaaaaatttcctattaaatttctgtgccagctgggtcaaattccagggcaataaaaatcaggattctgtgacagcagcagtatgctggtgaatatttaccaaccagttctctgaaaataaaatgtatataaatgtataatatatatgtttattacacgtgttatacatgttcactatacataaaaatatgtatcataataaaatgtacataaaattccacatactaaattgattctcacagaatgctttcattgatttttatggaatgcttgaatctgtagccagcctatgttgcagctgatgagagagtataatggatgatggttggtgttttcatttacactaatgagtaggacaaaagtgaaacaattgtttccttcaagacaaatgttggaacttcatttatttgagaatgatgtaaacaacttatttgctgaactggataatagtttttcaatattagaagaatatttcaccaacttttatgctacttacaatgtaatagttacagacaaagcacacttttaagcttaatctgcattattagcattttcttcatcaagttttaaaatctagaccataggttggcaaactgtcttaaagggccagacagtaaatattataggcttgtggactcatgtttctgtttcaaggatggctctgtcatggtaatgggaaggcagccacagacaatacataaatgaatgagcatggatgtgtcccaataaaactttattttggaaaacaggtggccagcctcaggccatcatttttcaacccctggtccagacaatcaacaaaataagaagtcaagccttgatttggcaacaacagatttccattgtgtaaatattcccaccaagaccaacttcaggctaccaatgggatgtcactgaaactggactgtagctgtattttgttttgtctgtgtattatatctgcatttctatcacatagatacaatagctataaataaccagagtatggataatagtaaatatttagaaacagatgagttctgtttattacctttgttttaaacacaatttaatattatttatttgctgtaatttatttattgcaagtttataaaagttttaatacattaagtgactatgtttaacaaccagcttacacaatccctgaaaatgtagcgattggttcttgtgagctggtatgagctggctctaggacaccactgtgtgaaagggagcagaaatgttgctcattggaggttcaaagagagagtcttgtcagaatctttataagtcaaaggttcctaaggcagggatccttgaaatggaaaataaatcagcaaatagaaactctagtttaccaaagacttacctttcattctttctaaaagggttccatagcccaagtcatactggtaggtgaggataaagcttaatggaacaatcgggaccaggaaggctggcttcttttttttaatcgctctgtttcaagaattaaaagaagaaccaatatcaaaaaataacctgtaaatacatatctgtatacttaaagaaaaaaaaatacctgctttttggaagaatgccttttccttcagaagttacttaacacatttgataattctatggaaataggatttccttacccaatacccctaaccagattctgcagttctcaagggcaaggtctgtgacttgctcatctttatttgactctgaagctcaggttccttgtttttaaaatgagtaaggattggtatctaccactaagggattgtggagataaacacatagagcccttcttggtgtcaagttggtgctctctctctctaactaataaagtagagaaaaagacagaagcaacctaggaaactaaattaactgttactgccttgctttcacagagttacccccaaggactaaggttaataggttactttggttacatacactatttggaccaaagtcttattctggccaacttcataataaaatggtaatggaaaacacaaaaagaagtaaatgactgaagaaaatgttaaatagcaaacatacccagctgttaaagagatggctgcaaggccaaaaaaagttccaaaatatttgaggaattcccgagaccacgcaatctgcatggccatttgtctttccctcatttcactctgcatgatgagctgcctttccagctaaggacaaaacaaaagacaaagtaaagttactcatctttggaatctgaacaaatagttaataatctgtttttccagcggattcattcttcaattgctttaattcatgttttttcaaaaaaatctcaacagactttgactaaagttcctttggacagctctcaccaactgtcaccttggcagtgaaatcttcctggaataaatacagaataaatatcaatattccatttttacaccctgaggtcttgactgcctgtggtctggagctttagccaagtctcaaataaatgtccagcttttcctattggatgtgtggaaagatctatgggtctttaaatgtagatacatcttattggcctttatttctacttgcatggaaatctgccttccaaatccattccaaattgaaatttatttggagtatttatttgctccatatcataccacaatatcatagtagatgggtgttgttttgagacatctatagagatttttctttgccacatttttctcgcctcaagttcttcaccactttgttcagtgcctttcactgctttgaacagaaggcagatggctcagaacagagaaggaaactgaatttctaaattgatttttagaaaatactcaggagaagcaactgtctgtaaacccaagcccattatttgaagagagttatattcttgacagagaaaagtgttgttggcattgttgttgatgttttaattctaaaatcttggcactacatgtcattagccaagctagagggcaatacacagggagttcatgatgcaaggaagaggagaggaaggactaataatgtgatttagttttccctccatgccctctttctactgaggggagtagctgggaggggcgaatgatagtttagatgtaaagatggggcttggctccttggcctatttgggaggttaaatcaccagaagatatgacggaagcctcagatgggtttgggaatccctaaacagagaagacttgtggccttgcttcctgcggagaattctgggagggagcagctacagcacagcagaaatggtttcagggcagaccttgcagagagcacacctaagagaggccgcttccatctccctcaacagccaaggggtgtggaggaagtctgcaaggttctcacatcagctggagaggggcacagaaggtaactgcggattgagagcagggggactaccaatgagtccaaaacctagagccagcggaccccataacagacacttggggagtgaacataagccagtggctgggtggggaaggccactcactggatcccagaggatcagcagcacccgagagtgcttttctgctttgttttctgttcaatcaacctggacagcgccacatgatgttccctaagggcatgtggccatgttccaggctggcgtaaccatcatcgccatactctcaggtgctactgatcctctgggatccagtggccttccccactcagccactggcttatattcactcccaagtgtgtgttatggggtcccctggcccaaggttttggactctggtaggccacctgctctcaatcttcagctaccttctctggccctctccagctgatgtgagaaccttgcagactttcttcacaccccttggccgctgagggagacggaagtggcctctcttaggcatgctctctgtgaggtctgctctgaaaccatttatgctctgcagtacctgctccctcccaacattctccacaggaagcagggccataattctctgtctggggatccccagatgcatctggctagatgtgccttccctgatgctggtgccacctgagatcacctggacccaagcctaggtcataccagggaaaagatgaacggagaaggggaggaggaaagctgaattcaactattttctcccaaagaaccgagttttaaactagaagtaattgagtaactttgacttgtcaaaattaaatttgctgtcaccaagagaaactgaggttcattttgagttcaattagagtttaaaaatagatgtgtttttgcacaagattagtgtgtgaaattcatccttgccacattacttatttacaaaacttacatactgattcatcatatcccccaaagtgatgtaaatacagcaattaattatttgtgtttttatcaaaaggcagcaaacaagaaatagaggagtccagactggttctaaacctttgctgcacatcatgagcatctggggagattttcaaaggtctagtaaccagatatacctcccagaccaactaaaccaagtgggatcaattaagtcaggatctggaggtaaaatcaggcatccataatttctaaaggcttccagatagttcccgtgtgcagccgggactgagaaccgtcacctgaaatgaaagactcatagctcatattttttttcccacaaaagatcaacctgagatatcaacctgaaagagattacctgggaactctcaaaagattgtgagcagaggggctttcagggtgatggagttaatctgtatggtactatcgtggtggatacatgacattctgcatttgtcaaaactcataaaactttacagcacagagtgaaccttagtgcatacaaattttacaaatcagccaaaagggcaagggatgcacaagatggaatggggactgtgacaaaataatctgactgtgctacaaatgtgtggcacaacctcaatgaagggttgggggaaaagaactgatctatctttggaaaatggtattttgactaaaaactgtaaaactaaagacaaaggactatacataaacactgtactctagtgagtaaaactgtctctcacgagttacagattaacaattctgaaactgctttacatgtctactggagatgagcaacaagtaaattgacagaagatggtggaagccaggtttcttattattaaacagggagattacaaacaagcaagaggaaaagactagaatgaaccatgtggtactggattagagccaatgacatccgtatgaactcatgcttagtgcttgatacagacatagacaaggatgaaattatagatatgcatatctatatgcatgcatagattaggcattcatggcttagtgtaagtacatacattttctcagctctgtccactgacagggcatagaggcaataacaaccccttgcaaacaagcatacctaacacccagaaacacccagacatgatttctactctccaaaaaaaaataaataaataaaccagggctccttagagaaatagctggcctaggactggggcaagaaatgtataagaggagcctacagaatcttatagtgccagaaagtcaagagatactaaaataataataatgatgatggagtatgtcaaagggacacaggggtcaatctgaaagagctcctaatgtccaaagctggaacaattttatcagcaaaataaataacatagtgttggattataacctaaagtacaaaataaatatccataagcctatactaacataaatggagaagagacaaatatcctgtacagaagaattccaactcatttatatacatactcctcctccctcttcaaagaagtggagcttaactcccaccccttgatcttgggctttgcttagttacttgctcccaatgaaaacagtatgaaagggcagcgtgagggatgaagaagctaaagagacaagaagactaaatgtcatgtggcatcctgggtgagattctgggacagaaaaagaacattagagacaaacaaatgaaatctgaacgtgggatgtattgaatagtaatggatcaatgttagtttcttatttgtggcaaatgtgccatggtaatggtaagatgttaacagcagggcacaaagaatgtagggtattcaggaattctatatgccttttctaaaaacctaaaactactctcaaatttaagtatatttaaaaaactagtcatgaacaaatattatattctgagtcggttcccttactgttaagaataaaggcaatcttgtccatctttcatagataaattatgaaaatcagcaaggttgtgtatctgtgataaactatgggcctagagtgagaaaaaattccatgcagactctctccatgagcaaaacattctaatgaaagatattttgatctataatgttaattatcaattaaaatgttattaactattctaaatttcataagattatgtttaaattcataggtctatatctgcacacatcttaaaaatcaaattaataaacttgactgtcaaatttttcaataaccataaagggataaatgaattaatgcaattgttaacttaccaataattggcatcctttaactatgtgtacattcattttcaaccttccttcccaattactgacattaaaaacaacaaataaaagcaaaacagaacatgtgcagcaagttctcttaatggttgttaacacaaatcctaaatacaaaattctttatcgtattttaaaagaaatgtagaccttttataataataattttcttatctctggaccttttgatactgctctacagaataatttgaaatcaaaatgttcctgattataacttcacactctgaggattttacaggcttatctgatgctagtttaacaattagagaaccacaattaatttcaaagagagcacataagacgctccacaaactaggcatcgaaggaacatatctcaaaataataagagccatctatgacaaactcacagcctatgacaacatcactgaatgtgaaaaagctagaagcattccccttgaaaactagaacaaaacaaggatgccccctctcaccactgctattcaatgtagtactggaagtcctagccagagcaatcaggcaagagaaagaaataaaaggcatccaaatggaaaaacaagtcaaataatccctcctcactgaatatgattctatattaggaaaacctaaagatgctgccaagaggctcctacccctaataaatagacctaataaacaacttcagtaaagtttcaagatacaaaatcaacaaacaaaaattagtagcatttctacacaccaataatggtcatgctgagagccaaatcaagaatgcaatcccatttacaacagacagacagatacacacacatacacacacacacacacacacacacacacacacacacacccctaggaatgaaagaaatcagagacagcacaaacaaatgaaagaacattccacgctcatgaattggaagaatcaatatcattaaaatggccatactgcccaaagtaaaatacagattaagtgctattcctatcaaactaccaacatcattcttcacagaactagaaaaaaaacttttctaaaattcatatgaaaccaaaaaaagtccaaatagataaagcaatcctaagcaaaaagaacaaagccagaggcatcacactacctgactttacactatagggctataataaccaaaacagcatggtactagtacaaaagcagaaacgtatgccaatggaaaagaatagagaattcataaataaagccacatacctacaaccatctgatctttaacaaagctgacaaaaataagcaacagggaaaggattccctatttaataaatggtgctgggataacttcctagctatatgcagaagaatgaaaatggacccctacctatcaccatatacaaaacttaactcaaaatggattaaagacttaagtggaaaaccttaaactatgaaaatcctagaataaaacctgaaataaaccattcgggacattgatcttggcaaagaatttatgactaggtcctcaaaagcaatgacaacaaaaacaaaaattgacaaatgttacctaattaaactaaagagcttctgcccaacaacaacaaaactatcaacagagtaaacaatttacagaatgggagaaaatatttgcaaattatatatctgacaaaggtctagtatccagaatctataaggaacttaaacaactcaataagcaaaaaccaaataatcccattaaaaagtgggcaaaggacatgaacagacacttctcaaaagaagacatatgcttggccaacaagcatatgaaaaaatgttcaacaacaataatcaggaaaatgtgaatcaaaactacaatgagataccatctcacaccagtcagaatggctattaaaaagataagaaataacagatgctggcaaggctgcagagaagagggaatgcttacactgttggtgggaatgtaaattaattcagtcactgtggaaagcagtttagagatttctcaaagaacttaaaacagaatgaccatttgacccagcaatcccattactgggtatatatccaaaagaaaataaataatttgacaaaaaagacgtatctactcatattttcatcgcagcactattcacaatagcaaagacatggaatcaacctaggtgcccatcaatggtggattggcgaaagaaaacgtggtacatatacatcatggaatactatgcagccataaaaaggaattaaatcatatcctttgcagccatatggatgcagctggaggccattatcctaagtgaattaacaaaggaacaggaagccaaataactcatgttctcacttgtaagtggcagctaagcactgggtaactatagacataaagatggcaacaatagacaccaaggactactagaaggggtagagggggagggaagcaagtgatgaaaaactacctgttgggttctatgctcaccatttgggtgatggaatcattcgtaccccaaacttcagcgccacacataataaacctgcaccccctgaatctaaaacaaaagttgaaattataaaaaataaagataccaaaacggatatatagaccaatggaacagagcagagccctcagaaataccaccacacatctacaaccatctgatctttgacaaacctgacaaaaacaagcaatggggaaaggattccctattcaataaatggtgttgggaaaactggctagccatatgcagaaaactgaaactggaccccttccttatgccttacacaaaaattcactcaagatggattaaagagttatacgtaagacctaaagccataaaaaccctagaagaaaacctaggcaataccattcaggacataggcatgggcaaggacttcatgactaaaacaccaaaagcaatagcaacaaaagccaaaattgacaaattggatctcatcaaactaaagagcttctgcacagcaaaagaaactatcatcagagtgaacagaccaactacagaatgggagaaaatttttgcaatctactcctctcacgaaggctaatatccagaatttacagagaacttaaatttacaagaaaaaaagaactccatcaaaaagtgggcgaatagacacttctcaaaagaagacatttatgcagccaacaaacatatgaaaaaatgctcatcatcactggtcattagagaaatgcaaatcaaaaccacaatgagataccatctcatgccagttagaacggtgatcattaaaaagtcaggaaacaacagatggtggagaggatgtggagaaataggaacgcgtttacactgttgtgggagtgtagattattagttcaaccattgtggaagacagtgtggtgattcctcaaggatttagaaccagaaataccatttgacccagcaatcccattactggttatatacccaaaggattataaattactataaagacacatgcacacatatgtttattacagcgatgttcacaatagcaaagatttggaaccaacccaaatgcccatcaatgatagactggctaaagaaaatgtggcacatatacacaatggaatactgtgtagccataaaaaaaggatgagttcatgtcctttgcagggacatggatgaagctggaaaccatcattctcagcaaactaacacaggaacagaaaaccaaacaccacatgttctcactcatatgtgggagttgaacaatgagaacaaatggacacagggaggggaacatcacacaccagggcctgtcatggggtagggggactaggggagggatagcgttaggagaaatacctaatgtagataacgtgttgatgggtgcagcaaaccaccatggcactatgtaacaaacctgcacattctgcacatgtatcccggaatttaaagtataataaaaaataaaaataaaagtaaaaataaaaataaaaaacataaaaggaagctagcatatcatagcaggaggaaccacattctaaacacattcataaaattgttacatcagctctttcctgtgtattttcattcttcaatttctttgtttaaaaaatattaagaacagccacaaaattactgacctcagtaatttgtcaatctgttgagtttccaaagaggcaattatgtaaaggtccacagactatttaatacaattttccccttaataaaatagtaaagttattaaatttcatttggacacacaaaacattgtataacacaaaggcaatgacattatccaaaatcattcttattgcagttttaatttcatatttactggagccttccctatttttgagaaataattaggccaactctgagaaacaaatcagtttactactatgttttagtttccaatgacattttaatttatgcacagtatattcacatgacagaaaagtttggtttttatttgcaaaacttttatttgccaaaaagttattctacatgttctaccacaaaaggtcatgtagacctgtttttgttttgtttttatccgaaatgagagtattttatatttatctatgcctttgttaacttaatagaaacattattaataccttctaaaccaaaagaaaatcgatgtttcaggtaaaaacaaaacataaactaacattgttaaaacaaagcagccataatgaaagctgtggcaagtggcatttaaccttaacttgcttgacggatatgttaaatgttcaatgtccagtctaggaagaatctcaatgaggaaatcagtagtaatttgaagttctttttgccttaagaaaaaaagtccccctttatcaataacttataaaaataattgaatactaaccaagttgtagtattattcaaaggcttaaaagctgtggtaacagcatcttattatatatcttccaataaagattacaacataattacatccattcttacgcgtacatgtaacatcttattataaacaataaggttgccatatgtaaaaatgagaatttcagtttggcaaaaacctgtgttttatgccaaatgccgtattaagaggtagattccaaaataaatatttagactttttctaaaaagatcagaagatgccagtaagttgagcagctgacagaacctaggaaagaaacaacaaaagaccatccacttctgatatgatttggctgtgtccccacccaaacctcaacttgaattgtatctcccacaatcctcacatgttgtgggagggaaccaggtggaagtaattgaatcatgggggccagtttttcccatgctattctcatgacagcgaataactctcacgagatctgatgggtttatcaggggtttccgctttcgcttcttcctcattttctcttgccaccgccaggaaagaagtgccttttgtctcctgccaggattctgagaccttcccagccatgcggaactgtaaacccaattaaacctctttttctccccagtctcaggtgaaatcagcagcgtgaaaatggactaatacaacttctcaaccattatctaaaattcttgaaagtcacagctcctaacagtgtctggtaagttattagcactgtcaactgaagttgaagacaattccagattgtctattgagtaaaaacaataagggtgttttcatttatcctgtatttcctcattttaaagagtacatatttcatagtatgatagctaatattccactatgtcattcccaacagtgcacaaaagacctctattctacaatacttaggatacctaagtattatactctataataattaggatacctaagaatcttggaaccaagacgtgctgcaaaaaacaatatcagaaaatcctttttttttttttgatatggagtctcgctctgtctcccaggctggagtgcagtggcgcgatattggctcactgcaacttccgcctcttgggttcgagcaattctcctgcctcagcctcccaagtagctgggactacaggcacacaccaccacgcccagctaatttttgtatttttatagagatggggtttcaccatgttggccaggatagtctcgatctcttgacctcgtgatctgctcacctcagtctctcaaagaaaattcttaagaaattgcagcatgcttgattttattacaacaggtgatgcactaataaaaataataatgtggctcaccatgtgcacagtatatgcaagttacatatattcatattctaatatgcctaatcttcccccaaaccctatgaggttagtctatgagttgcagacaatggaatccatcctaaacagtagtttgaacagaacaagattgatttcagggtatctggcaattacagaatttctgggggagcatggaagtaagtttgcactctacattatcaggaatgatgcagccattctggagaaatgttcagccagaacgtgggattctcctaggggaactccacagctactgcctcctgccacaggtgctcaggactaaatattgaaatgtcacctctgctactgtgcttacaagagctaatgtcgtctcgaagcttttcactgcccacttccacctcccaagtctccttcaggggtgcctacttggcagaaccaggtcagatgtaaaacccaggtgcgagggagtctggaaatgttctctgtggctttctagcctctgttgtataggcaggcatgctattagggagttggaatggaatccaactagtattacctgccactgaaggtattatctcagtttacagctgaggaaactagggatcagaatttgagtgattttccccgtggtcacagttattaagtgacagatctggaattcaaacccaggcctgcctgctccaaagccaaagtttgccgtctacttgcaataatcacgttaatatggaaaattggggtggaatggacagtgtatctgattgccatctcaaaatccttcacctttctatataattagtgcaagaatttaaaaaaggcacatataatgagctctaagttgatctggggtatagactgacccaaattattccgtttaaatctctttgaaagagcctgtatactcattgcctccaatttctcaccagcattttatgcccctatccactgtagtgtgtaattttagcgactaccactctctgaaattaagccttccatggaccttgtgacttcctcttccttgcttatctaattcctcagagaactaactgggagaaaccatgacgtccaaataatgaccacattctgtaaactcaactttctcaacatttcttgagggatggccttctctactctgctgcacaaatgtgggtctggggctctgaaccaagaccctgggaaagaccaggtcaagcttttggctctatgagaaaattaggctgagcacagtggttcatgcctgtaattccagcactttggctggctgaggcaggaggatcgcttgagcccgtaagttcaagaccagcctgggcaacatagtgtgactctgtctctaggaaaaataaaaattagctgggcatggtggcacacacctgtagtcttggctacttggcaggctgaggtgggaagaccacttgagcctggcatgtcgaggctgcagtgacagagtctgggtgactagagcaaggccctgtttcaaaaaagaaaaagaagaaaaaaaaaagaattgtctatgcttaaggtggggacagaacaggaagctaaggaagttcttctaaaagggcaagtcttgctcccctcccataactaaaatacaaagggaaaaggcacctcctaagaacagccaggcattggagccttttccagagagggtccctcttcaaatcccatatttgttcactttcccccagaatgtccttctcagacacctccttttggtcttctcagttcctgataatagcatcaccttctgggctctaaccactacttcttgctgatgacgtctacattcaaatctctaccttagaactgttcttggctgtaggcttatatttctaactgtcctttgggatctccactgggaaatggagagcaaaatctaattataatatctctgagtaactcttgaaccaagtctcctatctgcagcccctactccagttcagaccatcattacccatcaatagaaccactgaggtgatcactaaactgtgttttctgttcttggtttcttccccctctaatctactttttatgctactgccagattcctctctcaaaaatgatctggtgttgctttcctgcttaaaaatgttcagtggttctttagctcctagacaagacatggtctttaaaaatcccatcccaacttaacagtctagcttcatgtcctgccaggcttttccttgaccccaggcttcaagcctcactgaggccacacatgctcacttctccacacctttttgcttatggaaagaacacacactttagagtcacatgaaattgggttcaaattctagttctattatgtgattgtgggcaaggtccccaaacttcctgagcttcaggactcatggtgcaggttatttccaatgctaaataattttaggcaagtctttaagctagaaatttctcatttaagcctgattttaatataaaaacaaaagtagattatggaaagtattcatttttagttatccatttctggaaaataatacttccaacattcatattcctatatgatcacaaaaataacatagcatctcattattttagaaaataccattaattcctcaaactgaaaaaaagtcattatttttacatgctattatgttctgatttgtataaatctaagatttctacagaaaggtcagcttgacccagttacaaccagcaaatcttagatttgttactatttaatccctgtagacactcaccacgccccaacttcaaagtaatgctaaataaaaacccaaactgaatagccacagataaggaatgagaggtcaacttcagaagcataaatataaatgtaattaaaattctatactataaaacttttctggtcctttgaatgtttttccttaataagaaaagatgtacattttacattatgagttgtttagtcacactgacttcctttgctgaaactgaaagcctaatttgatagtattgacatgcgagctaagatatgaagtgttgaaaacaatagtggttcattatgggccccaggtatgtgtgggggaggtggggaggagccacagaaatgacaggatggtggaaaggaaaatgcatgagcttccaggaacaatgcaggcatcactggttttcagtttgggggaagacaattagtgtgcccagtatcaaataaaacagaaaatgaattccagataaatcaaagccctaaatgtaccaaatgaaataataaatacatgtaaaattttgaaactgcttgtataatcttagagaggcaaagatgttttcaaggaaggcagggaaaataaaggaaaatatggacatacttcatacattaaaaataaaaaaattgccactttctacccaagaggatgactattatccaaaataaagcaaacaaacacacaacaaaaacagaaaataaccactgttggtgaggatgtgaagaaaccagaacccttttgcattgctggcaggaatgtaaaatgatgcagttgctgtggaaaatggtaaggtgattcctaaaacaattaaacatagaactaacatataatccagcaattccacttctgggtctatacccaaaagcaatgaaagcagggacttggacagatgcttgtacacctccattcatagcagcattattcacaacagccaaaaggtagaagcaacccaagtgcatatcaacggatgactcggtaaacaaaatgtacatatacacacaacaggatattattcagccataaaaaggaaggaaattctgacacatacaaccacatggatgaactttggagacgttttgctaagtgaaacaaacaatcacaaaagaacaaattatataattccacttatacctagagtagtcaaattaatagagagagacagaaaggagaatggtggttgccagggactggagggagtggagagtggggagtttgtgtttaatgggtacaaggtttcatttggttacgatggaaatgttctggagatggagggtggtgatgtttgcacaaggcagcacaagggagaggcgcagtgaaggggccacgtctgggccttgcaaccagactgtctgcatttgcatcctgccaccaccacttattagctttgtgtccatgggtaggtcccttaatctctctgtttccttatctgtaaaatatgggtaataatactaactacctctgaggttgttttgagacttcattattaatgagaatggcatataaaagtagtacaaccctatggctgaatttggaaacaacaacattaaaatttaaaatgcacctactctttgatctagtaattctactttccagcagcatcagcactcagtagaaactgtttttctccttttcctccttatcaacatcatcatcatcatcatccctatgcagctacatgtcctgatgtggaaaattctgtaaggtattgttaaatggaaaaagcaaggtacagaaagggtatagtaagctaccttttgtcatttctgtatatacatacacacatacatacatataatcatattccaatatgcctaactatgtatagactatctttgaaagactattcaagaaactaggaatggatgtatctgaggaggtgaaccaggtggctggggacaggggtaagaggaagttttcaatatataccttgttgttcttttagaattttgattcatgtacacatattaactattcaaaaatttataatttttataaagaaataaaatcccttaagccttcatttcagaatgaatctgtactcaggctgcctgggaagttagagatctgtttccctgtccaattgcagggcagtggataaggaggtaatgaaatacaacaaaatatcctgcaaccgttacaatgactttcctacattgtgaaggctagccacagtgctggaaagtgcttagacacactgtcaagtgcaaaaagcataatataaaattcttttagagaggataacaagtaaactaaaaaaaaaaagatagcacagagaaaaaaactgaaatattaaacaaggctgttttgaaataatagtactatggtaatcttttcttctttccatataaatgtattatataatcttttatttattagttcactcattatactaaaaaatacattaaaaaggaaaaatgtaagcagggattactgggtagtgacataagagactattcatttttttctcctttgtatttatctatataaaaataagctaacaatattttttaaaagaatatctccataatggtgctggaaagcaagaacattttcagaaatgttgagaaatttctgaaagagagaaagcagatgggatcaaaatgatggtaaaacctgtaggagtttctgtagaagaaactacaacctaaagcagactctagggaggactattctgcctataagaatgccggagaagctccaagcttggaaataatttaatacctacccacgtaacaacaaatggtgcccctccattccaatacacacagaggtggcagtgtttgtccccagccaaattttctccaaagtggcaaatctcttgggggaagcttttattctaggggatggggtctgaaagagaagagctgatatcgaggcaattctgcacttcgacagcagacaagaaagaaagaaaaaatagaaggcagtaccactgagacctgaagtatgacaccatgcttcgtcccagagtaaacctttgttctctggcaattgtggggttcttcagcctgcttcttgctcatccaccctaaagggaagctcttgtgttggcacatgttgcacattccaaaaggcccacagactgcacagaaaatccatgccagctcctcaagatagtcaacctggttcttcatcatacatttgaacaggcaaccaagggctaccagacatttgagggaaaccaacagcgtaatagataaggataaaggtgcataaagagaacatctggaacgggagataataaaggtaatgcagaacagaagaaaagaatgcagcccaagcgatgagaaccttccttccctattcccagatgtatctctgaagggagacacatgcccctcatgtgccagcatgttttctctatctggcttgcagttttagctcctgctgagggagtccaacagaaactgtgataacaccgcacacaatatgaatgaatctcataatcctaatgttgaacaaaagaacccagacacagaaaaggataaaccagaagtaaaaagatcaaaattagacaaaaaactagcccatgctcttggaagtcaggatagtggctatccttaagtggggttagtgactgcaaggggttgggatgcagcttaaggaatatgttcagtctgtgtaaattaattgagttgtacactttaacattgataaaaggcatatataattaatgaagaagatagaagagttaagaattttttataaatcagacaaaacattaaatgacatgaagcaaaactgttgggaatacaaaaaaaaattacaaattataaataataatggtaggatttaaccatctctttcagaaatatacaggttaaattggaaaaatgtagtgatattaaggattaagcaattaaatcaacaagcttaatatgtgtgtatctgtatagccaataaatatttttaaattctttataaatatttagggaacattgtattatgccacaataaaacatcccaataaattcatgaaagttgaaatcacataggccatatttttttaaccatagtacagtaaaagtataaataaatacaactagataatgattgcctagctttaaaactcaagaaaataaactgaacaaactattagaatcaacaagattctaatcagaatcagcagaatggttgaatatataatcaacacacaaacattacagattttctatatgccaaaatccattaatagttattcacaatattgtaaatataatacccaggaagaaatactaatcaaaatctgatcagaaattactttagtgaactttacaagctcattgtaagatttccttggagaggaaaatatacaaaaaaagaaaactttgaaaattgtcttacctgccagacatataaagttactacagagatgtgctgttcaacatggtagccactagccatactgaatatttacattaagattaattaaaattaacaatttagtttctcagaggcactagtcacatttccagtgttcaacagccacatgtgagtggatatgtgtgtgtgtgtgtgtacacaaatacataaatataaactgatactttcagcctatcatatttatatatatgatttaacaaataatagtaaagaaaatctacaagccaataaagttaacccaatagaaaaagggcatttcactgaagaataaatacaaataaaaaatacattatgaaaaatgttgaacttcatttgtagtagaaaaataaaatttaaacaacaaacatctcatttttgagtctcatatagataaaaattgatactatcctttgttggtgagagtgcactcatgcactatttttgggaaagcagaagagtacagtagttttaaggacaatttgacagtatctgtgtgatagaaaatcttcatgcttttctccccaataatttcatgtccgggaagttacctactaaaatatttatgtatttgatcaaagaaatgcatacaagactattcaatataaacagtatttgtaattgaacgaaactggggaccaattaaatgtctaccagtaagagaatgattaaataaattctgatatattcttgctgtggatgaacaatttaaaacaaaaagaataggctgggcgcagtggctcatgcctgtaatccccgcactttgggaggccgaggcaggcagatcacgaggtcaggagattgagatcatcctggctaacacggtgaaaccccgtctctactaaaaatacaaaaaaattagccaggcgtggtggtgggcacctgtagtcccagctactcgggaggctgaggcagcagaatggtgtgaacccaggatgtggagcttgcacagtgagccgagattgcgccactgcactccagcctcggccaaacagcgagactctgtctcaattaaaaaaaaaaaaaaaaaaagaataaaaataatagctaatatttatcctgtattgtacttatgatgtgccagatactattctattaactcatttactcctcatttaatcataaatcacaatcctacgatttggatgttactatcatcaaatatcattttctcagtgagggcttcactgattccactttttaaaactccaagtgcttcaccccctaaacacccttttccttccctgttttactgaacttttaccttcagatatactatataattcacttttaaattttattttatctttttcccacttctaaaatgtaagctccatgagggcaaagtatctttttctcttttgttctcttgccataaccttggtgcctagaagagtgccttgcacataatagatacaaaataaatattttggattgaatgactcatcccctaatatggtttggctctgtgtccccacccaaatctcatctcaaattgtaatccctatgtatagagggagggagctggtaggaggtgattggatcatggtgggtggttccccccatgctgttctcatgatagtgagcgagttctcagaagacctgatggtttaaaagtgtggcacttccccctttctctctgtctttcctgccaccatgaaagatgtgcgttgtttctccttcaccttctgccatgattgtaagtttcctgaggcctccccagccatgcagaactgtgagttaattaaacctctttcctttttaaattacctagtaacagtatgaaaacagactaatacagaaaattggtagtgggagtttggagccaaatgttaatagccaagacaatggggaaaatgtctccagggcatttcagagctgttcgtggcagcccctcccattacaaacccaggagcctaggagggagaaatggtttcacgggccaggcccagtgccccactgctctgtgcagccttgggacatggtgccctgcatcccagctgctccagctccagctgtggctaaaaagggccaaggtacagctcaggtcattgcttcacagggtgcaagccccaaaccttgacagcttccacgtggtgttgagcctgtgggtgcacagaagtcaagaactgagctttgggaacctccacctcagtttcagaggatgtacagacatgcctggatgtccaggcaaagtttgcatttacaaacgtgcagatgtgtggccatgagaaagttacataaaatggggatgtattattcctttttcacacggctataaataactacctgagactgtaaatgcagagatctaaaacacgctttaaaaggggtcacctcttgggaggagatgagactgtgctaagagggtgagcaggttcttcacttgttgcctctgtgtagtaggattttattgtttggaagttggtctagaaacatggccaacaattgtagttttaaaaaatacataaagcaaaaacaacagactaaatttaactaacataccttcctcacagatccttaagttgtaccaaatcacagagggaccacatcatgagaggaagagtctgctccgagacagggcctccatgcctgagccagctctcaagcacaaggcactcctcccctggcttgtttacccagtcacaagacttagcagttgaaaatgtgcaccctgaaaaaaaagtcatattagcctcacaactttcctgttttattcttagagaaattcagaattattcctataataaatcgttggaaaataaactattcatgatgactctctattcattccctcacttgccatccattcatggagagttcaggcagtctccggatgctaaggatggaagacagcacctgccctcatcgagtctagtctagcagaggcagagaagtattaaagaagaaatttcaatgttggtcatcacagttatgacaggcacaattcagggcattatgaaagtgcatggcagggctgccagagctagttaaccagtcctgagaggcctctgtgaggaaatgacgttgaagctgaagatctataggagttagccaggtgaggggagataggaatgaggggcgagaaatggggagcacttcaggcagagggaacagcatgggccaaagcctggaaagaagaatgagcatggtgaatttgaggaaatgaaataaatcctacaagggctactgaagaaaacaggaaagagtcgactgaggtaatggaggaaggagggcaggcctggaggaatttgcaagccatgctaaagatgttagacttcgtggggagccacaaagtcactgaaacagaacagtgacatgatcagatttgcattttaaatgccctctggccgccctgtgaggaatagaggggaacaggactgaacacaggtagacccactagggaagtgtccacttcagacaggcaggtgctgatgttgccttgaagtaggatggcacagacagaaagaagtagatgggcaccaaaggacatagaatcagtaagaactgtgggaacctgaatgtgggtggagaaggaagggaagagtaggggttgactccctatagtgggttaaatggtggcccctaaaaggtaggtccacatcctaactccagaaacctaagaatgtgaccttatttggaagtctttgggggatataattaaggatattaagatgagatcactttagatcacccaagtgggctctaaatccaatgacaaatgtccttataaaagacacacagagtagagaggccaggtggagaaggctgtgtaaagatgcaggcagagattggagcaatgcagccacaagccaaggaacgcctggagccactggaagctgcaaaaggcaaagaaggattctcccctagagccttcagagagacggtgggcttgctgacacacctcgattcagacttctggcctccagaactgtgaaataatcatcttcagttgtttaaaactagcacacttgttgaggcagctctaggaaaccaatacactcctcagctgctagctggatcagcaagcacagtggtccccaacctttttggcaccagggaccagtttcatggaaaacaatttttccatggaccaggttgacggatggtttcaggatgattcaagtgcattatatttatggtgtactttatttctattattattacattgtaatatataatgaaataattatacaactcaccataatgtacaatcagtaagagctctgagcttgttttccttcaactagacggtcccatctaggggtgatgggagatagtgacaggtcatcaggcattagattctcataaggagcatgcaacctacatccctcacatgcacggttcacaacagggttcacactcctatgagaatctaatactgcccttgatctggcaggaggtggagctcaggtggtaatgctcactcactgccgctcatctcctgctgggcagtccggttcctaatgggccaatgaccagtaccagtccgtggcccaggggttggggatcctagagttagtggatacaggtgtgccatttattgagccagggaatggaggagaagcaatttgaaggccagatgacttcagcttcagatgtgctgaatttgcggggcctgggaaacagtcaggtgtaggcatccatttacatggagccactccactgtcacagcgcctgaccatttgtggcagccctggctccaaaaggcagtgagatagatggatctgagactcaggcaggaggtccacattggagttctaggtttgagaacttccagcatatatccctaggttaaagtgatggaagtaaaagccattgttgggggagatcccctagaagtggaaggcctgggactctaccctgaagagtggcaagtatgtgagccactgggaaaggaaactgagaaggaaatgaaaaacggtcaggggatcagaacagaacaagacaggggaatcttttaattattccagagttaaaaaattatctttatgaaatttcagataaagttgataaaaataattcacagtttttttagagcttccattagtaaagaagaaaaagtcagtagtgcatgctatatatcatagttcatgctagacatggagaggaataaaatctcaccatgacattgctatactttgactgtgactgtgtactcagaaggtaaagtcaaaatttcatttaaaatcttcttttcatatcaatacttagctactctggagatactgctcttgattagactgaatcatctgtggaagagaagtcaaactacacagaggtaagataaaggaagaatgaccatgtaaacatgacatgaaaaagatctaaggtcatgataggttaaattgggtcataagttagaaattcagagctacctcttaactaaccaagcagaagaaaaatcatcactccccacacaaaaaccagcatgaaaagatgcacaagaacccagcatagcccctcacacacagcaagtgcctaaataatgtgaatttccttcttgtttcctaaggtctttcactgaaacttataaattaaaatataataattttgatatgtgaattcattttcctctgatatttggtattgcttacacctttatttaacaagagcaacagccaaagtgagggaagatgaagtagaaatgaagtcaccaaggtgagatgaggtcagatggaggtgggtggggccaggggagggcagatcatgtgggaccttccaggccattgtaagtgttttagattttattcccagtgatactgaaagcctgtggaaggttttgaaacagtgtgattaatattatttcaacaacagtacacatttatgaatgaataaatgttctaaatccatcagtattaaaacagtaaataagtattataagaactttttggattgcttaagccttcataactttcccaatgtttgttattcttgtggcctctcatctgcttgagttgaaaaggacatcttggtatatgtcttttatccaccacacctggctaattttttgcatttttagtagagacatggtttcactgtgttagccaggatggtctcgatctcctgacctcatgatcctcctgcctcgtgatcctcctgcctcagctaccgcgcctggccaagatcattttttaactctggaataattaaaagattcccctgtcttgttctgttttgatcccctgaccatttttcatttccttctcactttcctttcccagtggctcacatacttgccactcttcagtacctgtgtgttttggagaaagtaaggaagaacagggtctgctgtgtgaagtctcatgagtaaggaggaacccccaagacagagaggatggtggaaaggaaaggaaagcagccaaaatttgtggtctatttttgagaggcaattctccacggatctcccacatctctgtatgcctttcgagcaaagacactgacagtgtttcctccagaatatatttcctaggatgtttatacagcaaaacccttggaagacagagatggtgtctctctcaagagaaaaggaaaggcatgcttattgcccattagcattattttagtaaaagcacagttatgggtcaataaatgttggttctttatatttggatttggattccttatgtcagacttcatctcatgtaatgcaatccactgccatatctagtatctcctggccctgatcacatagcttctgtgggacctgaggacaaggagaacagatgcaagaaaatgcgaatgcactggatgttaccattgatgtcagtaagaagtcctttttctctgacccaggagtcatgtgtcttccaccagcatctgtgaaactatggcaggctgacttgctggcctgcatgcaggataaaaatctcagaccttctacagttgttgacacaaatgagagtaaaaccaaagcccagcagtggtcaagaacttaagtacaggtaattccctgatacctttaggatattttagcctcaaagtagtggttctcaaccaggcatgattttgcctcccaggggatatttggcagtgtctggggacacttatgattgtcacaattgaagtatgctactggcatctagtgggtagaggtcaaggatgctgctgaacatcatatgatatgcagtggacccccacacacacacaacaaaacaattttcacttccaaatgtcaatagtgttgtggttgagaaattctggcctcaattaaagaggccatataatcaacacaggcactatagaggccaaagagaaatgtgactctgctcctgccccaggggagctctcaacctcactccagccttcatcttttccttctgacatctgtttctgttcatcccacctgctctctttcccccacctcccatcactgctacctgctgttagtcatcctatgtccatcacccataattatcctctgagttcattcattatgggcataaaaagttagaaaccataccacaaaattaaggtcacacaggaaccctatgactgggtcaggaaaggaaactgctcaccaggtcttgcccagacaacccctcaactatgaaatgcctggggtgtttaagaaacagcaaagtgacccatgtggacagcatggagtgagcaagggagaaagtggcagaagacaaggttggatgggtgatggcaaacggacagactgccaagggcagagctcctcaaactttaatgtgtgtgtgaatcacctgggggatttgctcaaagcaggttctgattatgtagacctaggagggacaggtgattttctacttctaaggagctccaatgtcaatgcttttagaaaatggaccatattagagtacaggagtatagggtctcgtaggcctttgccagaactctagcttttactccgaaaaagatggaatgctgctggagggtttggatcaggaaatgtaatttgacatttcaacaggaccatctgacctctgttttaagaatattgagtacccaagaggaatgaacacattttcattcatagcaacaattgccataatagactcaaactggaattaatccacatgaccatcaacagcagaatggataattatggtgtattcatataatgggatactataaaacatggaaaaaataatgtattacttctacaagcaacaatgtagatgaatttcacagatgtaatgttgaattaagaaaacagacataataaagtatataccatatagtcccatatataaggagcgttaaaataggcaaaattaatttatggggatagaagtctagagagtggtgacttttagcactgagagaggcgggaggaagcctcctgcgggggggctgggaatgatctatcttttgatctgggtgttaagtacacaggaataaacatctgtagaaatcaagctgtactcttaagatttgtgcacatcactatatctatgttatactttaacataagaagaaaggaaggagtattgcagatgggcaagggtaacaatagggagagcagttaggaggctatagcactaatccaggcaacaaacaggggtctggggtagagtgacaccagtgaaaatggtgagaagtggttggattctagatatatttggaattgggagctgaaatgattttctgatggactggatataggtgacatgatgtgtcaagcaggcagtttggtatagcagtctgtagttatggccaaattctgggttagaaatattaatttgaaggcatcagttatgcgggagttatttgaaattatgagactggatgaaatgccccaggaagcgagtatagatggtgaaaagaagacaatggcaatctgagccacagccactccaggaatgtgtaacagtcaggaagaagaggaggcaaaggagactgagacagcacagtcagagagacagggagacaggctgcaagtgtggtttcccaggaacaactgaggaatgtttttcaaggagggagagatcaactgtgtcaaaagttgctgagaaattgggtgagatgagcactgagatatcgcaagcttgtcattcattagtaaacatctaaaattctgcctgttacagagaaagcactcaataaatatcataggatatatgcagatgatacataaaaatctatataaactcactattcttgccaagagatcatatttctgcattgaagaaaataataagtcttcacaaactggcctactctttcactctttccccagcccttgaggttttgacttaaaatgaggaagtagagaggatcttctccccatttggaatagcccaagggcatgagcctagccctcagtcgccctggtcctaaaggtcatggagaaatgaagtgttctcttggcctgttctgtaatttctgctagaacttgtgatgaaatgtccctctttagagaaacaggacttccacttaacctctctgtgcttcagtttcctcgtctacaaagtgggaataataaaagtgtcaatctcataatttgttacaaagattaaaggcgttcatatatgcaaagaacctacaacagcatctggcacatagcaagtgctaaataagtattaggtatttatgatattgtcatgatattgacaacgtcctccagctgaaggtaccaggaaaatacctacagttgataaagttggcttattgacttgtgcaatgaagaagacatgtaccatggggaactgtggggtgtctcagtaagagggtattagagaggacttaacataggacatggacttgtgttagatatttggaggagggcccaaagattacctggattggatgctgtcaggaagtggccatagttatatgatgggatatcttaagatttacttagaagcaggaagaaaaaagcaggcaacagtgaaaaatagtaaggctgcaggagcactgctattagtcagcaggggggatgcttggtcatttctgtggttttgacaacgttcatgtggttgtcagtgcctggcatgattacagaatggtcttgttttatgtctttgttcatcacaagtcacagcatggtcttgtctgatggtgctgatctatgaaattgtttatgttctgcaggagaacatgacggtctagctgatagtgccaggtcagcccccacctgtcagggtatgtaaaaaatgccatgtgctttgaggggatcattaaaatactttggaaagactttccatttcctccagtaccatctggataatgagtcatcagagaaaacctggagaggtgggcagagaggagtaactgatctaggaagaccccaattgcttagtcctagacatgctcatcttctctgcttcgcaaatgattcactgaaagctctcagaaggggctgggaattttctaggtgacccaaaataagttcatgaagaaaacaggaagagataggagtttgttagcctgcactccaggataaaatggcattctccctaatgaccgaaggccattataaggacaaagtagagaaaccagcttcatagtatgtgaaacggaccttcattgaaggacaacacctgtgggaactcccagccagaaagcacatcaggaaacctgaactgccaggagaaatatcaaggaggagtgaggaacaagggtgtgatttccagggtcctgaaatgaagaatacccaggaaggttggtacatcatgtccagaagcaccaggaaggtgccactggggtcagacagtcattgaggaaatctagtggagtcaaaggaaccaatgcaggccatctagaagattctaaaatccagataccaaccctcgtctgcttcaggatgggagggtatttttgcttaaaataccagcaattctcaactctgtgactaattcagttcttctgtgtgaatgtgtatatgtgtgtgcgtgtgtgtgtgtgtgtgtgtatgtgtatatatatatatatatttgcctttctccatgtaaaattaggcctgaaaaaccacaaaactgccagacgaagacctagacatgtgacacttttatcagaatttatcaaggtagcctcatgctggaccagtttcaaaatttgaaagatcacaggagaggccaaacagagtggtctcaggcagagagagtcaaagaggcaggctgagggggctgaagacccttcccgccttggctgtccccacagggtccaagggcagaatgcaaacactatcacatcattctcacctttcctctacaaatgatgtttattctccttggcatttgataattcagcaaatcaagttggggttagtggctttggagccagagagacccagatctttaactcaggctccttcaggtaatcattgcctgatctcaaccatggcattcctccaaactgcagcttccccaatgtacccagtcactcctaccttgcaaggctgttgtgtgacttagagataatataggtaaaaaggcaaacccaggtgtagccaacaaagaaaaataatatcaagtcaagtttatagctatgctgctttttgtatctccactggagattttttaaatgtcttcaaaacacaaaatgactaaatcttcaaaaagaaaaaagttctatttactaacataattctcaattgtcagaaaattataataagggggacattagtggttggttttgggttttcttgttttttgtttgtttttgcactattcggtctctccaccctaaatatcaaagcagcaggattttctaagaacaattaaaagatacctagcacatcccaatagccagaaaagtactttgcggaattgatgttggtcacaagactttaaaaacttgacttaaatggttaaatgcatgtgtgtgcataaagcatcattaactttatctaaaaatcactgatttgaggcaactttatatgatgcgatatggttttgatttgtgctaagtcaaaataagattatttatctttgaaccaattgcagtttatggcacttggtttcttggagtggaaaagaaaacagccaacatgtcttgaaaacattgccggggaaataaaagctaagataagaaaagaaagtcatcctgctgcaatactaatttcacctagattatcgcaatatttctcttgaggatagcatactttgatttcatatcagaaaattccataaaattagtttgttacatgtaatgagctgtgcttctgggtacaaagatgacatcacactggccacatctttggcctttggtcagaagcagtgataaactggtgtagaccgaactctgctttctccatgtcaccctgtaatcagtgacacacattttggagactgtcctccagagtaaaaggcagagtttgtggcattgaggcaagagtaaggctagctcttctccatggatgaaccaataaacaaagcaagcagccccacaggtatcctgaaaggttcagtcgtattcatgctttgtctaatttagctgtccttaaacttttagcaagccaagacacctcaaagctagtgacttattaggttctctgtaggaattaggggaaggaatgttggctgggaaagccctgcaggtaatttagacgcacctcccctccctcatccttccatgcagaagtagggatgggcatgttcctctcagttgaacaattcaaggctgatctccttagctgcaaggatgcacagagaggagaagttggtctggcctgggcaacactaaactcatctcttagagctctgacatatgtaccatgagacctagagggggaaagtgtgtgaggcagcaacaaggctaagcatgctgaacacactgggacaaattgagttttctgtgcctttgggtttttttccacttaaatctcagacgctgtaatagcagttatattatctggtctcctcaggactactccggagaggtacttttaggacaaatgggtatttgtcaagttgttatggatgttcacaataaagatatgatcatagttctgattaattgcttagggttaatatattgatataaatgaactgccattgacaatcagtcccagaggaatgtattctttatttctacaacttatctttaattgtgtcttaaaacttctactaacacttcctattcactgtatcattattgtgcaattataatacagttattcataaagcaaattgcttaaggctaactcacattctcacattagcatgtctcggcttttgcatatgtctcatgaatatgtgaagcaggaggagataagcattccaattctgtagtcaggctccctgatttgaatctgagctcccctacatactagctgtgtgacctcaggcaagctgcttttcatctttgggcttcagttatctcatctattaaaaagaaataaataattagatctccttactgggtgatcataaaataagagaatacataaaatgttcagactagtaactggcatttaataagcattcagtaaaaattaactactatgagtatttttggcatgcccctttatttaaatttccggattgatttttatttatttactttatttcattttattattattatttatttttgagacagagtctcactctgttgcccaggctggagtgcagtggtgcagtctcggctcactgcaacctccacctcccaggttcaagtgattctcctgcctcagcctcccgagtagctgtgattacaggtgtgtgccaccacacccggctaatttttgtatttttattagagacaggatttcaccatgttggccaggctggtctcaaacttctgacctcaggtgatccacccgcctcagcctcccaaagtactgggattacaggtatgagccaccgcacccagccaaaatttctggattttaaaaactatttgcgacattataataagatgacttcaccctgccatttttattttctccctcagtgagtgaagtcaggataaacatccttttttgttcctcctaccatgtacacaataacaagaaatagctagttggaaaaatgaacatcttgtaataatatgaaatatatttaaaagccttctacttcctacacctcttggtggtttttttctatggttactgtgaaatatgtggatttttaaaaatagctctagcagttaaatgatgctgtaaaaccccaatatggtaagtgtaaataattctaacagtaatttcttgttactatacctttcaaagaggtttattctataatttagtaaggtctctcaacattagtcattttactcagcaacaaatatggaccttctcaaagagaatcacagaacaagagaattaacaatcttattttttttcttaaccattggtaagaaaatgagctgtgctgctcattttcaatcttttggaatcagaaattctcttactagtttgtagtttttgctgaggtttctatttttttaataagctgggaataaggacgagctacctcaaagaattaagtaatttctttctaacaatatttaaccatttgctgatttaaagttgagctactattttttctgggttgattccaaagagaatagatttccgttttaaagatttttaagattggcaataagaaaaaggcctatcaaatacaaatatatgccctcatggaaatgaacactaaaaactatacccagatttttgaccatctgggaagaaaagcctcttaccttatagtgagatacattctccttcagttggtgaatctctagaaatgaccatctccctagcccagcattctatctagtgttgctatttttatcattaacaccaagtttcatacacatccctttcctaaggaactgtaaacatgttcactacaagtaacctttcggaagtgaaagtttcaaaggcaaaatgatctagactttttgatgttgtgactaagatttatttaattcctgggaaacaaaagcaggaagcctacatgacttcctgatgaactgagggtgagcagggaaggcagaggaggcagacatatttactagtttctaacatagccatagagaaaagaacaaggtaaatggctcaggtgcagggaaatgaagaacgagggagaaaacatgaactgaatggaactttccatgaggattttttaatgagaagttttttgtttgtttgtttgtttttgagaaggagtctcgctgtgttgcccaggctggagtgcaatggcgcaatctcagctcactgcaacttccgcctcccgggttcaagcaattctcctgcctcagcctcccgagtagctgggattacaggcgcccaccaccatgcccggctaatttttgtattttcagtagaggcagagtctcaccatgttggtcaggctggtctcaacctcctgacctcaggtgatccacctgcctcagcctcccaaagtgctgggattacaggcgtaagccactgcgtgacagggaagtttttttttaaatataacttttcatttaggaaaacgttcaaatattggatgctataacaaaattcaccatagtttcctgtatcagtgatttaaacatgtctgttttttaatgaactctcttcttgctgctggagatagactacagtgaactatttccaaacagccagccatggtgaagctgactgcaacggagcctcagggaaggcaatgagggtgagggaagtgggcagaggggcccccattctgcaaggctttgcagcaaggctacccaagctatcttgaaagattccgacttttttgttttacattttattagaaggcattatgacaatgaaacattacactcaaaatattacacttagattttcctagtggtgaaaaggctttgcaaaaaaaaaaaaacttaatgaaagattatcttcaaacagattatcttcaaataggtgtaatatattattggggttttacaattttcaagagaagtattcgacaactagtggtagttaagttcatgcacaaatacattaagctgacaaacttttattaggatttgagtaaagttactgatatatgctgtagatatatgaaactataaaatgaatcttctctacagaatcattagtgtgaggcatgatattagtttatttataataattgtcaagcaagcaactcagtgaattactggtacttcaattctggacttcaattctgaagtcactgaaatcctggacagtagttctgaccattgatgtaaataactttgcagaattatggagcaggactcattaagaaataagagtaacattcattatgaaataagaaagtattgactcatgtagcagaaagtaatataagagcaggtgaaacaagcattaaacttaagaacatgtttaaacagtgcaaattcctttgtataatgatctctattcactacttgatctggcattttcttttatcctctgagctataggacagcataataacttgtaagcctatctcttgaaataggcaaaaagaaccaaaccaagatgtagtttcttaatcctaatttgcatagttttcatttttccaaggcattttcatggaaacattgacaaaaaaaaaggtggattttttttatttgattggataccattaagaaatgcattagggttcatcctctaacctaacagttttttttttttttttttttcctgagacagagtctcactctgttgcccagactggcgtgaggtggcacaatcttggttcactgcaacctccacctcccgagttcaagcgattctcctgccttagcctcccaagtagctgggattacaggtgcccgccaacatgcccggctaatttttgtagttttagtagagacggggtttcaccatgtgggccaggctggtctcgaactcctgacctgaggtgatcagtccgcctcagcctcacaaagtgctgggattacaggcatgaatcaccacacccagcaaacctaacacttttaattatactttacaattctgaaagactctctcaagtggattttggacactaacaagaacacaacaaaatgatttattttttatttttttattttttgagacagggtgtcactctgtagcccaggctggagtacaatggtgtgatctcggctcactgcaacctcaacctcccaggttcaagtgattctcctgcctcagcctcccgagtagctggcactacaggcatgtaccaccacacatggctaatttttgtatttttagtatttttaatagagacagggtttcaccatgttggccaggctggtctcgatctcctaacctcaggtgatctgcccacctcagcctcgcaaagtgctggaattaaaggcgtgagccactgcatccggccacaacaaaataatttcaataaaacattttcacatatgaaaagttagttttagaattgcatttaatgactctttatatccagaaggcatttaaaaataataaataaagacattttaagaagggcaaaaacctagcagaaaacagttttctcttctagctagtctgtgctggaagactgggtagaaatgatgcattttatcattatcatctgaatgtaacagatggaagccagctatggataaatctacaactccaacaaagactggaacaatttatctcatcaaaattaagcacttcattttcagtgagttgaagaatcacaacatgattctcatcttaaaattatacagttcaatgtgattcatacttcacagtgacaataaaggcaaacataagactattctactaaagcagaatttttgaaaatcagagttttaaccaaaagtttaaattaacttccaaacttatttgctcttatgagtaaattttgatgctggaagcaaatattttagtggtaagtatgaatgcgaaggctacaaaacgaaattgtaggcttcctactagtggcaacagattgtaggctactcgtgcctactagtggcaacccattaggaaatgagctcatggactttcttccaggtaagatcaaagaagtcagtgtgcttactaccctcatcttgcacatgactttcccctcactttattcacgcttctattcaaatacttctttccaaaggcagctcttccctgacctctacatccagctttagtgttcatcatagcacttagctcgatttacactttgtatttctttaaatactgtatgtcatttctattaaacgtaggctgtatatgagcagtgactgagttcaattctgtatcccaatcaccttagataggtgttcatcaaatatttgttgaaagaaggaagaaaagagggcaggaaggaaggaaggagggagggaaggaaagaaagaagggatggagggtgggggaaagaaacagggaaaaggaggaagaaaagggagggaagaggggagagagggaagaaggaagcaagcaatggtcagtggcttggaggcatctgcctaaacacatgcactgtggctaaggaaaaaggagaaagcaagaacactacaagcagctgtcccaggtgctgccctcaggtcactgaacttacagagcataaagatacagggagcattggctgcccttggtgtcagctgcgctcagcacactttagtttgtgagcttgctcctcttctctatctctagctttgaggcagccctgagaacgatggtcactttcttctcctccttatttccttttatttcaaaactagaacggggaggcatagaacttgaaggaggacatagctgagatctgtgcaaataggaactctgtagcttggtgcccacatccgaatggatgcatagagcaaagcctgaaccacactgaggactagagcaggtagattaggatatcagtggatggacagcaaaacgggagcagacaatgaataagatcccttccaagtgggagcttctctttgtgactctgggaaagctgatagggcagcagctgcacccttaccactcagcaacccccaaaggagaaacatcaggggtgggttaccctccagcagtgctttactgctcagatttaggaaggtgagaaacctgctgcccagtcataggactgcagcatgccagggaccctccagaagcaatatgcttttaatcacagatgaaaagtacttaatagttactgaactacataaaaacaatgacaaccgatccaaggagagaagttaactctgttaagccaaccaagtgacacaaggttttgcctggaggaaagaaaacagagaaacaagctgtgatcttccttttttgtagcaagtgctttgaatctccttggagaaggaagtccacagagaacaatttgatttctaagtgagtaataattagatgctctaagttttcaatttgataaagctacaaacatcctggcatttcttctccactgcaccccaacccacaatatgggggtataaagcctttgggatcctctcactggagaagtccatatctgagatacctcattttacatcataaagctttgaggaaattatatcatgtttaaaaactttttaaaagaaggcgccacatgatgttataatattgggtagcattttaccaccaagtagtgatggggtcagaacaagtcatcccaaaatatgccactttgatgtattattttgagctaaaagaaactgagaaccagtcaatgcagaaaaagcacttcgcctccccatctgcttaaagtataatttcccatttgtaaaggacatttttattagtaaatgtatctatctttgccagaaagagagttactcatagataactttttctcactggagagacttttatctgcatagcaaggtaacctttattcaccacacatttcctcctctcgccttcccacaattcatctctaccactccccagtacccccaaatccttattcctattccttactctagcttaagatagtatctgtctcaatcatctggctgcttcctggagtctcatattttggtgggactcctgtgcatatgtgagtaattaaatattttttctccttttaatctgtctaatgtcaatttaattcatagaccagccaaaaaacctcaaagggtacacagaagcaattttccctctcctacagtagtttcccccctgataaaatatatgaagaaaacaaaatccttgccattattatttcaccttatatcacttctgtctgaagattacttgttcttcccttttatatgctcaataggcagattttttttcccttttctttagagttgtgcatttttagattgtccggtccttgcaagtgacagttagtgaatatgaaagctctaatgttatatttattaaaggtacatagcaccaaactattacttagaaatgaattaattttcaaaggttttaaaatatctaacctaataaaatttcccttacttgtaagtatactaatgtctttgaatatgcaaatgtttaaatactaaaaatataagcaaaatatggaattaaaatacgcaggccaggcacggtggctcatgcctgtaataccagcaatttgggaggccgaggtgggtggattcactggaagtcaggagtttgagaccagcctggccaacatggctaaactacgtcgctactaaaaataccaaaaattagccaggcctggtggtgcacgcctgtcatcccagctactcaggaagctgaggaaggagaatcacttgaacctgaaagcagaggttgcagtgagccaagatcgcaccactgcactccagtctgggcgacagagtgagactctgtctcaaaaaaaataaatgaaataaataaataaataaagtgttattctaatcagctcttaaggtggtggtagtaatttttattgttatatgtgcaaaaaaaattcaccaaaatttgtgggtagattagcagttactaatgttaaagtgcagggtctacagctgaagttctccttgtgttttttacttgtttatgtacattaaaaagaaaacatatgatcacagatagattttccaagagaggaaaattacgcataatccccactcaatataacttctaatactcaaaggtcttcatattcaaaattccctcaaaacatatgtggcttcaaattgtggggtgcataactgaaaataatcattttacattataatttgacatttaagtcatgtaaaatgatttaaaaatcagaccaagtgtaaaataaattccaattccaaatgacataatcctattaccgtaatgaaataaatccctaacctgatggtccctgtatttctaatttgtctttggtaaatatacttgaactgaacctaaccaggaatttaacatcataaacctaccaaacagattcaaagataacacaaaatttgtgtttactgaacatcatccaaatatttcttcttctaagaaaagcactgtgtaaaataatttgaaccaccagaacatataaatattataaaagtactcaaccttgtcttttcatctttatatcctccttgaatagtacagaggctggcatattgttattgtttaataagcattgaataagtaaaccagtattattctctttggggttctatccttaacataaacaaatgtgaagacgcaaattagaaaaccaacatattcaactacgctgctattcagccatatgatgtaattctaacatattttttccagaaacattctgaggcactgctttgtaaattcatgcctaagtgtaagggtaagtgtaggagaagtggggtgttgggaaactttatcctcaaaaaccccagaaaccaagttagataagatcttaagatagttggcttaaaaataaaaacataatatttttactttaaaattttactttttaaggaaaaataactgctactgctggccttaattattactattattttgccgggacaggtggccaataggggaatttaagtctttcattttcaagtatacaagcttagtgttccattacccagtctacacaagacacaggactataagctcaagtcacagaaactactggaagtctatcaaagacataaagaaataagaaaggcaacaagaattttaaatataggacgggctagaaaaaaatatgtagattaggttatgcttttctagaaaactgcattaatttgttcacattaaaactttgtctaacactattttgttttgcatggcatttagaatgaggtaaatatacaatagaacaaacaagaaagttaataaagcaatagagagaatttgtaattaagactgttaacctctagcaaacttctatggcctgtaacccagagaaagattagaaatgactacaatataccaaataagcttcacagatgaacaggaagactttgtgtcaaaaaaaacattttttaagcagagccttccatctaaaaacaatatatactacttataaataaaataaaccagcattttttactttcgtttgatgtaaatttgttaattgttatatgaggaaaacaggtattcaaaagccaatatcaccttaatttatgttccaggtgaagataagagttgtagttctaaaatttctttaaggttgtaatatctatatctgaaaggtgacatcaatttttttattttattttttccttcccaaaggcggtgtcaaggggacatcaattctattgtggaagcaacttctctgttgtaaaatccatgtaacgcactggaaagttcttttctctttggtcaacagacacttgtctcatgtttagtgtggattttttttttctaattaccacagttacagcaaagtcttacccaaaaatttaatttgtaattatcgcaggtatgtaaagcagtttgagagcatcaaattcaatctaaaattgctagaaaacttgttacagtttaataaacaattactttaaatgtacatttttagtgttcctgaataatgcaggtttctgttaaattttagaaaatcatttgtaacaaaaccacgaacatactattattttgtttgattagtgtcaacagaaggtagagatagtattccctcaaaagagtttaacagagaagaatgtaatgaaagaactctgcactctctgtggacagggtttaaggtaacctcaagggatgaaaaggcacccaggggctgacaatagcaggaaaccatgaactcttttaggctagaaggggaaggggaaggaaacagtattaaccagatccagcaacagatggagctattgaagtggtactgcctaaaaggatctgtggcttaggaacccactgccatagccagaccacatacctaaactcactgtctccctaccctccagactcctgctgggaaccacactggctgatccccatcagaagccagagggcaagggaatctgggaaatgcagtgtggagggtcagactcagagcacagggcagtgacggacgaggaagagcagggtatggaggagccaggtgggcaggttgtggtaggacatcaaacagagaatgttcaggtctccacccaacttatgtcaaatagtgatctgaatcagcatgacagactatttttagagttcttgtttaaatcagtttcaaaatttttataaagtgtaaaagtaggacagcaaaattaagtccttaacgtttttgaaatttaggaagaaatgatggttagcacaaatcagaattagttgtaaagtaaatactaagtattgaaacagaaggcaaatgtcttgacaagaaaaaattgaaaacagaaatgagcaaggggcattaaaaacgtaaaataaagaaacttatagaacagaccaaaccctagcaggaaaaatagtattctcccctggataataggtagtggaaggctgggtagaaataaggtttattttgctgcatttaatcattattggtctcaatgtaacagatggaaggtggcattagataattttaaacagacagcagattggaacaatttatttcaccaatactaggtgctttgttatacagcgagttgagaggttgaggttgctaaatgattcttttttcttttttttttttttttgagatggagttttgctcttgttgcccaagctggagtacaatggtgcgatctccgctcactgcaacctctgcctcccgggttcaagtgattctcctacctcagcctcctgagtagctgggattacaggcgcacgccaccactcctggctaattttctgtatttttagtagaaacggggtttcaccaagttagccaggctggtctcgaactcctgacctcaggtgatccgcctgcctcggcctcccaaagtgctgggattacaggcgtgagccaccacgcccagccatgattctcattcttaatggtgtacattttgaagtgattcatacttcacagtaaggataaaggcaacgataagattgttctactaaagcacaagaaaacaatatcaccgtattaaccagaagtttaaaatttaatctcattctatgttctctattgagtaaacttctatcctggaagcaaatattttagtgatgagtatgaaggggaggactacaaaacaaaatggtgtgcttattaatggttacagataaatcaacccatgagaaaatgggctcatgcacttttcttcacataagatgacagaaggaaataccatttctatggcctctgcctgttcataggttcccccttatcctacaagactaataaagagaaaaagcagaagattcaaataaacacaatcagaaatgttaagggggataccaccactgacaccacagaaatacaaacaaccatcagagaatactataaacacctctatgcaaataaactagaaaatctagaagaaatgggtacattcctggacacatacacccttctcaagactgaaccaggaagaagttgaacccctgaatagacaatgagttctgaaattgaggcagtaatgaacagcctaccaaccaaaaacagcccagatcctgatggatttacagctgaattctaccagaagtacaaagaagagctggtaccatttcttctgaaatgattccaaacaattgaaaaggagggacccctccctaactcattctatgaggacagcatcatcccgataccaaaacctggcagagatgcaacaaaaaaaagaaaacttcaggccaatatccctgatgaacatcgatacaaaaatcctcaataaaatactggcaagccaaaaccagcagcacatcaaaaagcttatccatcccaatcaagatggctttatccccaggatgcaagggttggttcaacatacacaaatcaataaatgtgattcatcgcataaacagaactaaagacaaaaaccatataattatctcaatagatgcaaaaaacacctttgataaaattcaacatcgcttcatgttaaaaactcttaataaactaaatattgaaggaacacacttcaaaataataagagccatttatgacaaacccacagccaatagcatactgaatgggcaaaagctggaagcattccccttgaaaaccagcacaagacaaggatgccctctctcaccactcctattcaacatagtgttggaagtcctagccaggtcaatcaggcaagagaaagaaataaagtgtattcaaataggaagagaggagatcaaattgtctttgtttgcagatgacatgaccctttacctagaaaaccccattgactcagcccaaaagcttcttaagttgataagcaacttcagcaaagtctgaggatgcaaaatcaatgtgcagaaatcacaagcattcctatataccaacaatagacaagcagagagccaaatcatgaatgaactcccattcacaactgccacaaagaaaataaaatgcctaggaatacagctaacaagggaagtgaaggacctcttcaatgagaactacaaacctctgctcaaggaaatcagagaggacacaagcagatggataggaagaatcaatatcgtaaaaatggccatactgcccaaaacaatttatagattcagtgctactcccattaaattaccattgacattcttcacagaattagaaaaaagtattttaaaattcatatggaaccaaaaaagagctcgcatagccaagacaatcctaagcaaaaagaacaaagctggaggaatcatgctacctgacttcaaactatactacaaggttacagtaatcaaaacagcatggtactggtatttttaaaatagacacataaaccaatggaacagaatacataactcggaaatgaaactcatatctacaactgtctgatctttgacaaacctgacaaaaacaagcaatggggaaaggactccctatttaataaatggtgctgagagaaatggttagccatatgtagaaaattgaaactggatcccttccttacaccctataaaagttaactcaagatggattaaagacttaaatgtaaaacccagaactataaaaaccctagaagaaaatctaggcaatactatttaggacacaggcataggcaaagattttatgatgaaattgccaaaggcaactgcaacaaaagcaaaaattgacaaatgggatctaattaaactaaagagcttctgcacagcaaatgaaactatcatcagaggaaacagacaacctacagaatagaagaaaatttttgcaatctatccatctgacaaaggtctaatatccagaatctacaaggaacttaagaaaatttacaagaaaaaaacaaacaatcccatcaaaaagtgggcaaaggatatgaacagacacttctcaaaaaaagacatacatgccgccaacaaacatatgaaaaaaagctcaacatcactgatcactagagaaatgcaaatcaaaaccacaatgagataccatctcacaccagtcagaatggaaattattaaaaaatcaagaaacaacagatgctggcagtattgaggcgaaataggaaagcttttatactgttggtgggaatttaaattagttcaacctttgtggaagacagtatggcaatttctcaaagatttagaaccgaaaataccatttgacccagcaatcccattactgggtatatacccaaaggattataaatcattctgttataaagacatatacatacgtatgttcactgcagcactattcacaatagcaaagacatggaatcaacccaaatgcccatcaataacagactggataaagaaagtgtggtacatatacaccatggaatactatgcagccataaaaaggaacaagatcatgtcctttgcagggcaatggatgaagctggaagccattatcctcaacaaactaacgcaggaacagaaaaccaaacactgcatgttctcttataagtgggaggtgaacaatgagaacacatggagacagggaggggaacaacattcactggggcctgttgggggagggtgggccagggggagaacattagggaaaagagctaatgcgtgctgggcttaatacctaggtgatgggttgacaggtacagcaaaccaccatggtacacgtttgcctatgtaacaaaatgcacatcctacacatatactctggaactaataaaaacctacatattggctacgacacactactcaggttatgggtgcattaaaatctcagaattcaccactatagaattcatccatgtaaccaaaaaccacttgtacccaaaagctattgaaatttttaaaaatattaaaaataaaaatgaagttaaggtataaggtctacagttgcagctctcactgtgctttttgtttgtgtacattatagaataaaatgtaattgcagagtgtttcaggaaagaaaaatcacccatagtccctcacttttatattgcttttaaaactttgaggtcttcatgtataaaattttctcaaagtaaatatttcttcaaattaatatttttactttggagtacataattttattctataatttggcatctaaaacatgtacaatgattgacaatcaaatgaatgttctcatatataacaaaaattcagatgctaaatgacaaaattatcttaccataataaataaaatcctaacccaatggccccatattgctaatttgtcttcagtaaatatacttgaactgaacctacccatgaacttaaactgacatcactaatttttcatacacacaaagaaaacaccaaatttgtgtttattgaacataatctaaattgttcttcttccaaggaaagcactatgtgatataatttgaaacacttcagaacatttaattattatagaacttctgaaccttgtgtttttatctttataaccttattgactagcacagggcctggcatattgtcagggctttaaaaagtgttgagtaaataaattagtattacaatattctatttggggttctatccataacataaacatgtctgattacacctctagacagcattctaatgttgttcttacaaatttttcaaaaaaaaaaaaattctgaagcattgctttgcaaatccacacctaaagtgataactcaagaacaggagaagtggagaatttggagactttaccctaaaaaccctaggaaccaagttagataggatcttgaaataattggcttaaaaatagtaacatttgaccttaaaaccataattttaaaagaaaagcaaaatgctattgccactcttaattgcatctgtaactatgtgtgtgtgtgtctgtgtgtgtatgactgatattagcatttaatgctgccattttcaagtactactacaaaggtttagtgtttcattgcctaatctgtatatagacaactctattgtaagtccaggacatggaatttaacagaagcccaccaaagacatgtagaaattttctctgagggaataactggtctaaatttggaggggcaagaaaaaaagttttattttagattatattttgctataaaatcatattatcttgttcacactgaaagtggctttcgaactgtgaaatgggcagaggttggaagagtgtggagggctcagaggaagacagaaggatgacggaaagttggatcttcctagagacttgctgaatggttgtgacccaaatgctgatagtgatatggacagagatggccaggtggatgaggtctcagatggaaatgaaaaacctatgggaagcggagcagtcacttctcttaagctttagcaaagagcctggctgcactgtgcccctgccaagggatatgcgcaacttcgagcttgagagtgatgatttacggtatctggtggaagaaatttctaaccagcaaaacatttgagatgtagactggctgcttctagcagcctaggctcatatgcacaagcaaagaaatgacctaaaactggaacttatatttaaaagggagcataaaagtttacaaaatttgtagcatagccatgtggtagaaaagaaaagcccatttctgggtgaagaattcaagcaggctgcatcaatttgcataagtaaagaggagccaagtctaatagtcaagacaataaagaaaaggccttgaagacatttcagagacctttgcagcagcccctcccatcacaggcccagaggcctaagaggacagaatggtttcctgggccaggcccagagccccacttccctgcacagccttgggacactgttcccccacatcacagtcactccagctccagcttcaggtcagatacagctcagatacagatacagctctggtcactgcttcagagggtgcaagctgtaagtcttggcagcttccatgtgatgctaagcctgtgagtatgcagcggataagagttgaggcttgggagcctcttcctagattttggaggatgtatggaaaagtctggatgtccaggcagaagcctgctgcagggggagattcctcatggagaacctctattagagcagtacagaggggaaatatggggttgaagcccccacaaagattccactggggcactgtgatggttaatactgagtgtcaacttgattggattgaaggatgcaaagtattaatcctgggtatatctgtgagggtgttgccaaaggagattaacatttaagtcagtgggttggggaaggcagatctacccttaatctggatgggcaccatctaatcagctgccagtgaatataaagcaggcagaaagacgtgaaaaggttagactggcgtagcctcctggcctacatctttctcccgtgctggatgcttcctgaccttgaacatcggactccgagttcttcaattttggaactcggactggctatccttgctccttagcctgcagatggcctattgtgggatcttgtgatcgtgtgagttaatacttaataaactcccctttatatatatacccagagtggtagatccactgacagctcagaccctgctcctggaaaagccacagacactcaacaccagcccatgagagcagttgtgggggctgaaccttgcaaagccacagggatggagctgcccaaagccttgggagcccatccctcacaccagtgtgcgctggatgtgggacatgaagtccaagaagatcagtttggagctttaaggtttaatgactgccctgctgggttttagatgcatggggcctgtagcccctttattttggccaaattctcctatttggaatgagagtgtttacccagtgtatcttggaatacctccaatgtatcttggaataatgaaattctaacttttttttccagaaacattctaaggcatggcttttcaaattcttatctaagaacaagcataggagaagtgggacctggagaaatttttacctttaaaaaccctagaaaccaagcatataagatgataaaatgattgcttttaaaataataaaataatattttgactttaaaactttatttttaaaagcaagaaaaattgctattactggccttaattgtacctattcatttttctatttgtgactgaaataagcatttaaggtgatcattttcaagtataaaagtttacactacattatacaatctgtgcaatcaacctcactataaactcaagacatagaaattaacagaagtgggtgggcacagtggctcatgcctgtaatcccggcactttgggaggctgagtcaagtggatcacttgaggtcaggagtttaagaccagcctaggcaacatggtgaaacccccatctatactaaaaaaaagttcaaaaattagctgacatgctcacttgaacccaggaggcagaggttgcagtgagcagtgggccaagatcgtgccactgcacatcagcctgggtaacagagcaagactctgtctcaaaaaaaaaaaaaaaggaaaaagaaagaaaaaagaaaaagaaattaacagaagtcaccaaaatcatgttgaaatcataattaaggcaataagcagtttaagcaggcagggttgggaaaattatgttttagattatgcttctctataaaaaatgaattaatttgttcatactgaaactttgtctaacactattgtctgttgcatagctcttggaataaggcagatccacagtagaaaattaaaacgtttcacttctagtacaggtttatggcctgtaccacagagaaagattagaaatggcatcagtatatcaaataagcgtttacaaatgaacaataaaattttgtctccattttttaaagcacagccttttaccttgagaccaatacacaacactctagatgaaataaatcagcattatttacttcagcttgatataatattaattgttatatggctaaacaaaatgggtatttgtatgataatatttagcttaacttactctctggttatgtatataatgaaactagagatgaaagaaaaaatggagtagtcatcatgagcaaataagagaaaagaaagcagacaagaaaagatggaaacaggccagttgcggtgactcacgcctgtaatcccaacactttgggaggccgaggcaggtggaccacctgaggtcgggagtttgagatcagcctggccaatatggtgaaaccccgtctctactaaaaatacaaaaattagccgggccacagtggcatgcgtctataattccagctactcaggaggctgaggcaggagaatcacttgaacctgggaggcagaggttgcagcgagccaaggttatgccactgcactccagcctgggagacagagcaagaccctgtttcaaaaaaaaaaaaaaagaaaagaaaagaaaagagggaaacactattgagcatctactctgctacatgaaccaattcttgggtatccttctccccatcttagagatgaagaagccagactcagagagcctgtgtcacttatccatggttactgaaccagtaagtgatagagtcaggttcggacacaggtatatgtgactccaaagcctgtgaacctgcaagtgcacacaaagaagaatgaatccacagccctcagtagccataccatgacgttaagccactgctaacacatcctcttgctggctaggtaagaaatccaactataagaatatatttccaattactgacaagatattacagttttaaatttaacttaaaatttcattttttctttagtttagcctacagtttatttataagcttctggaagacattaaaatagacttaaacaaatggaaaaacatttcctattcttgaataaaatgactcaatagttcttcacaaataaacttataagttaatacaatcccaatgaaaaatatcaacagactattttatacttgggcatgttgataccaaaatttctgtggaaaatcaaacatgaaagattatccaagaaaacattgaaaaagaaaaactacaatggtatagtagcctcaacaagcattaaaccatactaaaaagtgtctataattaaaacattacaatactagtacatgactagacaaactgaccagtgaattagagtgtccagaaacaaatgcaagtacatacagagacttagtatgtgatacaggtagtatctcaactcactgggggtaaagatagacttcttaataagtggtataggtaccacaaggtagccgtctgaaaaagataaaactagatccctatctcatatcatatatgagaataaaccccaaatggatttggaatctaaatgtcaataaatgaagctatacaagttgctatggtttgaatgtgtccccccaaagttcatgtgtgggaaacttaatcctttatcctcatgaatgaataaatgctggctctgccctcatgaataaattaatgtccctatcatgagagtaggtttgttatcatggctttgttataaaaccaagctttcttgggcttgcttgctctgtcttatcatatgatgcttcccgccatgtcctgatgcagaaggaaggagacttcccagcctctagaaccatgagctaaatcaatctctattctttataaatcacccagtctgtatattggattatagcaacagaaaatgaacgaagacaaaagtaccacaggaaacaaggataactgtggtatagggaaaagctttctacatcaagaatcaaaatgtagagtaaataaaatattggtaacttgaccacataaaactaaactttttttcatggtgtaaaaatttttaaaccaccgtaaacaagtgacaatctgagataaaatattaggaagatatatccatagacaagaggccaatactcctaatattcaaagaacacttgagggacagtagacaagagaccaataaacagaaaattcacaaaaaaaacaagatatataaatggccctcaaatgtgagaaaatgttcaaactcactcataattaaagaaaagcaaattaaagcaagactgagataccacttcttgcttgtcaggctagcaaaaactaaaaagcaagacaacatactttgttggtgagactttgggaaaatagccactttcaaattgataaacccttctgaagagaaacgtagcaatatctaacaagtacttgcctttaactcagcaatctcaactctaaaaatctaccctgaagatacacctctaacaatataaaaatatgaaagaacaaagttattcattgaagcactgtttgtaatagcaaaatattggaaataacctaagtacctggggtgggcagaataatgggacctcagagaagcccatgtctaatcctcagaacctgtgaatgtatctccttacgtggcaaaaaaggactttgtagatctgactcagctcaggattttaagataggaaaagaagagtatcctgtattatccaggcccagtgtaatcacaagggtcctaaaagtgaaagatggaggcaagagagtcagaattagagagaaatgaagatgccatgctgctagcttaaatgtggaggaagggcccatgagccaaggaatgcaggcagcctctagaaactaaaaaaggcaaggaaagaggttttctcctagaccctccagaagaaatgcagcccccctcacatcttgatttttatccattgagaaccatttcaaacttctggccttcagaaatataagataaacaattttatgttgttttaaatcactaagtttgtgataatttgttatagcaatagaaaactaatacagtgtacatacatcatttgaataaattttgatatagctacacaataaaattctatgcaaccatttttttaaatgataaagatctctatgaattgatttggagtggtttccaggatatactgctaaatgaaaaatgcaaagtaaacaatgtatcaatgatatgctacccttcacacatgagagaagggggcataagaaaatactcatatagctattaactgtaccaaatcaatgtaggaaggacaaaccaaagatttatcttggttaagagattaaacacctatagaggaagggtgggaacagggtattataaagaggagggggaatgggaatgagttaatagggagaaagaggaagaacatttcttggagtgtatcttttttgtttgtttaagacggagtctcactctgtcacccaggctggagtgcaatggtgcaatctcgcctcactgcaacttccgcttcccagatccaagcgattctgctgcctcagcctcccaagtagctggtattacaggcacctgccaccacacccagctaatttttgtatttttagtagagacggaggtttcaccatgttgggcaggctggtctcaaattcctgactccaggtgatctgcctacctcggcctcccaaagtggtgggattacaggcatgagctaccgtgaatgtatcttttttatatagctttgactattagaaccatagcaatgtttcatatactcctcagcactataattaattaaaaccaaccagatgtggagagaatataaattataacaaataaatccaactgcattacaagtcaataaactaacactgaaggagccgggagaaactaaccttactaacttaggaaaacaatattttgactggatactgtgaagacaaaaggaacatgcaaataacgtcctctggttatcgaatctgtttctcacaggggtacgtactggcaattctaaaactattttacatgtctactgggattgaagtgaatatagtgtaagtgtcccagtacctgaggaaaaaaaacttatgaatgaagaaaggggaagagctagaatgaaatgtgtcacactggattggaaatagaagtgtcaatatgaacttctggtttagaaaatatacacagataggtagatatagaaataaatacagatgtgtgtctatgcatgggttcatatacatacatgtctttgctaagaggacaatcatcataacagtaagcatacccagagcccaggtcttgatttccaaatatcattctctgacaaaagggaccaggactccatgaagaagtcattaattccaggcctggagcaggaacaatataagataagcctggcatatattgtgatcacagaaaagaagcaggtactcaaaaaaggatgggttctattaaaaagatatagaaagcaaatggaagttggtcaaagtcaaggctgaaacaatctgggccgcaaaataaataatgatggtactagtttataacccatagagtaaaatgtccacgaaaacatattcatataaataattggataaataaacacacaaagaagggacagctcttccaattaacaaatacagatgaaatgaagtaaataaaaaaatcactattaggcaaacctcagagtaataactgttgcatgtaagatctcaccaatgaaagatgaaatcagtgggcaaaagttcaagaagaagcagaatattaacaaagtctcaaagtatctcctcaaagatatttatcaattagaaagaaaaaatagtaactttacagtgtatataaacttgatggatacaaccttaaccaagtgatcaaggttaacaccactagcaataagacatatcaacttcatgtatcctctgatacaatgcaacaaggaagacacaaaagcattttgtggtttaagaaaaataagcaaaaacattcacaatctcaatctaatcatgagaaaatattgaacaaacccaaagtaagaaattctactaaataaatgaccagtatttctcaaaagtacttatcataaaaggcaaggaaagaaagaataactgtcacagatgggaggagattaagaagacatcaattaaatgtgatgggagatcttgggtttgatcctggaacagaaaagggactttaggaaaaaactggtgaaatatcaaaaaaaaaaaaaaaatcagtggttaatagtattataccaatattaatctcctggttttgatcattgtacaatgactttgtaaattgttaatattagagaaagctggataaaggatatacttgaactctccatgttttgcaccttttctgcaaatctaaaattatttcaaaattaaacattttttttaaaaatatggattcacttttattctgaatgtcatgagtttattcaagtctaataatacttcagattgttttccttaatactcaacattaaagacatctatgggggcttttttctctctctctagaaatcctcctcctcctgctgccctaaattcttcattatcttaaggaaccaggtaaagtagaaacaagacatgtagaagtctaaagattttaatagcaaggttacctgaaattctgtttgaaatatggtagggtgactatgtgtctgtctgtgtacatattatcaaaatgtataaagaaggcaaaaacaattattaaagctataggatcatttttaatcattttgcacctgaaaccctacatatagtaggcattctgaaaatgcctcacagaattaataaataataaagcaatccacccccttgcccaagcaatgaagaacaaaaattaatgaaaatttgctctcttcagatttatgaaaataaaattatagcttgaaggaggaaaacaaaaaaaaaagctttctgatggttactggattcattggtctcacttaagtttgtgaacaaatctaaaaactgtgtgtctgccctggagaagtgtctgtcctggacccattgtttgcatggaagggctaggcagccaaggatcagcttggtggcttgacctttctttgccatttatctacctttgtagaaaagtgcctgtggcactaatgacctttattaactgttctactttcacttcctaccatttctggacatcagaatataggaaatattaaaagtattttcattagctccccaagtgactgcagacatattaatatctgccctacattttaagagacttggtggacatttttagtaggctctttaaacgttaaataatgcataatagtatttgcatttagatacagtccttcttactgtaactaagctaacttatttccattcattccagctttgaaagagaaagacacagcaggttgccactcaaactttgaagaccagtaaaggtcaagatgcacttttcaaaggggctgtgtgggcagaacctggtaagcagtttctttatctgagccagttaaagacttagtatgtgacccctaatatttactgtacagtgtctagcttcggtatgcttataaagaatggacctcataccaagacagctggatatccacacgcaaaagagtaaagttggacccttacttcataccatacataaaaattaactcaaaatggacccaagacctaaatttaagagctacaactagaaaacttttagaaaaaaaacacaggagtaaatccatatgaagttggatttggcaatggtttctctgatatgacaccaaaaacaacaaaagaaaaataaactggacttcataaaaattgaaaatgtgtgtgtcaagggacactgtcaagagaaaaaaaaaaacacctgcgaatgggagaatatatttacaaatcttatagccaataaaaatctagtatccataatatgtaaagtactctttttttttttctcatgatgtctcggtttattgctcccctattgggctttcagtttaataaacacgtaggatctctaattacaagtgaagaaaatgaaggttcacaacaaaacacaacacattggagacagttgttaaaatattttctcaaaaaaaaacgactgtccattttgacttgttttgctgccattcaaaatgtataaaaagcctcagcaactaaatgaagactgagtttcaaggaaaacaaaaaaagtagagaagccagcactgcatgtcttaactgaatttttacaaggatttgcaggtttaattctacttgcatacagagcatctttgttttaatctaacggatttcgagaagatcacattgtacgcacttgtggagtttaacgtctaagtagaatatgtctatctcgtaacgtgattttgaaaaatcagaaattacagtccattgaatacatgattatgaggatgcatgcaatcatcttcaaagctgttgccatcagtactcagagcaagttgcctggtatcttgttgagacctcaccttctgcccttcatgtctgtcttgcggtaaatcaagaggcaaaccagaggccagctctcagcaccaaatggtcagtgtcgccccctcatcttctcactgggatctcatcaccaatgtgctcaacccctaagttggcacccacaagagacttccctgcagccctctccagccacaagatgtcacagtcaagcgcttagaaatgcaggacatgttatggagcacgatgctgaggaggaagaccaagacgcaagccaccaagatgacagtgcacaccctcaaccacatggagcttttcaccatgccccgcctgtcctgctcctcctccgccaccccctggggagccctgccttgcagaggctgctgtccagcagggatggtcaccacagtgacggacttctgccggttcctgggcagcaggtggcggctcatatctccgggcagcagcgcgtgctccttggagatgggcaggggcagcatgtagcacccactgccgggaagtctgatgaagaccggcatgtgctccgaagcgtgtggaatggtgatgacagccaggacctcggggtcgtcgaggagctgcgacacggagaagtcagggggcagcttggtgacaccgctgcaccaggggcatcgcacatccttctggctggtcctcgtctgctggaggcaaactgaacagcaggtgtgcttgcaatccagcaacttggccttcactaggggctgcagtaattaaaacagatctgacattctagcagagtcctgggacagcgtctccatggtggaccctgagcaggaagggcaaggccaaggggaaggggagggagctggtcttcagaggccgccgctctgcgtctttccagtgcaggtcatggggagctcagacatccagcactcacaggtgtgttcattttgtcaaaggccagggcgacctcagcgacaggcagctcagagccagcagcggggcacatcttctttcaaaacacccaggaatacaaggccagcagcaatggcaattttcaaagaccatggcttctggaaacagtggttcccaaggaaaacattgcaatatgattatttatcctccaaactgaatctgtcactgaatccctttcactccattctgagcatgatgacatcaagtggaaatggtacgtgtttgggaggcaagagccaggaagcacaattgagactgagctttcttcagcggacctttctccgtggcgtgttcaggtgctggctacagaggccacggacgctacagcttcgcggggtggtcctgggtgcctgcccagctgagccagacatgccctatggccagcggccgccgcgagccacaaaaaaagacacaaaaaagactagaactgacatttcgccaaagcagatatacaaatggccattaagcccacgaaaacatattcaatgttattagccattatggaaattcaactcaaaaccagaatgagatatatttcaaaactaccagatgactagaatttggggggaaaaaaaaagagagagagaaaataagatttggtgacgacataaaaaatggtaacccttacactttacagcgggaatgtaaaaaactgtggccatggtggaaaagagtttggtggttcctcaataagttaagcataaaattaccatatgactccgcaactccattactaggtatatacccaaaagaatggaaaacaactgttcaaacaaaaactggtataagaatgttcacagcagcactatacacaatatccaaaaggtagaaacaacccaaatatccaccaacatatgactaggtaaacaaaatgtggtatatccatacaatggatgatattcagccataaaaaggaatgaggtactgatacatgttacaacatggatgaatcttagaaaggttatgttaattggaggaagccagacacaaaagactgcatattctatgatttcatttacagaaaatgcccaaaataggcaaacccattgaggcagaaagcagatgagtggttgcagaaagcatattagtggttgcaaagggctgaggaaggagaggaggagttggaagtgactggttaacaattacagggtttccttttggagtgatgaagtgttacagaattaaatagtggtgacagttgcacaacactgtacatgtactaaatgtcactgaattgtggtagactttaaaatggtgacgtttatatgatgtgtatttttttcacaagtgaaaaaaattaacttcagaagaatgacttcagatgaggaacatggggagactacggcaggtagtggggacaggaggtatgggcagaaatgagccccagaacgaaaagctaaatacggtgtggatccaggagttaagtcatgcatgtacacccactccctcggtgaacttgtgttggccatgctgcccctttaagaaagacacttccaggttaagtccgctcatacttctagtctctgggccaactcccactcactacctggtctttctccctacaaagattgtgctgctttcttctcctccacctactctacattctggttccttgtcaccaaaagcctctctaaaagcacacactgcactttcttgctttcctcagaacataggacccttcctatttcaagatgttggtacagccttctcctcaaaaaacaagcaagtaaagaaaaaaacagatggggggcacaagtgtgacagatactgggagttataaggatttaagcaacttttaaatgtgctcataatagttatttgctgctttaacttttatgtatttcagaaagcatttattgagcacacactatattttatgttgcaaaaaccatcaggtcacatcactactcctctcaaaaccctttaatggcttcccacgtcactcagaatacatttcaaaacagttgtcctgggtacaaggcttgagcgacctctgacctcatctctatccactctcccccatcctttcagagttctggccataccagcctctttgctgttcttccaactcaccacgagttctcccagctcagtgtctctgcattcactttccttttgcctgaaactcgttccctggctatctgcatggctcactttgtcatttccctcaaggctctgctcaaaggtcaccttctgaggctttcactaactactctaccaaaaatggggtttcccattcacccacccatggtctcccatcatcatcccttaccctgctttttcccctcacagaactcatcaccactaacactctgtgtttgttggtttgttgcatgtgttcccactggagtgtaagttccacaagggaaggattttgttcactattatgtctccccatctaaatattacccagtatagagcaggggctcctcaataaacatttggtgaatgaataaatggcacatctaataagaaaacttttgctttaattactgactttgctgagtgcttacatggggcagatgctgtgtgctaaattcttgtatgtgggacatctcacttaatcctcagagtaaccctacaaagtatcatactccttattattaagctatatactcacatgtgggaaatgagacacaggcaggctaaagcaacctccctacaatcaagaattaagtgggtcttatctaagggacataggaatcaacttgaaagagcttccattagccaaagatgggataacttgagcaaaaagaataatgactacaactgattaaagagtttatagtcacaatatacaaataaacaaaagttatttggtaaattgtggagacttctagggtatcaattcactattctgaaattgctaaataaaaggacagaatcaagcatttattttgtttcctgtacaaactatattccaggataaccaggtagtaaaagttcttaataaatttccacacaacgaatgtcaaaggaatgagagaatatttttaaactgccattttattcaagccctaatgaagtcacagatgtaggcaatgatcatgagtggatggtaaggccggccgatcacaggttgatggggaaacttataatgggtagatcaggtcgatatgactaaaggtaagacaaccagacctcatgagccttgtgatgtgatgtattaggaattacacactgccacctagaaaagattcttgctaaaagaactgaactggagtctcatcaaacctctagatttaccacttcataggaagaatgaaatagaagaatatgctcagaaataccatgaggaggcaatcagccaaatacaaactgtagcacattccatagaacagatgagctggtttcttcaacaaataaatagtacgacaagtagaaagggagggatattctcacaaactgagaaagacttaggagtcataataatcaactatagtaggaaaactttgcttggatccctatttcaaacacaactgtaaaagacacttgtgaagcaactgaaattaggttgcatatgataggaagaaattattgctaatttagctaaatatggttatatctatatctgttagagaatcatatggaaatattacaggtaaatagaaatttgccttaaagtatattccaacaaaaaggggcaaaaaggcaaaggaagatggaatagaagaaaaaagactaccaaaatattggttttaaagtttttttttaaagttttcctctcctctacatgcactttagcaagttagatttgctggtgggtcttagtatttctttctaaattgacaagattatatcttcagttaattgctttcgaaacacctggctgacttattttcttaatatttgcacgtttaaaattttctttttatcatcatgcatatataatttacctaaatataaagttttggggtttttctctcaaaattctgaagatatggctccatagtctgctggcacttagaaaacatttgaagccagaccaattttggctcacaaaacactctagaattctcagttcctaacacaatattgaaagtgtttgttgtcactatcacaccactaccctgttcaagagcctgagttccttgaaagaggggattgtgctgtttaccaaagtatctctagctcctaattcaactggcacgtgatagacactccataaagtgtactaaatgtgtaaatgaatgttgtaatgccaaaggaatacctcccagtatgtgtctggaagtatgtttctttttataattatatttggaacatactgtatcttttacctgcatggtaagatttcacagaaaactaagggagtctatatacattcttccttcattttatccttacgtacactcaggcctttacagacttgtttcttccctcatattctactgacatggttcctcccaggcactgaccttttttaaaggcctttgacttctctgcagcatttgacaccgttgaaaacaccttctttcttcttgaaacactctatgaacagattgccaggccccaggtacctcaactacagctcattaagaaattcagatgggaaatttcttttttattatttttcttttttttttgagacaaggtctcactctgtcacccaggttgtagtgtagtggcataatcacagctcactgcaaccctgacccccccaggctcaagcaatcctcccacctcagactcctgaatagctggaactataggcacacatcacattgcccagctaatatatatgtaatatagtctataatatatattacatatattagatattatattacctgttatatattatatatagtaatatatgtaatatgtatgtgtaatacacaatatatgtaatatgtaatatatatgtatttatttcatctattatatatgacatatattgtatataccatatgcacacatcacattgcccagctaatatatatgtataatatataatatatattatatatgtaatatagtctatattataatatatattacatatattatatattacatgtaataatatatattatatatagtaatagatgtaatatgtataatacataatatatgtaatatgtaatatatatgtatttatatgtgtcatatagtatatatacactatatgtcatatattatatataatatatattagatattagctgggcaatgtgatgtgtacctatagtattatatataatatattatcattaataacatataatacataatgtaataatatataacatattataaaacataatatattatatattaacatataatatataacatattataaaatatattatatattataacataatatataacatattataaaatataatatatattattaacatataatatataacatataaatatatattattaacatatatgttaatatgtttatataatacaatataatatatattacttattatattatacagtaatataatatattatttattatattatattatattaatatatttacattatatataatataattatatattttatatatatatatatatatatatacacacaggggggggagagagggagagacagagagagagagagagaaagagacagagttttgtcacgttgcccgggctggtcccaaactcctgggcttaagtgatcctcctcccaagtagcacgagccaccacgcctgactcatctttcgtgttgttttgtagagatggggtttcaccgtattgaccaggattataggcgtgagctaccccacccagcctatacatattaatattaaataactgtattttttggtttatagctatgcctcattttcttaacaccaaagtctaacaacagatataaaggtcaaagtctagatctcatgcatttttaaaaaacctttagtttgttgcttgaacacaataaacaacaaataaacatctatttactgcccagctaatctttacattgaccaaaagtgctttgcctacatagcactgcagcacagcatggacctatagaatatgttcttccctcattctcaaaatgcttttccagccactcaggtgacataaaattagtttaggtgtgcctcctagtggcattttaaggaagtattcatttttagaggagtttttagatgagtttaccactcatccaccatcctaacacaggctagaaagaaactgaagtttgttgataatctgaaaatatcattataactagtagcatgaatcctctccatcacaatttgaaccaaagtcgtaagttaaaaaaagaaaaccttttgatttgaggcctttcataaatttggttaaccagactccagtgattgatttaatttcgtttcctgattggcttactattaattgaaaacttgcttggtttctatctccattatagattatattaaatcactgacaatcaccaattataattatgtagcatcacagaaaaagaagggaaaaaatgtttctcaccccaggccattacattgcattacagtcccctagagagattaaaataacaactctgtgaaggtctgaggtgggacccaaacattcaaaaggccctagatgaatcaaatgtgcagccaggattgggagcctgaccagtggtataagagatggggttgaatcatgagtggtcttttcccccaaaagaaaaaaacaataacacaaaattactgagctgtgatttatctttgtttttaatcaaaaaataaagaactaaaaaaactccagtaggataagattttatttattaggctttactctaataaacgttttgctttatttcttctatttatccttctcatgaggtgccattaaatttaaaaatagccaaaagactaaatcacaggctaaagatgttatttagacatggtatttcaatcagaatcttttttaaaacttcatctttgaagaccctaaaaagacaacatcttctagcccagtagtcaagtccatgccattttcagggtccttttcaaccctagggacttctgggacatgaggtcaattccagcccagccttagctatttgggttcactcaatacatagggaggagaacccccagggagcttcaggaatattgtcataacagaattcttaagcttagtgggagattcgctggtgttcatcttattatactccataacttacatttgatataaatatactctgtggtatatatcaaatacttcatactcttaaaaaaggaaagaacagctcaaaaccctagaatgatgctggaagtttaattccttcaagtgggacacattcaaggaacaaaccaatcttccgaaactattgtagatgaggatgtttctctctaggctgccccagggaggatcagaactcaagtatctctagagttagaacactggttcaaccatgtgggtctatattcccctgttcatcctttcttgaaattaagaaataaataataaagtgtatcttgatcaacaagaaaaacctagtcaccttaagcaacatatgttaggagaatcaatccaccatgggacaagtcttcctgcacgatcttgctgggtaggatgaggtcacaggccctgactgctctttagctgggccatttcccagagttgtgtttgcagtaagcaaccctgagggatgaggtaccatctccttccagtcaaagagcagacttgctcatcactcatgatgaaaatgatagagtccacaagctcaatgtacctcagctatgtcacaaacccaaagcatccatcccagcatccaacgaggctctccttcatctcctttatgggacttggagtgcgtgccgctttctgtgctacgagtaataaagtcttctgccagcatccatgaaataataacaggctaatttattacagcagtcccctcttatccacagttttatttttcacagtttgagttacccatggtcaacctcagtctgaaaatattaaatggaaaatttcagaaataaacaattcataatttttaaattacccatcattctgagtaatgtgataaaatctcccaccattcctgctgggacatgaatcatccccttgtctagtgtagccaagctgtccacactacctgcctgttagttacctaatagccatcacagttatcagatcagctgccacaatatcacagtggctggtgtgcaggtaacccttgttttacttaaccatagccccaaagtagaagagtagtgatgctggcaatttggatataccaaagagaagcaataaagtgcttcctttaagtgaaagagtggaagttctcaatatgaaaaaaaaaatcatatgccaaggttattaagatctacagtacgatattttaagaaggagagaacatacacaaaacttttattatagtatactgttacaattactctatttttattagtaattattgttaatctgttactgtggctaatttataaattaaactttatcataggtatgtatgtactgggaaaaccatagtatacataggcttcagtacaatccatggtttcaggtatccactggggatcttggaccatatcccccacagataaggaagactaccgttgtttgcaagtagcataaaatcccagacactttacatgccctgatagttttggtggcaaatgtgagatgctcatagaaatatttgactttctggaaaaggagggacaagggccctggttggctgggttacaggacgtgagaagattcccagagatctggtagtaaatgctcttgcctagatggtggtgaggatgggaaagtggaataagggttcctcactgtcctatgtgttaaatgtggttgaacaacaaaaggtagggttgaaacaaggtgtcctaatggtgctttggctgtgtcatactcccttctggggtgggagaagggaggatgttatcaatgacaatggggcagcaagctccacgatccagccaaaaaacaaggcgacgtggcgatggctgctgaatctaggggtccccagagctgaaataaatggtgttaacaatgagggtagagaactgtgggtagactaaaagcgtcagaaacttgtctgttgagcccagtggcagaggtcacttgaaataaagtaaatacaaagccttgcttactggcactgagtggctctctccctccagtccccaatcctcccctgcctctcctccaactccctctgctttagggaagtatgctggggaacttcagggcagggaaggactcaaaattttatggctctgttggactggacacgagtgccaaagtctacttggtctcagggaaggcaagtatgctaagcactggggtggcccagagctccaaagactgcaaggccatgcagtggctccagcaaaggctgaaataatgatggctctgagtggccattctctccagaggccagagaacacaggacaggaagcagcacccattctgggacgaggagccaaaggacaaaaagccctccctgcccctctcccctagctggagacagcataatctcttgaaactattacgaccacccttgaagtacctatgttaaactcttttgtctctgttcttttattgttattgttttggttttttgagatagggtctcgctctgtcaaccaggctggagtacagtggtatgatcacagctcactgcagccttgaccttcctgggctcaagcaatcctcccacctcagcgtcctgtgtagctgggactatagttgtgtaacaccatgcctggctaattttttaaattttttaaatggagatgaagtctcactatgttgcccagggtggtcttgaattcttgggctcaagcaatcatcctgccatggtctcccagtgtgctgggattacaggtgtgagtcatcatgcttgatcacatgtatattgtgactaggtgggggaaagtaactgaattcaactgatagagtgtaagcaaacttcacaatgagtaaaaaaaaattaaagggacctttatagccaattcaagatactgtgatgtgtgtcaacactctccctacccactacatacaaatgtacaatgacattgatgtattacatgcttgtattataaaactcacagtgaccaaaacagactccccagtcagggattcccagaccccttctaggtggtctaatagaaacatagaagcccagggaggaaaagaaaatcactatgaagctccagtgaggccactgcccagtgcagcagcaccacctgcttggcacaggcaccaaatacatcctgtattagtttgctggggctgccataacaaaggaccacaaactggacggcttaagcaacagaaatttattgtctctgttctgaaggggagaaatctaaaatcaaggtgtctgcaaggtttgttccttactaaggctgtgagagaagcatctgttccaggccccttccttggcttgtaaacagctgtcttcatattcacattgtatggtcccggtatgcatagtccagtatgaattgtatggtcttgtatccaaatttcttcttctcataaagccatcagtcacactgaattggggcccattctaacgacctcattttaacttgattacctctgtaaagaccctatctccaaacaagatcacattctgaagtactataggttaaggcttcaacatatgaatttggagacaggagacacatttcaacccataacacacccctttcaaaaaggggacgcaatcgttggtctgctgctgagctcttgttaaaaatgaacccatggaggcttgtaactcccaggtctgacatctccattttggggtgggtcaaccaggacacaacaactacgaggagagtagctcccaccctctccccctgccacaacccaccccttgctcatggcccactgtaaaagcagtaggctccctaagctcaacgctgctcaactgtgacacaaatccactgagtgcatagcactcatttcgcccgtgcccatctttgtcacctcggtgagttttggaggacatggggaattaacaccaccacgctcatgctgtttgctgtgctgtgagtaataaagtcctctgactctgatgtagttgtctccagtcttctgtaataggctaacacgttagcttgcaagtagggtaaaatcccagacccttcacagaccctgacttcatggggaccaacataagagtaaaaaccctgtagtttccaaaggtctttgacaaggacgtgctaagcatcggatagctggctgatttgtaaacctaatacttggtctcgcctaggtcactgctctgttacaataattcagttgtccattctttcaattgtttcattgtccccaaagagatatttattctgcataagacactcttgtcagtcattaaaaacaataatagtaacaacagcaacaaatatttatgaggtgagaagcatttttctaaaaacttgaggcattgttctatatatttcatctttaatctttaaaacatccctttgaaggggatattattacctccagtgtacagatcaggagactgaggcacaagtcacacagttagtcaagggtgggactgggattcaaactcaggcagtctggctttagtcttcatttttaaccactagctacatgccttaccagaggactttctactcccagagccataatgggccacagaggcctagacatctttgtctgaaatcttaggaaaataattcgggtcaaacttttaagacttgattttttgacttgcaacattttaaaatgttttttacaacctgtattaggcaattagataatcttctgcagtgctttgatcttttctatccagccacgtctaaatccaatgttaaggtttcacactccatgttagtttcctattgctgcagtaacaaattatacgaagtctgtggcttaaaacaacaccaatctattatcttacagttctaagttcagaagtccaaaatgggctggcaggactgcatccctgtagaggctctaaagaataatctgtttccgtgccttttccagcctctaggggcttcctgaattccttgactcatgatccttaaacaatcttcaaagccagcagtgtagcatcttcaaatctctcttatactgactctcatgcttccttctttctcttataaagacccttgtgggccaggcacacatacctgtaattccagcaatttgggaggctgaggccagtagatcatttgaggccaggagttcgagaccagcctggccaacatggtgaaaccttgtctctattaaaaatacaaaaattagccgggagtggtggtgcatgcctgcaatcccagctactagggaggctgaggcacaagaatcgcttgaacccaggaggcagaggttgcagtgagcccagatcataccactgcactccaggctgggcaacacagtgagactctctcaaaaaaaaaaaaaaaaaaaaaaagacagacccttgtgatgacaatgagtccatctgcataatccaggataatctccccatctcaaacattatctttgggggtggggggcattattctatgtaccacatactctaagcagttatctcttcctacagaatggaaatttttacacaaatttatctggattggagatttaaattagcccattcaccagataattagtaagccattttatcttggttttaaggatgcagcccaaagaacattttattgttgggagtcaaagagaatgtacggctggagtacatgtggtagaaactttaagcattgtaacaacataatagcttaattattttaaaacatacctgaagtcgagcattcataagcatgaactccttttgatttttcatgctttcattcatagattttgaaaatataaaccccattttgacctaaaatgtaaaaaaagcaaggagacttataataatacactacatgcattcttgtatgctccactttgagctaccttgggcttatgacaaagtaaaaaaaaaaagtaaaatttctgatctaggaacacagtgtggattctagttcttgctcctaactagctgcctgacctcaggcatacttaacgagtctggccatcattttactcacctaacaccaactgattgaactagataatttccaaaatccttccctgctctataagtatatggctgtttcctgatttttcttcccaccataaatcttgaagaactgaattcttgaagaaaaaaacaactctctttttttgtgaggggaagggtggataccatccatcttcttacctctgtacaattaggcaacagaacctttgcatctgaggagggatgattaagaagatgccttgtgcgtcttaagaacatatttctttgtgctctttgcatttgcgttttaagaagattgagctctccctctccctccccctccccctccctctttctacggtctccctctcttgcggagcctggactgtaccgccatgatctcggctcgctgcaacctccctgcctctggctccggtgattctcctgtctcggcctgccgagtgccagggattccaggcacgcgccaccactcctgactggtttttgtatttttggtggagacggggttttgccgtgttgactgggctggtctcgagctcctggcctcgggtgatctgcccgcctcggcctcccgaggtgctgggattgcagacggagtctcgctcattcagtgctcaatgttgcccaggctggagtgcagtggcgtgatctcggctggctacaacctccacctcccagccgcctgccttggcctcccaaagtgctaagattacagcctctgcccgcccgccactccgtctaggaagtgagcagcgtctctgcctggccgccctgtctgggaggtgaggagcatctctgcccggccgccaccccgtctaggaagtgaggagcgtctctgcctggccgcccatcgtctgggatgtgaggagggcctctgcccggccgccccgtctgggaggaagtgaggagcgcctctgcccagccaccccgtctgggaagaagtgaggagcgcttctgcctggccgccccctctgggaagtgaggagtgcctctgcccggccgccaccccgtctaggaagtgaggagcatctctgcctggccgcccatcgtctgggatgtgaggagcccctctgcctggccaccccgtctaggaagtaaggagtgtctctgcctgaccgcccgttgtctgggatgtgaggagcatctcttcctgaccgcccatcgtctggggtgtgaggagcatctctgcctgaccgtccaccgtctgggatgtgaggagcgcctctgcctggctgccccatctgggaagtgaggagtgcctctgcccggccgccaccccgtctaggaagcaaggagcgactctgcctgaccacccatcgtctgggatgtgaggagcgcctttgcccggccgccccgtctgggatgtgaggagtgcctctgcccggctgccccgtctgggaagtgaggagcgtctctgcctgagcgcccatcgtctgggatgtgaggagcgccttggcccggccgccccgtctgggatgtgaggagtgcctctgcccggctgccccgtctgggaagtgaggagcgtctctgcctgagcacccatcgtctgggatgtgaggagcgcctttgcccggctgccccgtctgggatgtgaggagtgcctctgcctggctgccccgtctgggaagtgaggagcgtctctgcctgagcgcccatcatctgggatgtgaggagcgcctttgcccggccgccccgtctgggatgtgaggagcgcctctgcccggctgccccatctgggaattgaggagcacctctgcccggccgccccgtctgggaggaagtgaggagcgcctctgcccggctgccccgtctgggaggaagtgaggagcgcctctgccccgttgccccaaatgggaagtgaggagcgcctctgcccggccgccccatctgggaagtgaggagtgcctctgcccggctgccaccctgtctgggaggtcaggggcgtctctgccccgccgccaccccgtctgggaagtgaggagcgcctctgcccggccgccaccccgtctgggaggtgaggggtgtctctgcccagccatcccgcctgggaagtgaggggcgcctctgcccggccgcccttcgtctgggaggtggggagcgcctctgcccggccgccccgtctgggaagtgggcgcctctgcctggccaccccgtctgggaggtgaggagcacctctgcccggccgccccatttgggaggtgaggggcgtctctgcctggccgccaccccgtctgggaagtgaggagcacctctgcccggccgccgccccgtctgggaggtgaggggtgtctctgcccggctgccccgcctgggaagtgaggggcacctctgcccggctgctctttgtctgggaggtggggagcgcctctgcccagccgccccgtctgggaagtgggcgcctctgcctggccgccccctctgggaggtggggagcgcctctgcctggccacccatcatctgggatgtgaggagcaccgctgcccggccgccaccccgtctgggaagtgaggtgtgcctctgcctggccgctccgtctgggaagtgaggagcgcctctgcccggccgccctgtctgggaagtgaggtgtgcctctgcctggccgccccatctgggaagtgtacccaacagctccgaagagacagcgaccatcgagaacgggccatgatgacgatggcggttttgtcgaaaagaaaagggggaaatgtggggaaaagaaagagagatcagattgttactgtgtctgtgtagaaagaagtagacataggagactccattttgttctgtactaagaaaaattcttctgccttgggatgctgttaatctataaccttacccccaaccccctgctctctgaaacatgtgctgtgtcaactcagggttaaatggattaagggtggtgcaagatgtgctttgttaaacagatgcttgaagacagcatgctcgttaagagtcaccaccactccctaatctcaagtacccagggacacaaacagggccaaaggccgcagggacctctgcctaggaaaaccagagacctttgttcttgtgtttatctgctgaccttctctccactattatcctatgaccctgccacatccccctctctaagaaacacccaagaatgatcaataaatactaaaaaaaaaaaaaaaaagaagaagattgagctgtctcaaggtcagtagaccagttattcttcctgtcatcccaccacaatccctgtccctctcctacatgccccttatttccatccacccactgctaactgccttagccatcctcctccagcttcactctcattctctccaagatagcatgtactaaagttctcaaaaatggaaaaacatacagatacttgaatgtcctggaaaatgtactttttagatgaatgcacagtagtgtctatcttatgtaagtttttaagtgggctgtcaactctacaagggacagaactccaatttttattcttaatccaactgggtgggtacagaagaccttgagttagttggttgcatttcagaatactgcaaaactcaggggaaagttacaactgctctacccttctcaacaatgttgctgataccttttctctttaataggctgttgagtagggttgtgaacctcaggtaagaatggccagtcttaattcattacagccaggattcccaagtattctgtgggaagcccagctaatggggttccaggtgagtgggagctgcaagcaagacttcagtgacttccttgtattctgatcaaggatacacctggagtttcagggctctgtgccagagtcagcttcaaagctgagcacaggataccaaaccacttaccaggatgaagaggcacaatgctgaaaaggcctgaggtggtgagatttccctccccttctgccactgtgccactcgagcaccctgtgaccagagttagaggccactcactgacagcagggtgatttggcagttctttcctttctccaaaccctaacagtcccatgcgactcatctctaacagcagaccagaacctgcctgaggttaggagcgagatattatccatcttgatagtctccatggtgtctacttcccctaaatatttgcacaaagcatgagagatacaagaaaaactgtggctcaggccacttgccattacttatttttcttctgaacataggagtggatgactaaatttttacacctgctgcaaacatttataaagaaaacaactgtactctagtactattcctccacataccctgtatatcacagagctgtgtgctttcaagtgctcctgtttgtaaggggttaggatctcccctgaaaagagagagtcctcatgtcaatcatctgggaaagaaacactgtctgggaagttagtatttagatttacctctttctgggccttgctctcctgggtctggacttgtagtctgaatgtgttagaggacgctcccaggtggaagggttaaaggtggaagccaagcaggaagaagagcttccttatgggaaaccacacctgagaataaataaatgcatcacaccttgtaaatttcaccctggagttcagtattttcaacattctttcctttcccaacttccccattcctggcaaagtcatttcccaaagtctgggaatattccgtagggtgtccagaacactttcagctatctcctcttgctcacaaaatatgtatcagaaaataagcaaaattgaccttgcaatagggataactttgatttcactcacttgtataagttaagtcttttaaaaattctaacacttttcaccaggggtaaaaaaaaatgtcttgctacttatacaattttaaacatcactgtgtctcagagtgatgttttgcagagaatgctgatttcaatccctctgtcttcattttccctttgattccttctgagatcttggaaggggtctttaatgcttcagccctgcctcaggtgagctatagattactatgggaaggtgtatttctggggaggagaagtggtgcctgcaagttccagacaacctttcttccggtcacccgtgagtacctagatttgattttacttggggggacataaaaaattaattgcatgaattctgtcatcgggattaccacgctgacttatttcccgatcagatgacacattgcctgaatgtatgactgatcgtctcaccacagtcattttcaatatttgcatcccattgaaattaagccacatccccttgcaaattccagcccagagcccacagcttccggaggttttctgtaattaacaccgcccttgctccctgaggccagttactgtaatttaggtattccccgcaatagtgtgctgatttctgttgagagcactgtgcctgtttttctcaactctattttaaagctacggagagatccggagtccacgccaggcgacaagaacgcgctctaatggaacgaagttggcaatacctatcagcaccaggggcagtgcgagagccaagagccggcgctcacgaggagcgggcgcccagcgctgcctggcaagcccggagcccaggagatcgcgctgactgacatggccgggctgacccttctccccacccgcctgcggccggtgttcactcactgggcggcgctggtgccgggaccaggcgaccggtacgcaaacctccaggcccgggctcctttcgcccgctgcagggaccgggcctcgctccgcccagcgtcgggattggcgcccagacacagtagatgacgcacctcagccaattcgcgcagccctcagcttctttaaagagccggcacttccgccagaagccgggtgtgtccttccgggccaggctcagtgttaccagaggtgggaggggaaggtcaaaagaggcaaattcaaagccgcggcgactcagctgccagatttttgagatgaggcagaggaagcggagtggaattctcaattaaaggcctctgtcccctcatctgttaaattggcactattaaaaagtcataaagataagacagaaacgagaaagaagagaattgactgaaattacccattcttttttgaacagagccgtctttctcccctgctgctcagagagatgtcggtctcgcctcaacctcaccagcaatttctatcttgaataagccacgtctctctcccagcctgagagaatgcttgaattgttggcactctgttctttgctaccaaatggcttggaaaaatagcatgaacgtcaccagtctctggccttcaggaaagtccctgctaaccaccacagcggtggagaaggcgtctaactttctccaggctcagcgtgtgagtgcacaccgccctgacctcctgggcgcgtcttgatgctctcaacagcagccctcaggattctggactgtgggtcccacattccagataccatttgtggaatggctggatgagaaaattgcaacagcaccctcatttccagttaagggaatgggcgggttaccaggaggtttgacactcttgaagggaggttaacaactgatgcaagaagtaaggaatcgtgtttgagtgcacagactctagcataaacacacctaccttcaatttctagctctgtcactgtcactctgaatttatcacctctgcaacaggactaaagccatctaatttattggattgtgaggactaaaagataatatatgtgggcatttagcacagtgtcgggcacatagttcgccttccgtaaccagtagtaaccagtaacagcggggagctgttagtaactatagggctgaggggtgggggaaggaagcagttactaaaaccaggcgagagcgagagcggtagctgtggctgtacgagagagtaaccaactggaaccgtgtcgttcagtagaggaaagcaagcaatgccaacttttcaccaagtaaggtgagattctatagttgtagccagtgctgagacgtcagcccaaagcagggacagagtggagaagacccacctctctgttctcccagctctgatatccagctggggtcttccgctggctggatccaccaggaagccagaagacagtggagctaggtctgtgtagtctgtagaggtcagcctactaggcacaatgcctggagggagaaatagaaaatatccagcacaccatttcttttttttgtttgtttttacactttaagctctagggtacatgtgcacaacgtgcaggtttgttacctatgtatacatgtgccgtgttggtgtgttgcacccattaagttgtcatttacattaggtgtatctcctaatgctatccctcccccctccccccaccccacaacaggccccggtgtgtgatgtcccccttcctgtgtccaagtgttctcattgttcaattcccacctatgagtgagaacatgcggtgtttggttttttgtccttgcgatagtttgctgagaatgatggtttccagcttcatccacgtccctacaaaggacatgaactcatcattttttatggctgcatagtattccagcacaccatttctacaaccttgggtttattgtgtttggaagcctagatccaaaggaaggaatgctgccactagaagaccccgtcactgaattgaattgaatttcaattcattgattcgaaagctgaaactgccctctggtcactttgattcctcacagtgacagaatggtatgattcatcccaaataccaaaaggaaattgggttacatctatatattgagggcaagaagaactatgcatgacacctggagattcactgggcacttcttaatactgccgtgtgccataataatgattatcagataactgaagtaatgcagaaatttcagatcatgaagaaattaaagtgttgaagcataccagataaaaaaatcctgatctacctaggtgttggcatagggcaggggaaacatacataagtaaatgagtaggaagctatgattattaattttagccttgcaacaagctctagaggcaggaattatagtagctctccatttaaaatgttaattacttcttccctgactctcttttcctattaccctgcataaagagtagtggtggagataaatattacaatttagtttctgggtgagaatgtgcctgaactgacatcccctcaaggcaatatggcagctgatgaggcttgttaaggaaaatcaaagctggacaatagctgtagcagtaaaaatagatttttattcagcaacttttgaaatagggggaaagagaccttggtaaagaactgggctcaattctgaatacagtaaggataagtggggatttatagccgaggagcaggttgtgtggatgggggtggggtccgtggatggaaaattactaagaagagacagcaagggtaggggaaatccttgctaaactgacctaacaggattcttgctaaaggtaggccagggtaagcagacatcacctgggggctggtgggggtaaggaatttgatcagatattgagagtggtcaaacattcagggtgggaagatcctctctaaactgacttagcaggattcttgccaacactgattctgcaaggatgaacactgcagcccaaggtcaatatctaatcaaggagatggcttagaggagcctgactaaagtttggtcgaggagaaatcttgtcagactctgtcattctcatatgtaagggatgagctgctcttcatctgagcaaaggaaaagaataaattctgggtgacaaaacaattagactgtctaggttttctgtttgccttccatcatattcattctcctcacttccctgccctgttctataccccaaagctgacctctttggacggcaccacctgggctctcctcagctggtttccatttgagtttggacagcgggaggcattcagggagatgggaggcaggaggaaaaagacatcagggtatattttctctgttctttctctgtttggggctgagtatctggtggtggttgtgtttctccacaattgcagctcttggcaagcagtcccttctccatggctccagctccatgggctctggaaacacttttctcctttgctatgtagcctagagagagcgcagtcttcctgctgttgctagactctggatgactcaactggatggttctcttagtcatactcctttaagtagtgtcttcactaatatctctttaatcaaaccaactgagtaaaattctgattcctgatggatacatgttaaaccgaaaacacacattataaattttcttgtatgtatgatgtttttcataattttaaaacataagtgaaaaaagtgaccatagaaaaatatgcccaggaaattgaaaaaaaaagtcttggtatagatattggacacattttataaaatgtggagtaagagggttaaaggaaatttatttcagaatcaaatggcatataactttaactggtatgtgaattattttcagttgtatgaatttgtgaatatatatgtgtacatttttatgcatatatataaatatgtgttttatatcatcttgcattataacataaggatttttatgttgctacattgcatttatatttaccatttttaacagctaaaggattttcaataagtgtgtatgtaacaacttccattgctggatatttctcagtatatatatgtatatatacatatgtgtgtatacatatatatatacatatgtgtatatatacatatgtatgtatatgtatatgtacgtatgtatgtgtatatatacatacatgtgtgtatacgcatatatacatatgtgtatatatacacgtatatacatgtgtgtatatatacacgtatatacgtgtgtatatacacacgtatatacatgtgtgtatatacatgtgtgtatatacacacgtatatacgtgtgtatatacacacgtatatacatgtgtgtatatacacacgtatatacatgtgtgtatatatacgtgtgtatatatataaacacatatatatatgcacatgcatatgtatacactgagttaagtagtataaatattttagagaaaattgatgtaaaatcctcaactcatttgatgctccctatcccaggacagtaaaaattgcccaatatttccttggacctccataaagaagcagtttttcaaaaaataaagtgtttggaagtttaagatgtgcctagcagtgtctccttttaacagagatgctttcacaaggatttgaatttccccattgagctgggaaccaggtttagccaagaacttcggtctgtgaaggactgcaaatagttgcacagtgtggggctgaggctagaacctccttaatattaaaccattctgggatggtgctccccaaattctggattttaaccttcactccaatcctggggcacctctgtagcttgggcatgacctggacacaagctttgtgtaagccttctttggacttcatccattcctcaacggtgacaccatgtggcagtgtaatataatggcatcagtggactcagatcctgttctctccctacctagagatttttaagattaagatatgtaattcacaaccataaaatgtaccaccttaaattgtacaatttattggtttttcatacattcaaaaagttgtacaaccaccaccattatctaattccataacattttcttcaccctagaaagaaacctcatacctattagcagccactccccaaactccccattctccccattcccccagtttctggggacccctaacctactttttgtttttatagatttgcctattctggacattttatataaatggaagcctacaatctatggccttttgtgtctggctccttttacttagtatgatcaaggttcatccaagttgtagcatgtaccagtacttcatttctttttatgtctgattaatgttccaatgtatggatataccacattttgtttatccattcaaaattgtggggcatttggattgttcccattttttttgctgtcataaataatgctgctaagtttttgtatgaacgtatgttttcaattctcttgggtatatatgtaaaagcagaattgctgggtcatatggtaactctgcatttaactttttggagttgaacaaatacaccatgccagcagtgaataaggatgctgatttcactatacctttgcacaatagttaagagcataaacactggaaccagatgtctgggttcgaatcccagctgtgctatctcctagctgtgtcgtttagacaagttactaaagctctgtgcctcagtgtccacatctctaaaatagaggcaataatagtaccttccttacaggattgttgtaagatttaaatgagctaatatgtgtaaatcacaaaaatagggtctgacattttttaaatggtatatgttttaccattgctgctattttaatctttattataattattgtgttttgttttgttaatttgatagctttaaaaggtaatgatacagtttattgatgtttgttatgaaaaggagtaattggagaagataaaaatgtaaggggtaataaagtcaaggaaggttttttgagctgaaaatgattatatttcagagtgtaacctgaataaaactgaggcttcacatggctcagtccatgcatgtaatagcattctaagaaaacataaactgaatgaaaacgtaaactgtgaagcatgaagaataatgagggtcttcaccttatgctttctgaaggagtccccgcaaatgcttcacacagcatattgaacaagaaactcctaaaatcttctctagatatttctctctttcctattttttcccactgacagtagcaccttatatctatcctcctcaactgcgaggtcactacagcactatactaagcccctgttaacttccttctcttgaaacccatgcaactcacatgatcctattctcagcctgtgaatctcagcctcctgcaatcctgtgaaattcaacttggtctcctactctgaatgtgtataaaaataacagagaacagttcctgaactctgatgagtaaaatgatctaccttattacatgtggtattataataaataaatatacattaatttctttccccattttccagcacacagctcctaaaagacttgtaacttcctgagtgataggtatgctaggtaaattttttgttctatgtgaccttcgactccagttcttgacacagagctcctgatcccttggaatttccatagtgataggagcatctttcattctcctgaagtaacttggtgggcttctggatgggagctggtcacaagaatgaccaagccatgattagaagcttggaactttcacctcctacctcatcctgtgaaaaggggagaggggctgaagattgaggtaacaattgctgatgtgtacatgatgaagtccccataaaaatccctaaatgaggggatttggagaggttctggaggtgctgaacgtggaggtgcttggagggtggcctatccagttcatctccagagttcacacactcacctaagtgctgatgcccacctgatggcatttctcagcctccgaggctttccttctttgtacttagtcaaaagaatgctctaatccagtctatcattgatgggcatttgggttggttccaagtctttgctattgtgaatagtgccgcaacaaacatacgtgtgcatgtgtctttatagtagcatgatttataatcctttgggtatatacccagtaatgagatcgctgggtcaaatggtatttctagttctagatccttgaggaattaccacactgtcttccacaatgcttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttgtctgatggccagtgatgatgagcattttttcatgtgtctgttggctacataaatgtcctcttttgagaaatgtctgttcatatccttcgcccactttgtgatgggattgtttttctcttgtaaatttgtttgagttctttgtagattctggatattagccctttgtcagatgagtagatagattaaggaaatatggcacatatacaccatggaatactatgcagccataaaaaaggatgagttcatgttctttgtaaggacatggatgaagctggaaaccatcattctcagcaaactattgcaaaaacaaaaaaccaaacaccgcgtgttctcactcataggtgggaattgaataatgagaacacttggacacatggtggggaacatcacacactggaacctgtcgtggggttgggggaggggggagggaaagcattaggagatatacctaatgtaaatgacgagttaatgggtgcagcacaccaacatggcacatgtatacatatgtaacaaacctgtacgttgtgcacatgcaccctagaacttaaagtataataaaaaaaaagaattctctaatccatggaataagtgttgaataatgaaattctgatattgtgtttaatgatatactgcactattcagaatatttgtacttaccttcgagtctctcttctaaaagatgccaaacccccttacacgaagtagaaaacgtcaaatatctaaatattgtatcttaataatgttcaaacattaaatgtttcaaatattccaatgtttagaatcataaaaaaaaaacataagaattgttttaaaaaaatgctctaaacttaacccacagcccttcttgtgaatttctccaaaataactggagcctggttaatagcaagcctcaggagcatggctttgaaatactgtcaacatactgccaccaatttctccatttccagaaaagactgtaattttttctttagaaatcatgattttcttgattggtttagactggtttccagtagttcacttaccaggaaagtttctgttttgtttttagacttccttaatttagagaatgcacataatattgaaactggctatagtatcctactctggaaaagcatattaaatacatacaaatatatatttaatgtatataaatacaaatatatatgtaatgtatataaatatatacaaatatatgtgtgtgtgagtatgtatcttccttgatttccttttatccattaccactaatatccctcaataagtcctactggttctacttccaaattatattttgaacatgctctacagaaacagctcctaaagattttccagcctccatgaatgtaagtcccctccatattccattcttcgtaccacagctagagtggtatttttagaacattcatcaggcaactaccctgctctaagccatctggtggcttttcattgcaagtagaatgcaacctctcccctagtcctcaaggctcttcatgatatgatttgaccctcccatccctcttcctcactctctacccacaattctcttcttttcatccttggaacttgccaagcttgttccacccgtatagtctttgtacctgtctcttcccatggccaaatatgctcttttggcagatctttccatggttatcttcatgattcatttctcagatatcacctcttacacatttcctgaccaccataactaaaggaacctcacacctgtgcactataccatattgctctgacttgtcttcttttttcttgtataggacttttcggtatctgaaatttttatttattaatttctgtttggaacatatctctctcagagcagaaaggtcttgctgtcctttcaaggaaatggtggggaaaagaaaaattctcattcttttatgatgagcctacaaaaataaatgggttaaatgggttcttgatccagttcaccttaagtgtggttaccaaaggaaatgattcacaaggtgactatttcatttgtgtgacactcacttatgttattagttctaggatattaaatcaagaaatattttctaggatcccctgaaagagtatctctcaattgtaaactttatctttagtggcattttgttgatttattgagattccctagatttaaaatatttaccacagagtgttccccaactcccacagcatttatccaggccataactacttatgtctggatttatgaacttattgtgggtgggggaaattgttggaggtctcatctttgttttaaagtacctgtggcatggggtctgccctttgaaggcaagagctcttcacctgcccagctcttccccagcttaggacaggaaggagagagacacagtgtgagcgagagaagcatctgattgtgagtgtcagatgaggacagctgctactctctggtcacccatacatgttaattacccctgtcatttaaaccattgttttgtgtaactagaacaaagtattctttccacgaagtctgtttgacacgagacacatataggatgtgagtctatgacaagggtaggggcaacaaatgtgaggggttggatggaaacagaggaagagaaatgagcattgcatagggcagtggtttaaaaccctacatgatcaaaaatagaacctggagacaaatcttgatattgtctttatacataataaaatgcattttaaaatattcgatgcaaacaaagcagtttgtcatgtcttttgttttgagtctctttagtatatgctgcttttgaagatcaagaacatttact

SEQ ID NO: 332 - DNA, 124806 bp, Homo sapiens
gataattttaatttggagaatgactgtgggccatgctgctgggaagcacagaacaaatcctactggcaccagcttaatccttttccacacctgacagactctagggaattgttactatcacatgaaaaaaaaaagagaacttgctcagcattgactattccaagctaccatcttggaagagactgcagtggaaaggagtttaagttcttgctatagattgaatgtttgtgtcccattccccctcccactccccctccacaaatccttatgttaaaatcctaacccccaatgtgatggtattaggaggtggggcctttgggagacgattagttcatgggggaggagctctcatgaatgggattaatgccttttaaaagaggcctcagaaagctctctcactcatttccaccctgagagaacagtgagaagacagctgtccatgaaccagaatgtggaccctcactggatactgaatctgcctgaaccctgatcctagactacccagcctacataactgtgaggcataaatttctgttgtttaaggcacccagtctattttttatagcaatccgaacagattaaggtgattctgtttattaaatatttcatttacataaagttttaaaatttcaattacaaagaaaagatcctgcaattaagccaaaatatgaactattgttccgttccaaaagacacattttgctttcactagaagcgccttccccagtgcataattaggtgtggctgccttcctttcactggaaagcagtctaggaaatgttcaatccaaatatagtatgcctttaaaattttatttagaggaactaagtcaatatgtaacattctttatttaaggtctacttatattctaaaattagtttcaaatgttttaaaaggtaggttcaaaagttatacatgtttattgtttataaacagaaatggaaaatataggagagcctcaagaaataaaaattacccataatcctactaacctctgagaattctggcataattctttccagtcttgttttgtacatatagatacttaaatacacagttttacaaaattgagattaaacttcactttccttatcatataaaaaataagactagctaacatttgttaagcacaacagtaccaggcactagcctatgtgttttacatgtatcaattcttttaatgcttgcttctccagcatctaataggtacatactattattaccctaattttacagatacaaaatctgaaatttgaagaagttaagtatttgcccgaggtcacaaagccaggggagctacctacactcttaatcactacaccgtctctcttaccttccaggattatgttaaggatcaaggaaaagacaactagcaagagtgctttgtaaatcataatatgccaaatacaatcttaactatagttctgcaaaaataggaatgatattaaattgagagtcataacttggagttgccctgacaccagagtctagagaacacctaaatgaaccagagaagagggcagaaaaggcatcccttggggaagaaagaagatctggtgtactaaagaactctgctgtggaataaaagaataagaattagggtttacttgatagcttctaacaaagggtgtcaagaagtgcaaaacaccaaagaatatcccagcagttaagggcatggacatcattctgcctggttttgaattctggctctgccatgtgaccatgtggcaagctatctgacctttctgtgactctgtgttctcacctgtgaaaatggaaataataattgtacccatcagccaggcgtggcagatcacacctgtaatcccagcactttgggaggccaaggctggtggatcacctgaggtcaggagttcaagaccagcctggccaacatggtgaaactccatctctacaaaaaaacaaacaaacaaaaaattagccgggcttgatgtaaggtgcctgggtgcctgtaatcccaactacttgggaggcagaggtgggggaattgcttgaacccaggaggtggaggttgcagtgagccgagatcccgccattgcactccagcctgggtgacagagcgagactccatcacaaaaaagaaaaaaaagaaaaaaaaacacgcatgtattcacatacacaaatcagcaaagagcagagagggcgccttatctactctcttcatcgacaacataactgcaacaagaatcctgaaaagcttccagaacaatgcagagagtaatgggaaaatgaggtaggctaccttagaaatttaaggggtctgtacaaatagtgaataaaggaaatctatcatagacaggaaaagactagtgggcagtagaataatattccacaccagggtggagttctgtggcagatatccttcttcccttccttggataaaagcattataagacttggagtgggagttctgacaggaagaataaagtgattattaaaggaggtggggaggtactctacataaaatatgcttggttcttagcccagggcttttcaagaaaatgtctgaattataaaatataaaacatatgagtatatataacatatatgtgtggagtttaaagaaatgaaagaaagacctgtgcagccaccaccaagcttaagagaacaatgtcagtatctctgacagcccatgtactatctggctactccttgtccatatcactctcttgtcccaaaagaaaccattgtcccaattttgtgttcaccactcctttattataactattgtacatacagtataccctaaatgatatctggtttagttttatctggtattgaacctttattttttttcactcaacattatgtttttgagattcatccccattgataattatagctgtggtttattcatttcagtgacagagtatatcattatatgaacatagcacaatttatgtaaacatactactgttaaaagacatttgggaagtttccagttttgggccatcagaagtaaaaatgctatccacattccaatccatctttcttttttttttttttttttttttttgagacagagtctcactctgttaccaggctggagtgcagtggcacaatctcggctcactgcaacctctgactcccaggttcaagcaattcttctgccccagcctcccaagtagctggaattacaggcatgcaccaccacgccagctaacttttgtatttttagtagagacggggttggtcaggcaggtctcaaactcccgacctcaggtgatccacccacctcagcctcccaaagtgctgggattacaggcgtgagccaccacgcccagccccaatccacttttctaataggtgtgtaggagtttctctaggggtactgacttaggagtggaattgctgggccacaggtaatgcccaccttcaattataatagattacaacaaaccattttcaaaatggttgtaacacggatattgctaccatctccacgttcctcaccaacacttattctcactgtggattttttagcttgtagttcattgagttctaatgaagttgaatatcttttcctatatcttttagctgtttcctcttctgtgaaattattttttgaccaatttttaatggctaatctttttattttttattcattggagtattttatttattctaggtactacaaatcatttgttggttatttgtgttggaatcatattctcccacttaatgacttacgttttccttttgatgaacagaggttctttttttttttttttttttttttttttttgagacagggtctcattctgtcactctgtcacccaggctgagtgaagtgttgtgatcacagctcacagcaggcttaacctccccagctcaagcaatcctcccacctcagcctctagagtacctgggaccacaggtgcatgccatcacacccgactaattttttgtattttttgtagagacggggtttcaccatgttgcccaggctggtctcaaaatcctggactcaaatgatctacctacctcagcctcccaaagagctgggactacaggtgtgagccactgcgcctggcctaggttcttcattttaaagaagtcgaatttatccatttttttcttaaggtttatacttgtggtatactaacaaatcctttcccagcataaggtaatgaagatactgccctatttttttttttctaaaagtgttgtgagcttttactttcatattgtctttaatccatctgaagttgactttttactggtatgagacagagatccaatttcataatttctatttagatatccaattgtcccagcttaattttttttaagttcttcctttccccactgaccagcaatgccaattgtcatttaccgagtttccatatatgtgtggatctgttctagggttttctattctgtatcacaggtctatgtttttcaaccctgttctgatacccacattgtcttaattactatagttttataatgagtcttgaaatctggcagagcaagtccatccaccttgtttctcttctgcctaatcttggccctttgtgctttcatataaacttcagaattacttttatcaagttctactgaaaaatcttgctgaaattttcatggaaattgcattaaattgaccaatagggataactgatatgtctataatatgtcaacctaggcttgaacacagtacttttctcccatttatttagatccatgttggcttttgataaaatttttaaattttctccatgaagtttgaccacttttgctgtgtatacatagagatagagctctttctctttatatacatagcaaaagcaacatattcttaggaagctcatattttgctgttactgttaatataactggatttttttaataattactttttctatttttttttattattttttaaagacagggtccttgttggccaggctggagcacagtggcgtgatcacagctaactgcagccctcagctgctgggctcaagccatcctcccattttttagcctcctgaatagctgagactagagtagctgggattacaggcaccagccagtgcgcctgtgccttgtttgttatcaatgtagaaaaatgcaattgattttagtatcctacactcagtgaacttgccaacactcctaatttttataatttacttgtagactgttttgagttttctgcataggttattatatcacactgagacttttggtttttcctttcctatatttattccttttatttcttctccttgtcatattacactggctagaatttccagtgcagtgctgagtagaagcatagcaggcaccccactctggtttctggctttaaaggaaatgtttattttaaatttgactgttgctatgatgttaagtaaaagttttctgtagatactctatcaggttaaggacactttttcctaacactagttccctaagtgcttcttatcattattagaagctgaatttagttgaatgctttttctgcatcattgttaggaaaatacatcttttataatctgtgaatgcaaaaaaaactatacacatttttctaatattgataaaatcttgcattcttagaataaggccagtaacccaggacttttcacttggagagtcagaagaagctagatgataccagaatagaaactgtctactttaaaccgtatagtgccagtcctacttgtttacctcaaaaccctgcctcctccatgacatcactgctgactcatccatgccttctctgagcttttagagtatgtaccattgatgatgttcatttgacactttgcatgtgctgttctatacatgacctatctaccaactagaatataagcccctcaaaaaacagcaacaaataagcacacaataaatccttgcttaaaatgcttaaaatatccttgtggatgagatggtgaaacatgagttgggtaataatacagcattctcagaaaatgagacttgtggacatatgagttttctggagaactgctgttttaatctcctaacactgaaactttaaaatcattctaaattgtacttccctgctttgttaaccgagtattctggccatgcttaatacacttcttgattttaactttttcttgttaaggacagtcaattatgaggaatatcagttatggtgttgtggtagagatgtagctgtagatacacaatgtgtgggatgcaaaacctcagctgtgaccctgaacaaggctttaactggaaaaagaaaaaaaaaaaaaggcaggcattcttcccctttggcattgacctctaactctcagcagtgatttatacttttcttcctctgctctcctacccttctctggcttcttttaccccagagttacacaatgcagagctgtaagactgatacatttttagcagtggatactgtgaaaagttgccatttctccagattatgactttctagcttgtttttccactatgtaccatctttttctctagatctcattactgcttctaatctctagagaggacacagcatagtgtagcaaagagaaccttctggagccagggtacctggattcaaatcccagtttggcacttattgaaagccctaacaacaaattatttaacctcagtattcctcagtttcctctcccataccacgagaatatataccaacttcacatgattgttatgagaattaatgagttaatatttacaaagtgcttagaacctggcctaccacatagtaagcattacataggtgttatttaaaaaatggataaaatactatcaacttgaactccatcactctcttatctctctgcctcttaaaactgctccagtgtttctcgttttggttgtgttgtgctagtggagataggcgaggagcggagggtctgacattactgagggatcccagtgccccttcccactggtcagagcctcaatgagacacaggaaaagggaaggagagtgtcagatatattcatcactgctccgttagccatgcgaaggtgaagaaaatagggatgtttatttaaccagcataacaggaatccagggacatgtgtaactgctgttttcaaatatgcgcagggctgggcaggagaagagataatagcatttagaattctatgcaacagctacaggctccccttcactgaacatgtttaagcagggtactggtggccaggtgtcaaggatgctaaagaaagaatttttagtcagataatctttaagatttcttctacctctaaaatcttggtaatcctagtatgagtcacgaagtggttacaacctagatgtgagtcacacatcgccaacgcgctcccgaaggcacagaattcactccccacagtgcttggcatcttaccacagacctaagtgaggaattctagccctgaagctgcatataacccagctcagagaaacaaaaactttcctaaaactcagggcgtcggttagctgattggcaaatacagtaacgcacacatcccaaacgggacttggcaaaacggtgtgcatctggattaactgtcatacagtctccacgtcactcttccacgaggccggacagaagcgggcagaagtgagcagcagcaggttcaggggaaggggtagggtggccgggatgaatgggaggccagcgaactgacctacggcggggagggacaaaggatcagggagcgcacgctgggcggggaggccgggaggaataccccaggcggaggagccgggctcgggaccaggctgcgaactggtgacaaagtcggttatcgtggagggccctaagtaccagcgaggggccccgcgggggtcctctctgcctcgggagctgggctcaaccactcgccccgcggagggggcatcgcccggccgggggcacccgggagccgcagacccgaggcaggtactgggggcaaaggcccaggccggcacccccgccccgcagcctcccctgctgccgagtccactcaaccctgccgccggagtttggattatccagtctctcgccgcccgggccgaggcccgtcccggagccccacacaggcggtccgacaagaacgccgcagtgccggcgcggaaagtggggcagcggctgcctcccgtccggtcgtgcgagcggcggccgccatcgcgggccgcggcgggaaggagaagaggggccgcgccaggcgccactttacctgagaaaccagcgggagtagcgtctgctccaccgagcgagttttgatctccagtcccgagtcgagggcgaagcccgaagagccggagccgtagactgctccggcgccgccaacgccggcgggtccgggagaggcggccatggccctcggtctatcccgcagccgggactccgcgccgcggcgagcctgccgccagtcagcccacccgcccgaggcggcggcgacaggacactcgcgccaaccgagaccccgcccccaggggcccgcccccccagggctccgccgccaaccctgcgtccccgacgcccgtcaccgtatgtccccgcccacccccggcctctgccccgcccgcgcagtccagcctggtgtgggctccctgcaaccccaccccctaagccgggtcccgcccccacatggccccgcccttatctcttctcagaccccttccatgggttccaggcaccttctcgccagggtggcgaggagaaacaaaacacatctgtcacacagccacatggcctcctcttacttggacagacaagcgtccccagcaaagcttcccgtcctctcgataggtgactcgtcctaaatcagctctgaattcccgcaaagacttctggaagctgtgctggggttgaaactggtagaccaaaaccagaatcaagtctgttgggaggggcctttcccctgggacgggaattccagtggtaatgtcttcctggggcttctccggaaggtccaatttccactccaccctgctcattctttcaccatgtatttctcacaaacactttgagctggattgaaggggaaacatttgataatgcaatcattaatggagtatctgggtattcggcaggaagtcagtatatctttcacactactgtttagacttattcaaaagaaatttaaaagaaacatgaaaaagcctcatctactgttcaacactacttcttaaaactatttttcgaagttttttcctagtgccaggcacagagcagtttcttcataactgttcattgcatgaaaacaccaagtgtgtatttctgacaactcacttgaggggaagggtaagaatcagttctgtaagcacaactctgagctcgcacagagccccacgatgggggcggggagctgaagactcctattctaaggtctccaggagcaaggccaaaaggaggttgtcagcagtatgcacgccgtgaaggaattccagacttaagcaacagactgagaagcatgaaaaaatgttttgtcaactaccatatctgccagtgagaacctgtcagagtaaaaaagaatctgaggctggccagtccacccggacaccttggcctggatcatttcttcttccataacaccagattgatgagctgggtacatcaacctgaggcataagaaagctctttcccaagcaccgttgaaaggcgcttcacagtgcttcaacctgtagcttcagcttcatcaatctaccagtgctgcacagctgtctttggtattgaagatagccaagcttcagcttctttttcttcattcaaaaaggacaggtcctcaatccaactttttcttccaattcttctcagccaaccatctcaccacttccttacctatcacaaggccaccttcccctgtgcactgagggcccttgacctctttaaggcgcccagtgtccacttcctggacacaccttcccttacgaagttgacagtatctcctaagaattcagtgtacacaatggtgccggaggaaatggcataacagaaggcctaagagacggatggattcatgaaactttggcttcacaaaagatcaagtttttcaacacacaggagattaagtttaccacatgattcattcaacactagtaattttatttcaaaatataaatatttcacattaataaagaagttacatcagtaggttgtcaaagcaagttagctaagaaacagcatttgtgtgagaacagagggtatttattgtattcgaatattcttttttacttttgaattgcctccttcacctgagaacccagggatgatacattttcaaagagttatgtaagcaattacaactctatatcaaatcttagttcaaaatcaaattgtactggaaatacacttcagttacctaaataagtggcactgcaaagggcaaagaagggttttctttgggatggctacaatgagagttacatctgctgggtctctgcaataaaaaataaatgatatttgataataagccaaaattatcaggatttgcttccatacttttcactgtaaaataaaaagctagcaaaaagctagtaagaaaccagatgtctagtaaagaactctggacttggagtcagaagttctgcaactaaattctggctccatcattttgtggtataaacttaggggaatatcaccaaaaacttttcagagcctccagagcccccccatctgtacaataaggataatattgtctgtctcacagggctgttacaaaaggtgtctgaaaactataaagtgccatacaaaagcattattaaaatgtaatatcaatatatcaccactgtatttgcacattagttgatccttgaaaaacctgcaaaattaaacacaatactgattttacacaccacaggtggaaaagaatctctataccttaagtatagctctaaacagcaaatatacttgctttctggacttcaagatttattacacactacatggtaccacagtaatagatctgccattcagtatttccattagggatgtcttctcaaagagttgtaaacttgatcaagggccatgtttctcaaaggaccctgtagtcctttgagatgctctgaggaataaagaaggggagtgcagtctaaggtcaaacagtgtttgtccccttttataaattcacaatgtgtaatagcatgttcaaaactcttagaagtcctacagtaaggaaacaaactcagcattccttcattttaattgaccatgcaatcccccacccccaacacacacacactttttttcttacatctattaacatctcttggaactactgctatatggaacacattttgccaaaagctgctcaaccatgaagaaaaggaaagagaagtagaacaacggactgacagaaaaaaaagaactctattctattctgaattctgttactaactggctgtatgtgtatgtcagacaagccacttaaacctatgaatttgggtctttctctagaaagtgacaggaccacctaattttagaagtcccattctagcacagaatttctgactctagtagacagaacaacttgatttataattctcttaaactatcaaaaataaccaaacagtggctgcagacagcatgtgtgtttttttttttttttttttttgcaggttcccaataatcggtaagttaataaaatgaatatattttgatggcagaatgttgaaagacaagaaactaataaaaagtacttgtttttagctggaactagcatttggaagtaatgctagccagaggctatttccactgtgaaatgcacactcaaagtcctattgtaatattattttaagggtcttaggaggcccctcagaggagactgcaaggtcagggctagagtatgagaagtcctaagggtttttgtattttgtttttttttcctataaaccctgaggttgaaagctctggatagctcacctaaattactttcctctaatctaacccctcacagcctgaatttctgagtattgcttgaccagtagtgacacattcctgaggcactaatataacccaaatggaaactacaggtcctaggaaatccagataggtcacaatgggttcatgtgaagatcaaggtgagccagaagatctcatctgcaagccatttagcagccctttaactgtaaaaagcagttccactttcaaaggctacagagtttgtttacatacaaggtctccatgtaacatgttggatttcttcccactgtcatgggccaacccacactagactcagaagtcaagggaaagctctgccagctaaacacttcttatcaaagagggtgtgaagaaaccttgcaattttaacaataactaagaccagcatgtaaggtggtcttacagagatcacttgcaggaacagatattgataggaacttcagaactcaaacagcactcacataacatggaatttatgctgaaaatcccatgccttctctctcagaaaagagaggagcatacctgtgtggagagcttgtattttctcccctcccatccattcggtttacaactgaatagcgaatgtgaacttgaaactaatctttaataaatctataaaatgcaagatattatgaccaagttctgtactccgtttttactgaaatgacttctacttcatcaacgtacggtctgttcctgaagaaacttcctctttctgggtcaaattctgactgagaatgtaaaggtaggttatctttgagacttgagcttaaaactcctaccttttcataccacttgatctctgttgccctgtgaaaattctgtaaaccttcctcattgcatctgaggaatcatgctggaatgcttctttctggctcggagggttccaagacctccccagctagtggaccttcctagtccttatgccgttgctgtagcaatggggcaggtcaagtttcctgatcatagctgtgaagcactctggggcacctctgctcctggtatttcagggtgatattacatcactgctgctaattttggtagctctaaagtattctcttaaagacctctaagaacctgatatttatgctaataattacccagcaagaaacattagctgtagttttttgcaatatcactttatacagctaaaatcactttgtatatgtatagtaactcattgtatatatttgtctcttatgaatatgtgctaattacatctataaatcaaccagtatataattaacaaaaacaaatgattttttagccttttaatgcaaaaaatttaaatttagtattacatatgatctggctaagagcaagaggccttcttatgagtgatctccatcaccctgtacagtgcctggcacagaatctagagtttagccaactctcaacaaatgttttagtgaatgaatgaatgattgactaaagaaaaacatgagttacttagtgaccaaatctaatactcagtggaatagctgattataatcgctaaaatattcataatagaaataaagagatctgtatgcagtctactccatatagtcaaaagatctcatggtagccttttctaaatgaaatttttcttaagtagtgtaagaataaatttaaactaattataattatcagtgacttcttagggagatgttttaggaaaaattattaatatttctacctttaaatactttccaaaaaggaaatcttcaacgcttaagaactaccccccaacacttttttttttccttgggacagtgtctcactctctcacccaggctggagtgcagtggcgccatcttggctcactgcagcctcgacctcctggactcaggtgatcctcatacatcagcctcctgagtagctcagactatagccacaccaccgtgcccagctaatttttttttttttttttttttttttgtagagatggggttttgccatgttgcctaggctgatctcaaatccctgggctcaagcaatccacccacctcagccttccaaagtgctgggattacagatgtgagccaccacctacagcctggccaagaacccttttctctcccacattcccctgggagcagaggataggcctgatgattgttttaaacagtagaaagggttcagctaagaactacagtccactctcagccctgtcatgtactataggacaagtcttcattcacaacaaatggatagcaacaccaatctcgtaacactgggaaaactgcatacaatatttagaaggaacactaatacagcagaatctgcacacaacggagtcaaagatctgaggccaaatcctactacactttacgactttgagttggtcacttttctgaaccttagcttctccatcagtgtaaaactgatgtaaaataatataaagctatatgaaagctgatgtgatgtacttgtgaaatagtatgtgcaaaaggactttgtaaaatgtaaagcactatgctggttattgtgatatctgagatatttttaaagttgcaattcaattcaacaagcattcatttagagtcatgtgcaaggcactgtgctaagagatgggaaaatactacataaatacaaaattctgctgaaaactaacttattggcagagttccaaataatgaaacggatacatttaacaaatcagagtattgctacacctgagatttttcacttcaaccacctggaaggagaaaacctaataacagcatgaattttatcatactgttaccattcatagcagcttaataagtatttcacttcaacgtggtcagccaagttttataatttggcaatagtgtaaagaagcgtgaagagaaaaggaagaggaggaagagcttcagtctttgtatctcccagggttataatataaaactgaacatcaaataagccaccccacccttatacttatgatttattatttcttaaagagcgtataatacattgtgggagaagggtagaagattcatttttcctgctcactcaactacacactcaaaagtgaaagccctcttccttgaaaagtgactgtcttagaaaagtttaacaatacatttcttaaaccaggaaaaaattacaccatctattcttttaacagcaggtagtttagagttcttaaaataactttataaatatataatatagtaacatagataaccaaagtggaaaaatttcaagccagggtaccagtgtataaaatgaaacttttcaagccatcttaacaacagttaagtgagcaaaccaccaactctgaactctcaagctgtgttttaaaatacaaagcagcccgcagcaagttctctcttgtccaggcattctgtatgtaaggccaggaggcttctgcttctttcctgggttttgcttgctaggcacagctggaagggcagagggccacagctgagctgaactcgctgtcaaatttgaacttcctagaaaaatcactgcagaggaaaccacatcaacctactgaagatttcagatcttcagaaatgtcacggaaagtcctaaaagaaaaaaagacggaatgattagttgattaccataaaacagtatcctatttttacaatcttttggagccctaatgagattatatagtcactattttttcttaagattttcattgagtattgtttcaaagtctgctagttgttgctcattctcattaacaagaactccatctttttgctggatctatccaaaggactgtttccccagactcccctgaaactacacatgaccacgtgactacgctttggttaatgagatttaagtagaagtgttgtgcaacttctgggcagttccttaaaagagaagagcaatcttcttcagctcttccaccttgttactggctggaagtggatatgatgattgatgttaaagaggaaaaaccactaagagaccaaagattaaatgctaagtggatacattttattacaaaatagaaatcgtaatccaacagagagtccaagctctaagggatgtggttcagtgcaggaaaaatgggttaggtcttttcatcaagtgaccttgtacttgaactgtttctgacccacattaaacaagctaagcgaacaatgttattggcgggtaatatctgggctggatgaaggtggctgagcaccgtgcctgactgctgcatacatgaagtgtctatctcagtactgtagtagctagcttgcttttgctacataatttacatgtctgagctgagataaatcacctggctaaatttacatctgtgctggcagccaaatggccaggtcagaatttatcaatgaacatgagctcaagcacccatattagacaaaaatgcctcacaccaaggctggcagtacatcaggatggagagaggctgggaccagatgtttatgcaacagtgatacagatataaagcacagtctattaccattcttttagatagaagttatattgctcctttacaataagtccacatattagaaatacagaaaaatatttgactttacagttggttttttgtttgtttgtttgttttgttttgttttgttttttgagacaaggtctcactctgttgcccaggctggagtatactggtgctatctcagctcactgcaacctctgcctcccaggctcaagccatcctcccacctcagcctcctgagtagctgggactacagggaacatgacaccacatccggctaatttttatacttttgggaggctaaggtgggaggatcacctgagcccaagaggttgaggctgcagtgagcctaggtcatgccactccaggccagcctgggcaacaaaatgagaccctgcaccaccaccaccacccccccaaaaaaagcaaggaagggagggaggaagggaaggaggaataaattgaagtacaatataaagtaagtgttccaaaacctaaggaacagctcacagtagtagaaactaaagataacaaaaagcttttattaggtacaatcacctaaaaactcataaaataaacaatctgaacttcaaatgtaattccacaatcatgccccctcccttactccttttctctcctctcaattcatataaatatttaggaggcccataggcaaggcagagatcaattaaagactaaccttgcagcactcaatgaggaaagtacttcagtgtcaagaggggaacaggtaaaatgtcacagaaaagaaattacctttaaggatgttcagttatctcaaggctctttcaaggatggtgccctaagcctctggatctctgaagcacgcctctactagcacagctctactttgaaaaactgttagtctcctggctatggctcctgaggctttgagagggtttatgtgtgacatgaatacaccaaccatttttaaagatgctggctgatctaataattgaaatgaattttctttccttaaagacttttatgttctgaaaacaagtccaaaggtgaagatttgtatacgcacatgtatgtttatatgcattatctatctatctatctatctatctatctatctatctatctcaaatcagtgtttctcaatcttgaaatttttctgcattataagatgttttgcagcatccccggcctctattcaactagaatgccaatcaaaatgactccagacatgagaaattgtctggggagaaaaaaatcacccccacactcctgtcagaactaaagctctagatagctatttttcacagtctcacccaagtttgtgtttttacatttgtctacaggccaagctggctgctgtctcagacaatatgaatttcaggtagcacttaattctgaaaagccctggaaaatctttgcaagcaatagtcaaaaactggctaatactacaaagcattttctaatacccaacggggttccctgacatcttttcaaatttctcagatacctgtaattttatatctattaactattcatttcctctaaattatgaatgaagatttcagcctcagggcaaagacacattaaataagattaaggctatggttagcctagtcactgctctctgttgacaagtgagcttagctgtaaccttgaaattcctaactactattcaattttgtctccaggccaagaaagtctccaaaaggactcaggaaaacaaacaaacaaaacaaagaaaaccaacaacctgaagcaagcttagagatcagttactaagagtctttcatctcaatgttctctctaggtatgtagggtgttagggtgattgatggagggggaggtgtgtgtatctacagaactctactgaagtaacactgatcttgaacaaacctctaattatctccaggaaaacaatatctatagtctagagatgcagaaattatttggtttttggcttattccagaggcatagctctaactaataagtaaagctcataaaactataactctctacgttagaaacaaatactgtattgacactattttctgaaaatgtttaacatcctacttaaaccatctaaatacagtattctttctcaaattataaggattattatgctgcaaggaatcacagtatagaatttctcgtctaagaataagcaatgtggccaggcgcggtggctcatgcctgtaatcccagcactttgggaggccgaggcaggtggatcacgaggtcaggagatcgagaccatcctggctaacatggtgaaaccccgtccccactaaaaatacaaagaaaattagccgggcgtggtcgcgggcgcctgtagtcccagctactcgggaggctgaggcaggagaatggcgtgaacctgggaggtggagcttgcagtgagcccagatcgcgccactgcactccagcctaggcgacagagtgagactctgtttccaaaaaaaaaaaaaaaaagaataagcaatgcagaatgggaccacatgtgactgtggtcacatgggactagaggactgttaacattttacacctcctttcagagcaacagggattgtgcagtgtagtctctcactgttccttgctctttgaaaatattttgggatctgcttgccccaaactttcaatgagatctttacaaattcatttcaccccctaccctcttccctccatgtaaatatgtaaatcatttatgatttaacaactcaagacttgttgacttccagcctcctagacaggcagagttaagttatggatgcctgaaagttgtaactaactaatttaacttacttagctggctccccagcactgagtgtgtatttcctacaccggcaccagcatacaatcctgtgacagagcacatgcaaccactattatacataccccctcccttccaacaaatttggaataaagttctaaggctaggatttactatgtcccatcgtcttttatcagcctcaaggttgtattctgcttttggtttcactaatccacaaattcaccaaatcttcacctagcacttactatgcgccaagcaccatgttaggagtggtaaaacagtggtaaagttagatatagctcccaccttcaaaaagcttaccaactaatgggaaaaaacaatgaattaaacacacatctataaaacgcgtattaagttccaacagaagtgtaagataccacagggacacagcaaggacttcttacctagttcagagtttcagtaatgtttctcacaaaaagggtactttgagtatacaccatgatactggacttggctaggagggaagtggtgttctttacagaggggacaacactgcaaagatgacactgccttctggtaactaaaacaagttcaatacagctgaaaaataaaatgcaaggcacacagcacagagatgaatctggagaagtagagagaagaaaggcatgagaagtctgacagggcaaattaatgtgttagctttatcttgaaggccatgggaagccactgtgggaattttaagcagcagcagaatagaatatttatgtttcagaaaaatcagagaagctatactatgaagaacagactagagggaggccagactggaggcaggaaccagtaaagaggctgctgaagaaatcctggcagtgggtcacaccactgggagtaaagaggatgagcagattcaggaaattttcaagtaacagaaagtaaatcaaatgtactcccttcccagccccagtttactctcttttctcaatcttctaaagtggaatgacagcaagtgcaccccaagtgaaattcttagggttagtgtaaagatctgcagaagcggggatggtttatggggagtatctttatacttcattttgcagagacccagagatggggtttcaccatgttgctcaggctggcctcgaattcctggactcaaacgatcgcctgccttggcctaccaaagtgctgggattacaggcatgagccactgtgcccagcggatactcatttttgattgtactttcggtatttaattatgaaagatataaacctcaggttaagaaagcgtgtacaaaaacagccacaagttactcaatcttccctagagaaagataaagctgagttcctaaaggaccacattccagttgtcaccttcctctcaaggtgtaacagagggcaaaggaaaactacaatatggagaatagcatccctgaaagagttcctgggacatatgccttacaggattttctgggctttaatattcagagactgctgctcaatttttagtagaagtgaaagaagtctatcaaagcaagtctgattatcctgtccaaaaatccagaaagtatgcatgactacaggggtgtttttgcctttccctacacatcccatctccctaaacaagcccactattaatagagaacagaggaagtgaaaggttctgattattcagcagaggccaaaatagttgggagcccaaagctgtgctgtatccactacattctcactatcaacagtgagcagcagagaaggtcttccttcctacaatctttccttagggagaatgggcattcatctgtgtgaagatagtagtctaacaagtttttttgcagtgtggaattaagaggtatgtctgcttaataaaatgcaaccatctattctctactgtcacactgtaacaatatacaaattcctagaaaaagccaagccctttcagagctcatgcttctgtagatactattccctcacagcccattcattccttccactaggaattgagcattctgagtacaaaatactgttgacagaggttgacatcagtaattaaaatagacttggtcctggcagtaacagcaactatagtcaagttgggatgggggagagagaaaaataatcaagtgtataaatgaaaactgcactacaaaaaaaaaagtacaaggtgcaaactataaacacattaaactggcaaggaggccataacctaatcttgggggtaggaaacgcttctctgatgaactgacatttgaactgagatctgaatagttaggagttcgttaagaaggaaaaatgggggattatccagatggaggattatccagatagagaaagcagcgtgcacaaaggcccagagtttcaatggcacctggtgtatctgaggcctgatggaaagccagtgcggctgcacctcggacagcaaaggccatgaaagaaaaaaaaaagaactaagaggcaaaagcaacaaattctaagaaggtggaaagcgggtgggactgctatgacctggcatacgtgatagagtttggctgtctgtcccctgcaaatcttatgttaaaatgtgatccctaatgttgaaggtgaggcctagtgggaggtgtttgggccacaggagcagatccctcatgaatggtttggtgccctccccaacaatgataaatgagtttttgctctattccttcaggtgagagcagtttgtttagaagagcctgtcatctcttgcttcctctctctctctccatgtgacacacctgctccccctttgccttccaccatgattggaagtttcctggggcctcaccagaagcaggtgctggcagtatacttcttgtagagtctgaagagccatgagccaaaataaacctcttttctttatataaattatctagcctcaggaattcctttatagcaatgaaaaacagactaacacaagaccctaaaaagctggatcttaaaccagtagtgagaaaggccaggaaacattctgatttattcagcgaaatcccccataaggtttaggaactggtgacatcaagtaactccggaagtagggtgggagatgggggtaaacacaggactgctttacagtttccttaaagagcagtaagacaacaccctctgatatcctcaccccacctcccaccccagccaagcagctgactccaccctctcccctccttggcagaaaactagaggtttttttcccctctggagaaggtaaaacaaaaagcgtctgaactagtgcacaacaggcagaaatgagggtgggcatccatcccaacactgggagattaagtggatgtttacatcttgaaggctgtccagaccttttcctcctcctggctcccaggaggctggcagccaggcttttagtctctagccaggagattagaagctctttctttgaggaatatacaagcccaaaaaggggaccaaaatcactgacattaagggctggacaaagcagtggccctgccacatcatattatggtaacacatatcacaatccaccacagcttctgagtgtctcactcttttttttttgagacagagtctcgctctgttgcccaggctgcagtgcagtggtgcaatgtgcaatggtgcaatctctgctcactgcaacgtccacctcctgggttcaagtgattctcctgcctcagtctcccgagtagctgggattacaggctcatgccaccatgcctaatttttgtattcttagtagagacagtgttttaccatgttggccaggctggtcttgaactcctgacctcaggtgatctacccacctcgacctcccaaagtgctgggattacaggcgtgacccaccgcacccggccatgtctcattcttaacatgagccaacagccaaacaccttcaatacctgatattgtggttctgttaatacaggttagtgtcccttatctgaaatgcttgggaccagaagtgactcacatcttttttgcactttggaatatttacattatactaaccccaaatccaagaatctaaaatccaaaatgctggccgggcacagtggctcatgcctgtaatcccagcactttgggaggctgaggagggcagatcacctgaggtcaggagttcgagaccagcctggccaacatggtgaaatcccatctctactaaaaatacaaaaattagccgggcgtagtggcatgaacctacctgtaatccccgctactcgggaagctgtggcgggagaatcatttgaatccgggtggcagaggttgcagtgagccaagatcatgccactgcactccagcctgggtgacaagagtgacactccatctcaaaaaaaaaaaaaaaatccaaaatgctccaacgaacactttctttgagcatcatgttcccattcaaaaaatttctgattctggagagtttccgatttgggatttgggatgctcaacatgtatggcaaaggtggatggattttacagatataatgaatgtccctcattagctgacttaaaaaaaaaagagattatgctgggtgggctgggtctaatcaggcgagctcttcttttaaaaagtctaggggtcagagaccaaagttagaaaaatactctcccgctggccttaaagaagcaaaaacccaaattatcagctgcctatgaagagaggcagcctctaggagccatgagcctcagttatacaactacaaggaaatgaattatgccaacaacaggactgcttgaaagagaaccccaatccacagatgaaaccccaactctgactgcagattttcaggtcctaagcagaggacccaaccaagttttgcctgaactcccgacccacagaagctgtatcgtaaatgtacgttaagctgctaaatgtgtaatctgttacatgtcatacaaaatataaacctgtacgctaaaaaggtacattttactctaaggaaataatacctcaataaaggaaactgaaaaaaatgtgcaagtagaaatggaaacctctatagtaaagctacaagataaagttgaagaaatcacccagaaaatggagccaaaaagacacaagtgaaaaaagagagaaaggatgtaaaatgtgaaatgcccagtccatgagggtcaaagtcaaaataaaataaatttctgaaagaagaaaaggaaatcatgaaacaactcaagaaaaatgtcagaacaccagaacacaagttttcacttttaaaggtcttagcaagtgcccatcaggacagaaaccgtagataaacaaaaagatcttatatgtcttcaaacagtcaaattaacaagaataaataataaaaattgcttcagacttttaacaacaatcctagaagccagaaaacaatgaagaaataaatgttaaagaaaaaatttcaagcatagaattctctacataggaaagctatcggattaagtttgacattaggaaaagctttttcagacatgcatcatccctcaaaatttacctcctatgcatattttcccgaaaatctataagaggatgtgctccaccaaaaaggaagaaatcaagaaagaaaattatatagggtataagaaataaggattccaatgcaagggagagttgagggaatacccaaggtgaccgctgaacagcaagccaaaaggacagcactccactggggcagaccagggcacttaggacagtcttctttagaagaccaactatgcctggtgcgactgaacataccaagtggagaggtgagtgcctggtgcagagcttgagatgggattagttataagtacatggaaagcaaagcaaataaaaaccagtatctttattaattcaagagaaagcaaaagtcgtatgggtaaagaaatattagaatatatgacaaggctcaaatatgaatataatttaaagtcataataatgtaaaacctgaatactgatctaaccagtatcaccgtttgttttgggggaatgggtagtgaaagctaacttctaaccttccaagtcggaagttattagatgatgcctatatatgaccaaatcagaaataaatacgtcacttcaagatatggaggtaaatatcaaaataatacagggtcaaaaagtggttcctcttagaaaaaggaagaagagggagaaggcaaagtccttattgtccttatttttcactgagttttgtagaaatttgactctttaaactcatgcatgagtaactttgaaagacaaaggctatatgggtcctcacgttatctttttctactctgccacgccacataagcattttgtacttttagaaggacaaagagttaaaaaggtttattacctctaaaagaattcatttaagttgctttcatttcaccttaaatactaactcttgctttagtaacttgaaatcattaagtttttctcaaaataacagcaaaatattgatcaattatcttttttctttgtgtttggtgagcccatggaacagagcctcaagttagcaagtgcattctgttgatttcgagcaccgctggcttctcaggtatctgagcacttgtctttaagaggcaaaggcagaaaaggatatcatagtgtcaccaccaccaaattgggaaggcccttgtcaaaatcaccgaagcacctctccttttattcttttggaaaaactgattttcccctgccatcaactaaggatcacgcattggctaaaatggccccctaaccagctctaactcagagactttactgcatttgttctgagttaaaggacaatgtctctcttcacaaaatataacactaaaaacaaaattaagcagaatcatgttgttaaagaattttacataaaagtataaaatattttcattaaatgcattgtcagaaccaacttgtcagtgactccttgattacacgagaatatccagtggcaggaaaactagtgttttccaattgcagataacaaggagaatgccatatagtttccggaaagttcaaaacattttactttttattctgagactgtccttcttttttgttgttaaaatgtaatttctggcacataacatagaaaactgtttttaagtatccacctaaacttaaaaccagatgtataaccagacattcctcttttaggtatatgtccaactacagtaagtactgtgcgcatgtccaccaaaagacatgtacaaaaacgttcgtggcaaaataagaaattttttttaaaaagttcatagcatcttgaattaaaacagacataaactgcaaactacccaaatatctattagtcctacaatgattaaatgagattgtaatatattcatgtaatggaagattagacaacaatgcaagaatgaaccatgaacagagaaaaacatccaacaatatgaatgaatcacacagatacactgttgagcaatgaggactgactcaagagtacctacctactatatgatttcttttatatgaagttcaaaaacaggcaaaactaatgaaaagtgactatggttagagtatcagcaggcagtggggtctgactgagaggaggcagggagaagccttccagaacaacaaaaatattctataccttgatatgagtagtggttacatgggtgtgagtacatgaaaaaatcaacctgtctatttagaggtacatttggctatttagatgtacatttcaccatatataaattatacctaaagaaatttaagaaaattataagacaattgagaaaaattttcaaacattataatttattttatgaaatgctggtgacagcagataacagtactttttattttaatatctgtacttacaaaataacatgttgcaactctatattggtgtcccaaataattttttcccaactttgtattttaaaaatgtataaacctacacaaaattgaaatgccggtacaattaacaaccatatgtctttcatctagattcaacaattgttaacattttgctacagtcacttcctctctccctctcccagttctggcggaactgcttgcaaataagtggcagacatcatgacacgtcatctttaaaggacattcttctacagaaccaaaatatcattggttatgactggttatcattgtatcattggttatcgaagtatcattgttaaattggttaaaccaaatttaacattgatatattatttaacatatggtccatgttcaaatttccccaattgtttcagaaatattcctcccatccccaatccagaaatctatcccagactcatgcaatgcatttggttgtcctatttcttttccttttttttttttttttttttttttttttttttttttgagacaagagtctcgctctgtcacccaggctggaatccaatggcatgatctcggatcactgcaacctccacctcccaggttcaagcaattctcctgcctcagcctcccgagtagctgggattacaggcacctgccaccacatctggctaatttttggggtatttttagtagagatggggttttaccatgttggccaggctggtctcaaactcctgacttcaggtgatttgcccacctcagcctcccaaactgctgggattacaggcatgagccacaccacatctggcctggttgtccatttcttgagtctctttcaatctggtataccatgtcccgcatagaattagattttttaaatttatttttggcttttcaagacattaacaattctcacccaatataggtcttttttttttttttttttttatatgctgttgcccaggctagagtccagtggcacaatctgggctcactgcagcctccgcctcctgggttcaagcaattcttctgcctcagcctcccaaacagctgggttcacaggcgggtgccaccacacctggctgatttttgtatttttagtagagatggggtttcgccatgttggccaggctgggctcgaactcctgacctcaggtgatccacctgccttgttctcccaaagtgctgggattataggcgtgagccactgctcccggccccaatataggttttaaattttcttggtatatgaaacccaaaactctgccaacgatttgtatttacttagtgtcttctgcaacctttatcacagcattggtactcaaatacctttatcctgacaagtctggatgaagctacttatcaaatacagagacaggacagttcaatgtataaatacagcttatgattattctgctttaactcaccgctgaggctgagcaggccatggggtctggtttggcgtgggaactgaattcgtgggactcactagcatggcactatagatattggaagcaaccacaagtatgcagagaagaataggaccgatgattgctccttccaggcctaggtagtatgctccaccggccactgccaagcctgtcaggtaaggatggccacctctggaataaagagcacgacctttaacacacaaaaactggaaaaaatctgaaatacatttctaatacaatgtgcattctttaatacactatgctttttagcatattatcagctttctttagatcacctcgatgcatacaactgaacactgactgcaataatattgagatgcaacaatattgagatgcaacaattgtttttcctatggatgacatctgcctctttttatagctccaggaatgaaagaataaagccagcaatgttaacagatattttatacccattacaggtgcctgcctatgatgggttaatgttggcttgggactggttaggagtcacctgttaagttaacctccatcaaggataattaagtgagcacaatttagcatgtaattcagttaattatgcttttatatgacgacagcaacaatgagagcatccctgttactcataggtcagacttttggcaacctcctaaaatatagtttttaacataggtgatgataaaaggcctcctgaggaaaatatctgtcacaaagcccaagatttctatttcacaggagaatcacaaatgccctccagcttattacagtatcacttatgtaagcggaatgaaataaaacagaacacagtagcatagcacattgataatgacaagaaaggaccactgacatcagaaggactgggaaataagtcacattctgtttgtttctagttttaaacatagatgagaagaacaattcagtgaggggcaaataactaaatatcctggaaggatgttctatattacagctaaatcaaagtaagacttgtggagaaccagtcttcaggaaaccaataaattatattcataatgtgtttgtctttctcattccaaaaaaatgatttagggcagtattccatgtttgctaagtaaacttcttccctaaacaacacattcaaggaaaactatcaaaaatgcttaaagctttttattccgctccatcacccaggctggaatgcagtgccgcaatcacagcttactgcagtcttgacctcccagactcaagtgatcttcctacctcagcctcctgagtagctgggactacaggcatgtgccaccacaccaaactaatctttatatttttgtggagaacgggtttcaccatgtttccccggctggtcttgagctcctgggctcaagtgatccacccacctcggcctctcaaagtggtaggattacaggcttgagccactatgctcagccttaaagctttttttaaaaaaaataaaaacgtgtgggagtttatgaataaaagcttaacctattaaaaaataaaacaatttatgccaaacctttcatttcccaataacaacgtttaaagacagtattttaggccgggcatcgtggctcatgcctgtaatcccagcagtttgggaggccaaggcaggcggatcacttgaggtcaggagttcaagatcagcctgatcaacatggtgaaatcccatctctagtaaaaatacaaaaattagccgggtgtggtggtgcacgcctgtaatcccagctactcaggaggctgaggcaggagaatggcttgaacctgggaggcgaaggttgcagtgaggcgagattgcaccactgcactccagcctgggtgatagagggagactctgtctcaaaaaaaaaaaaaaaaaaaaaaaaagacagtgtttctttaattccagctgtaaaccttaatataaaatttacagcaaagtttaaagaaataaaagcacttaagtattaatcatacttattcctgctcaaatgtcaactgtgacacactagttaaccacactatgatgttcagctttttaattttctctctcaagttttaatgtgactgagaactggcttgatatacttaatgcaatttctaaaagagatgtcaaaacctataaaaacagacatttatttattgtattatatggctaaagtgttgattctgacttagatttaacctgtatttatcatagaaccattccaattatatctttagagagctctgcttgccagaaattaacttgctgagatttggtttcacatggatatcctcagacatacaatctaacaacattttctccaaaaccaaagaagagataaaaataatcattaactgttcactgtacttaaaatatttgatgtacatctggtcataattcttttctaggttaaatgtcactaaatcaagagaaaattattcacaatttggttttaacccaggacatcatatatattataaatattacatatgtaataagaaaatattggctgggcatggtggttcattcccgtaatcctagtgccttgggaagttcaaggcaggaggactgcttgagcctaggagttcaaggttcaaggctgccatgagccatgactgcaccctgcactctagcagtctgagtgaaagagatattgtctcaaaaaaaaaaaaaaaaaaaagttgctctggaactctggggcaacaacaaccaaaaaaaaaaaaaaaaaccccaaaatatcatgccttgtaaacaatactattttcaatgaaaatttcatttgtgggaacacaaaaggctatttcactgaaaattcctactaccagttcttttgtatacccccaggagaaaaaaatcctcctttaaaaaaaaaaaaacggaaatgcctggatgattcactaataagaaattctgtggcttacttaccctgatatgtcagagtagattgcagtatctacaaagtatgttggcaagagatgaaaaatcaacagtaaaatggccttgcatcctaacccttgtgtcagccacaggtcaagaactgcaggtactgctgcccagtatgtccccaggaatggcactgctccaaggattgctgctaatgctgaaaaaagagtaaaagaaaaacaacttaacatcatcagcaaaacactaacaaagcaaaagaatctaagcagtagctcctcctcaacaacttccaacaaaacaagttaaatactcacaaactcaaatattagggaaatgatatgccctatctaactgaattttctagctaagtaaaggctcaatatcttaaaatgtgatactaaaaatctttctaagtgtgtgtcttatttatggatctcttcttaagcaataaaattcaagggttctgtagttgctactatcaatcaatagttaatatacggtcctataaatacacctacagaacatgtgtcaaaacttgtactgagtccaaagcccaatcagaaattagtttctaaacctcagcataataaaaataaacagaaaaaatcctgagttgaaggaccctgcttcaaggtcattcccttccagagcagtatgttcaagcactcttcctccatctggcttctctccaagttaagagtaaagcaaatgtagtttctagttctggtcctaccagaagccaggtacatgaccttggaaaactggtctctcatctatatgacaagtctaccatcccgcctcacagggtgcttgcaggtcagagggtaggtttgtggacatcacagtagagaagaacgtgaatgaacttgacaatgtagaaggaagcacagacaaatagggaaagggggggatgtggtagaggcaaatgtggaaggcagagatatttaggaaaacaagcagccatagaaataaaggaaggaaaagtagaagaagcaccacaacagatcttaagaggtatggaggcagcttatgtgccctcagaagcattcatcttgccctgggatgtaatccctcatggacaaagctattttgacaacaagttgctccctgccaatcagttcaattcaaacgttactgagagccaattatgtcctaggtgttatgctaagtgctagaacattcattcattgaacaaacatgtagggcaactgatacgggtttggatctgtgtccccaccaaaatcccatgtcaaattgtaatccccaatgttggaggtaaaacctggtgagaggtgactggatcatggcgggtggatttcacccctaggtgctgttctcatgatagtgaatgaatgagttatcgtgagatctggttgtttaaaactgtggtagcacctctcccctctcttcctcctgctccagccatgtaagacatgcctgcttcccccttactttccaccactattataagtttcctgaggcctcccccaaagcaggagccactatgcttcttgtacagcctgcagaaccgtgagccaattaaacctcttctttataaattacctaatctcaggtatttctttatagcagtgagagaacagactaatacagcaattttttctatgtgctgggtatggttccagctgctggggatacagcaataaacaaacacattacaaatcatatttctgttcctaatgtggactagattcgatctcaagccaaaaaatttagttttttaaacttgaggaagtagacatttcctagatgtatgtaaaatggcttaactttccttaaatagcgaatagtggaaggtacaatatggttgttacctgatggtatgaagacaatattgatgccaaacatagtatgagtcagccaggtatacaatccatagaagccagccattttgagggaagcatcaaacacccctctggaatgcccaaagataaaaagaaagagtaaataaacagtgtcatatcgtgattcagaaaaatcacgtgaccacttgattccaaatcatgtaatagcttcagtttttctgctggcctgagaatgctattttcattttatttcaaagaaacataaacaccttactttaaatacatttactaagttattctttatgtaatatgaaatatgttttatttggaaatatgtttactattccttaaatttctgatgaaaaaataactgaaacaccttaaaataccctattctctgaaataattcatcaacttttcactctgaagcagatatttcaccaccaaaacaaatggaaagaaaattaagcgtgaataacatgtttccaagaatacagtttaaactctaagaaacccaggctgtggccagtcctccccttttggaaagagccaataagggatagtgtaacttgtatttcaccatctttctttgccttaacaaaatcttcctatgtttcttaaactatgtaactaagcctacaaagtaacatctcttacaaatgctatcaaagaaagtaggtcattgggagagaatttgtgggaaaaaaaatattcctaactccaaagtaaaatcagagaggaaaatacaagagagataaaaacagacacatatatttggtgactaatataggaattcaatacatgaaaatctgcaatgtcaggtgctctgtgtttttcagttggaagattagtaaggcagtgcagcactataaggaggggaaataaggaactgttcagagagcacaaaggtggcaacccgtaagtaatctcaaggcagcacaaaatcataaaaacctggactctatggggtggtgcagaggggtgcagggaaagcaccttcatatggtcactacagaagaaaagctgtagttgaaaaagaagacgttagcggcaaacgtgaccttgtacatgcaaaaagaaacaccaagcttttctaaagcatcccaagaggtatactgttaggagcaaagtgaagccctgtaatctagtgatttagtcatttagtagtgttctgggacatggatccaggggcagagtggctccccaattgtaaaacctgctttgtcatccggaccaatggctttcactagagaacgtcttaaaggagccatatgactctgcaacaagaacccagaataaagtggtatcaaaaataccaaaaggaagcgaaagaccccaaagaaaataccaaggatctgctcaacaactaaacagagaggacagagcaaaaagaaaacaacagagcttcaggttttaaacctgaaggggaaagaatagcagtgtctcaaagtcatggagaaggccagaatggaagaggcatgcaagaaaagggcagtttgtttagtatgggcaacaggaactcaaaaaggatgatgaaaataccctagaggtagctgaaataagagacaaggcttaatagaaaattcagaacaagacatctgagacgcaccagaataattataaaagagtacaggacatcttaaaagggcaagtggagagaaaatagggcaacaggttgtgttttcataaaggacctaaagacaaagaaataccagccagagaggtaatgaaatcatttccgtagtaggaggaaaatcactagagtgcagtattcccggagaccaagggagaaggtaggttttgagggggagggaataatgacataatcgaccacagagaaaaagaaaggaaaaaagtatagaatttgtctagaactagggaggtcaatgaggaaaagatagagatgtgatcctttctttaaccttatgttatttaaaaaatttaagccaaaaataagttgacatcaaaggtgcaacagaatactgcaactcaatcacccctctgggtggcaagtaaccaaggctcaatccagtaaggaccacgtggagaagacagcagtcttctttctttcactgctgagaatattggttgctggtaatgttctcaaggcaacttttaaatgcactgtatattgtttgcagttactaaacatattcatgtaacctagtgagggatgaaaagacaatatattcccctctacctcattacttgtgatctggcacacaagttttataaataaaacagcagagaaaaatcctcttacaatttaccagaaaacagaatttaactccctcaaattcctagcaactttttcttcttttttatatcagctttattaaactatgatttacaaataataaaactcaccaatttgaagcattcaattcagtaatgtgcacaaatatatacattctataaccatcattacaatcaagatgtagaatatttccatcaccccaaaaagttccctcatgcccttctattgtcaaaccctccctaaactctggcctctgatggccactagatatgctgtcactataattctgccttttctagaatttcacgtaaacacaaccatacattatatagctttgtattaaattgtggcaaaatatccatggcacaatatttagcatctgaatcattttgagtgtgcagttcaatagtgctaagtacattcacgttgtcgtgtagcttttggtgtttctttcacctagcataatgcttttgagcttcaccaacattgttgagtatatcagtagttggttccttttttactactgagtagtattccattatgtagatctactacaacttgcttatccattcaccagctgatgggcatttgaggtgtttccagtttgggggtattatgaataatgctgctatgaacatttgtgtacaagtctttgtggacatatgctttcatttctcgtctgtaaatacctaggagtggagatactgggtcatacggtatctatttaactttataactaatattagctttaatctctcaattccgaaaaaactaatagtccacggacaccaacccagaagccactgcctcctacctcaccacatatctcctcaaggtatgaggttaaacctcacagtttcatgtgagtggatgctggcaggaagaacaattcaacccatgaaaagctaaatgacaatgcatctgaagcacctagtaactgacctagtgcacagtagatgctcaataagcagtggctattagtagaaaatgtggtgtgtgcacaaggaaatactattcagcccccccaaaagaaggaaatcctgtcatttgcgacaacgtagatgatcctggaggacattatggtaagttaaataagccaggcacagcacagatagacaaatactgcatgtggaatgtaagagttgaactcatagaagtagagagtaggatgtggttgccatcctacaaattttttttttttttttttttttttttttgagactgggtgtcaatctgtcacccaggctggagtgcaatggtgcaatcttggctcattgcaacctccacctcctgggctcaagtgatcctcccacctcagcctcccaggggctgagagatggtcaaagggtacaaagtttcagttaggatgcataagttcagtagatctattgtacagcatggtgactacagttaataataatgcattgtatacttgaaaactgctaagagtacctcttaaatgttctcacaacaaaaatggtacgtgaagtaatgaatatattaattagcttgatttaaccatttcacaatgtaacattttattacaaactataaatatatagcattcatttttatttgttgtctggctggttgcggtagttcacacctgtaatcctaacgctgtcagaggccgaagcaggtggatcgctacagcccaggagttcaagaccaacctgggcaacagggaaaaccccgtctctactataaccacaaaaaattagccaggcatagtgcgtgccattagttatatgccagataaagttttatttgactttgggagtaaattattcctagcaatctctgaattttaggttccaaagaaccctggagataaatggtaattatatgcccagtattataggttatttaaccttacaatttaaaataaccaaaccaaaactttccggtatgctacctgcatgtgcacagcatataactgtacttggcatgtagtgggttgtgttagtttcctgttgcagctgtaataaattaccctaaactcaattggcttaaaacatactttttatcttataattcagaagtcctaaaacctggatgccacattctttttggaggatttaaaggagaatctgttttctcttcttttttagtagttttttttttaggctagccaagtaaagcagtgagagcagagagggaacagagcaatctgtaactggttgtgatcatttagttgtaaatacgaccacacttggactagccttttccagtttttaaaggctgccttcattccttggctcatggccccatcttccatctttcagactagtagtgtggcatcctccaatctctctccatctctgagctctgcttctgtccacatgtctccttcattctgactctcctgcctttgttttctaataaaatttttttattgagatgaagctcatataacataaattccatcattttaatgtatacaattcagtggtttttagtatgcgcacaatttgtgcaactatcatcattaattccagaacttcctccctcttataagaactttttttttaacttttcttctttcattaaaaataaataaaggtatagctgacaattttttttttttttttttttttttgagactgggtgtcaatctgtcgcccaggctagagtgcagtggtgcaatcctggctcattgcaacctccacctcccaggctcaagtgatcctcccgcctcagcctcccaagtagctgggactacagacgcacacacaacccactacgtgccaaccactgttatgtgctgtgcatatgcaagttttggttcggttactttaaataacctataatactgagcatataattatcactcgtctctagggttctttggaacctaaaattcagagattgctaggaataatttactcccaaagtcaaataaaaccagttagtcaacattttttggatagtcaatttcagtaaacacttccctgtcttactatctatgaaagacattatgatacagttcatcaaatctcttgcaaacatcacgatagacgtggacttctggcattccctaaaggtgaccatgtatgacttgtgctgtgtgatccatggtgccaatggtcattacccttccctttgtaactgctcacaaccatgtggtcaagcacctactgcagaaattgacagaacacttacatcaagtttaccagtctaatatttatggactatatacgcttcctccacctttatgtctcaaaaaatatctgccttttcttggttttctgggacctttttcttcagtgattcttcaaagattattgacagttgttctttaattttagtccaagctctcctagcactcaatagttgatgagaatcaaactctggaggttcttttcctccctccttttggtagctcagatggacgtgatttagctcaatggaagaagagactgacacaccagccactgagctagaggcacggttttctaacaaggcctattccctattcatagacctcccattactacacagtcttagagatgttctcctgtcccatactatatatagactattatagagcaggattcctgtccattggaaggtaggccatcgtgcatccaatccagctatgccccacctaagcatacctctctgtggaataaaagttccaagagttagttaggatcagctttttctcagctaggattttcccctaataaagcctactgtatatttataccgtatggcactaaaggtgtgaatatccatgcctcctttacacaactatatttaataataactcctctgcaccagaagcttgaattgacttcaaatgattgtttacaatgttaactcttcctaaccagctcttgatcttcatcctttataaatcctaggatgaaacttactttttcacacgtttcctgatacttaactttagctctcaaccctctcttttctgacaaaccagattgtgcttgctacttttctaaactgagtaagaaaaaaataacaagacaattcaggatttaatcagatgacctgcttttaatggaatgatatttgaagcaaggagtgggatggggagaataacaaaccagtccagaagctctataaactcagtgtacacagggccttagaccacagctgagtaagaattacctgtctaaggaagaagataaataatgaagaaaaggaggagtgaagagtccaaagtgaaattctgcctcctccacatttccttacactggttccaccctcttttctaaaggactgtcattccccttcccagtattctagcctcactgcaatatggtatgtctcaagtagaaagtgagctggtgggagagaccagtcagcttttagagacacagtatatacaataaccagtgggaaaagtactcgccagctcccttgactgctctctacatatttatggggtacataataatgtttcaatacatataatgtatagtaatcagataggggtaattggcatatccatcatcttgatcatttatcattttggtttttttttttttttttgagatagagtctcactgtcgcccaggctgcagtacagtggcatgaccacagctcactgcaacctccaccacctgggttcaagagattctcccacctgagcctcccgagtagctaggactacaggtgcatgccaccaagcccagctaatttttgtatttttagtggagatggggtttctccatgttggccaggctggtcttgaactcctgacctcaggtgatctgcccgccttggcctcccaaagtgctgggatttgaggcgtgagccaccgtacctggcctcatttcttttgttgggagcattctgtatcttccttctagctacttgaaatgatataatttattgttgaactacagtcattctacagtgctgtagaacattagaacttatgccttctaagtaatttttgtatcctttaacaaatctctctctacccaccccttcccagccccaacctcccttgagaggtcacatcttccctttcttgattaatctgccctggaaacccagctccacagggtgtcatatagcaacctggctgacattagatttccagcatgaggggaacggccgagctgctgaagggcacaggggatgagctgcttacgtggaattcttccattctcaccctccaaaacagtggtgaaacacagaaacatacaatgacagcatcacaatagatcatctggaggctatggtagtagtaaatattaattcaatattttcatacagtaatacatggttttgtgtccttgacaatgcctagtgattgtggatgcttactctaatgctaactaaaaaaataacaaggggttgtttcaattacataggcaaatagtaaacgtgtatttcaaaactagttccattattagcccactaaaatgaatttagcagttttcgaagcatcacaatgagaaagtaaaagacacatttttaaggtaatttaccttggaaacttaagtttatgagatgaatctttcatcaggtaggttaagcatacctttactgtcttgattattatttaagaactccagttaatttaatttccccaaatatgcataagagatttctgcttctctattccagtgttgggagagatttcttcaaataaatgaaaatacattttcttacagctttacattcttccttatacatttaaatattgtttatactcttaaatcaatgagaatttgtaataaatatttcatttgctcaaagtaaaaaatggaaacactgatttactaaatgatcattgctgactttttttaatccaaatacttttaattctccaaaattggaaggtaccgatgggaagcatgttcactttccaaatgagaatcgcatggcatacacactgtcttatctaattcatcaggacacccacccactggcactgaaaagctgtaatcccagcaagcaagagccatacccgtgtgcatgcactcatgtgaaaatatcacacacactaaattgcattgaggccgtgacaacatgcaacttagtaatgtgcaatatctccaccagagcaagcagaatgggagcatcagggaagaagggtgtgatgtatacattcaggagacaacatgctgctgaagagaggaaaatggtctggggataaaggatgcatgccactgactcaaaacttcatgaaatgaaaacccaattgcaaatgtattcaactgagaagaatacttattcagaatcaaaataatgagtaaggttcaaaacttcaatgagatagtgatcataaagaaaccacatacttcagaaggcaaagcttcacgaacagacactatcactgtctggtcatgcaattaacccccaatttcaattccatttttgacttattcacagatcatataaatgaatgtaatgatttccacttagctgcaacatagatgatgattaatgactgatgcttataaaagttggtatcactgatatttgtaggctaaactgcactttgaggacattacaatattttcatagtcattcataaattataaataaccacttatttttccctcaaaatctttttccatgaagaaacatattgcctcttcaacacaaaccttcaggatgaaaaatccaacaggagctcttagaaagagaactcactaccatcttctccacaggagaaagctcttcagaggaatctctgtaaaatctgtacattttaagtcttgaatttgagccagtaaagaaacagccctaggaacttaaactgcaaaaaaaacaccttgaattatagccttaaaattacataacttgatatagctttggttagaaaaatgtctcaggccataacccattctttagtctgtaccatatttatcagactcataaaaatctatcaattctgagaaccattagattatagttctggtaccaaaggttgttaaaattttttctgtatttaaaataaggtgataataaaacaaatggtttttaaatgccagtatactatggaaccaagacataagctactgttataatacataattagtgtatgcactcccaagaagggaagtcgaatctaatttgtaaaagactgatttcctcatatcgctgtagatgacagcactctttgtaatctcaaattctctcctgagccaaagacctgaatttctaaatgccaccctcttatgtccacaaatataagtcatgatcttccctaaccagctcctcttgaaagaaggcatcatggtgtaacagagtatgtgctttcaatcagctgaacctaggtgtgactaacagctttacttaccactgactggcaaacacaacagctaggaattaagtttaaaacaaaaaaggtggcatatttggtatgaaaaaaggtgacagacatttagaggatggtctgctgtaagaaagcagaacaagagaaaattcaaaagctgtgatgtgaaaatagaaacatttttctaagaataagagtcagtaacaatgaagattacttgaggaaaatggaagcatcatctttcttgaagttctttatgaacaaggtagatatttttctgcaaagcttggcttaagccacactgactggagaattcctaccagcctttgatatggctgctacaataaatagctttaccccactgggaagataaaagattagccttcctttttggtagagcatttgcaaaagcttttctgagtcagaaagatatcacctagataaacaaaagattatctattgctagaattttcatcatttcatttattcagcaaagatgatagtcaatggtcatataggacttaggagggaagctatagctggtacttccttcgaaacagcttcaccccaattgctgttacactggataatatactcccaaatctggaatctttatagatggcccctgtgtggatacctgaggacactatacaggtgttaagagcattttttttaatcccacttgacagccaatcgcggaaacaaggtattggtgaagatcttacccaggccttgctagtaggaaaaggggagagaacttagcaaaagttctacagacattgtattttaggagcatgcatcctgtttgaatgtaactgaaggttttctaacaatcaaatgggattctccctagctattacatgaacacagtgaaaaaatataccaagatcaatcaggtgcaattatcagagaaaaaaaaaaaaatcaagatttctgtggaagactagttccagacaatatttattaaaagtatgtggagacagaaatgccagccaaagatttgctattcaagagatgcttaagaccacctggttaacaacgtattagaaaaaggagctctaatggacaataggagggtttaatttgagacgtattcataagaagtaaaaatgtagttgagtcttgttaatgaggaatgatgacagggattacaggaggggctgagacaggcctgctctgcaaaagggtcctccctaccagaaatgatgaagaggaaaagataaaggaagccaagagccaacgacctggaaagagcttatacagaggaaaagttgaagaagttcattcagaaacaaagcctgtaaatacatggatgccagaagtcataacgaaaaagtttctggccagaacctccagtgcatacagagcctataacttaagagataaacaacgattctgcatttccagtatccaacctactccttgcagagggcacagcttggctgtaggacagaggagaaacaggaagtccacctactctccttctggagcaaagctaaaactcctgacagcagagggttctgaaagaagttggagatgggggtggtggaagcgggggttctcttaagcaagtgacatgatgctaacagctagtctaagatcctgctgatggaaagctgatggagatagaccattacatctttgtaaatctcaggtttgagagaaggttatcaaaactgctttgaattgttaaattttgttttgtttttgagatagggtcttactctgttgcctaggctgcagtgcagtggtgtgaccaagttcactgcagcctccatcttccaggctcaagcaatcctaccacctcaacctcttaagtagctgggactacagctttcacaccaccatgcctggctaatcttttttatttttagtagagacaaggtctcgctatgctgcccaggttgtgtcaaattcctgagctcgaacaatcctcctgcctcagcctcccaaagtgctgggattacaggtgtgagccaccgcgcccagtctgtttttttgttttttaagaaacagggtcttggccgggcatggtggcttatgcctgtaatcccagtattttgggaggccgaggcaggcagatcacttaaggttaggagtttgagaccagcctggccaacatggtaaaacctcatctctactaaaaatacaaaaattaactgggtgtggtggtgcacgcctgtaatcccagctacttgggaggctaaagcaggagaatcacttgaactctggaggcagagactgcactaagccaagatcacaccactgcaatccatctccaaaaaacaaagaaacaggatcttgctctgtcaccaaggctggagcgcagtggcgtgatcacagctcactgtaacctcaagttcctcaagcaagcctctggcctcagcctcccaagtagctggggttacaggtgcatgccaccaagcccagataatttttaaaatttttttatagagacagggtctcactatgttgtccaggctgatctcagactcctggcctcaagcaatcttcctgcctcaagcaatctcaattgctggaattacagacatgagccactgtacctggcctgaatctttttcttattaacaactgcactgttcatatttatcctgtcaaaatgagatgaaaaccttgaaaataccagagtccatcacgagtttagcactgaatgttatcaggatgctcatgacaaaaaacaggcttatcatggaaaaaaagttctgggagaaataagaatagcataaaccttatccctacctgatagcttcttccacagactggccaataatattagaagaaggacctggctgagatagtggagtcaggcttatcacccacttcactggcttgtagtactcatcactggaacttaatagataaaatagtgtggtcaggaaaattatctgcaaaacaaaggacaacatctcctaaaaaaatcgtatttggaaactataggaagacagacatctgcaattgcaaatgaaaccagaaatatgctttaacagggaaggaaatatgacgtgtacttatctatgtggacgtaccagagagagtacaaaattgagaagggctgtcccgctgtagaagaggatggtcaagagtgtagtgacagtggtgaacagcaggctcacattccggctcataacgatccacagagactccaagatctgacgaggaaggaaagctggatatcagaaccaatcctcatgaaaaaagtttctagagccatctagtgtgcttttaatacagtgttttagtaccatgaactgaaaagctaagaactgaggattatttcaaatgaaaattaaaaaaaaaaagaaaaatcaaccaaaaacagttgtatactcaatagtaaagaaaatagtaaatccacaccaaataatatagacagcaattaaaaacatcactgttataacatgggaaaatattttacaatgaaatgctaaatttaaaaaacaggattaaaacattttatatataattggtggggcatggtggctcatgcctgtaatcccagcactttgggaggctgaggcgggtggatcacttgaggtcaggagttccagaccagcctgaccaacatagtaaaaccctgtctctactaaaaatacaaaattagccaagtgtggtgtggtacatgcttgtaatcccagctacctgggaggctgagggaggagaatcgcttgaacccaggaggcaggggttgcagtgagccgagatcctaccattgcactgtagcctgggcagcaagagcaaaactctgtctcaaaacacacacacacacacacacacacacacacacacacacacacacatcattgtagattatgtaaaaatcgcaagcagagaaaaaatatagtcatgcatcacttaattatggagatatattctgagaaatgtgtcattaggcaatttcgtcctgcaaatgtcatagagtgtactgatacaaacctaaatggtaaagcctagcacacatataggctgtaagatacaacctactactcctaaactataaacctttgtagcgtgttactgtactgaataccacaggcaaccacaatataggtatctgtatatctaaacatctaaaaggtacagtaaaaatacagtattataatcttatgggaccatgattgcattttgtggcccatcattaacagagacattattatgtgacacaggccatgactttacctcctggggaatatgctagagtacaacctgtggttatatttatcttgtaggatcctaagtgcaggccatgaaattccagtatttgctttactggctgcctagcccccacccttgccatttccaacttagagctatctacaaatataaaaagcatcacctcaatgacttcattaaatcacaagaaaagcaatcaacagacagggacaagagcagtgctctgaggccaaaaatctttcctgagacaggcaatgaccagtatattgacgtctactgagttcagctgatttgtcacctacacattcactagaaccagatatcatgaggaaggtttctcatagatgttaaatattaataaaggagaggtacaatatttatagcatacctgcacatttcatttactatctcaaatccccttattatattatctgttctattcttcctaagtggactatccttcctcttaatgaaaaatacaaaaacaaaatgaccagaaaaacacctcccattaccatttctaaaatgcttccatagacctcccaacaatgctgtgaacgaagaaatgcagatgatattatctctattttatacatacataatttgaagctcacaaatttttagaaaacttgcccaaaggcacaaagctagtaagtggaactagagcttagagcttaaatgttgtggggcagaactcacaacatctgatttttgttttggtgcccttcccaaaacagcagttctggtttttgtcatatgtccatctgttctatgaaaagtcttctccattcctttcctacttcagatgtaccatttataaaggcatattttgttgcccttggcatttcttgcaaacctcagctcagtttcataagagaactccggcaggctggtttcatttacaaaaactccttacataaaatcttgaaaatgcttcacaatgcctacaaaaatgtgcaagattgactgtttgacctcgtgggataaagaataaatgaacaatgccatcagttccaagaaacaagccaacaatgcctttacttgtgatttgacaagcattctttttgcagcttcagtcattttggaatttttattaaaaaaaaaaatttaaatagtttctgggttgcactgagagaaaatatcttgtggtaattcttaagaaattaactaaatacactaattttagattggtagtctccaacaacaaaaaagtaacctttcctatttgaaagaaaaaaagaaagggaatcaactggagaaaatagaggaagaaacatttctagaatattaactaaatccttaaagtaaagtggtttaatttatatgtcaggcttaaagaggagaaactgggtaaaggcaggcacaatagcaaggcccatgaaactctgaaaacaaaacacatttatggagacaaaatgtatcccaactcaggctgggtgcggtggctcacacctgtaatctcagcactttgggaggccaaggtgagcggatcagttgaagccaggagtttgagaccagcctggccaacatggtgaaatcccatgtctactaacatacaaaaaaattagctgaatgtggtggtgcatgcctgtaattccaactactcaggaggctgaggcacaaaaatttcttgaacccaggaggtggaggttgcagtgagctgggatcgtgccactgtactccagactggatgacaaagcgagactctctctctgagggggaaaaaaaaggatcctaactcagaagtagaaaacatgagccaggtttggtatcagtttaatcaacaatagcaatgtaagtactggaagaacatcacaaagagttcattatgaaacatacaaaaagcccaagagacttactgaaccaactaagcaatgtggtcatgaacggtggtctctactgtggataagaactgaccaacaaggcctcaccatctccagtggctctgcagccctttactctgagtccaccactcaccaaacaaccttttgattattaacttcgtttcccagtacttactaagagccatcagcccaccttctatggagccggtgaaggagattcaaacgcaacagtttagaaaaacaaaggaggaagaggacattgcaggaatgcagaggtctaaataaggaaaaatgtctctcctggcagaactgagccacctctgtctgcctcagagacttgggagggagcctggagacaatggaccacatgagctctgctatcttctctagttccaatctttcttatctttaaaggaagggacatgagtcacgtgacctcaaaacgccatttcaacacagccactgtatttctaaatacaacaataattattggctgggcatggtggctcatgcctgtaatcccagcactttgggaggccgaggtgaaagaacagcttgagctcaggagctcaagaccagcccgtgcaacatagcaagaccccatctctgcaaaaaatttaaaaatcagctgggtgtggtggtgtatgcctgtagtcccagctactcaggaggaagaaggaggaggatgaagcagaaggatggcttgagcccaggaggtcaaggatgcagtaagccacagtcaaactactgcactacagcctaatgtgcttctcttaattagtttaattgaggacctaacaccatactaaattctaaggtagtgatatatgagattccttctacctccaaaaacttacaatctagtccagaagattgggtacaaacactaaagtgtcaaaaattgaaaaagaaggtaaaatatgttcaggtatcaaaagggtgaaaacaataaatgcaaaaggagtctgaatgtagagaaacctcaatgtattctgaaatacactgggaagatttcatgaacgagactggccctaagccacctatttacaacaatatccaaaaaacaaaaaaaaactgacaaagcaaataaaaatataaaggtatgagactaagaaatgttgagttctctagaggatgaaatacagtttgaaagataatacaacattatataaaaagtctggcctctggagccaaggaaagatgaactgactttgaatatcaactgttatttaccgtgcaaactatttaacacctgtgagcctgtttttttgttattaaaatgaaggcaactatactacttttgcagaatcactgggagaattaaattggaaattagtaagcacctagcacaatatttgacacaaaacatttcatacaaaaactactaatcatctgttccctgaactgttcattactcaatatttaaatgtgtttagggatacagaaattgtacttttctttttgagggattacatggcaaaactgttattttagtttcaaaaactgcctcttctctttccgtaagaatttataaaatttaatcatgtttctttatcatctatcttaatatgattcaacactgtcacttcattcatcaataacagacacttttaagttcaacgactacagtcacaaaacaaaacaaaacaaaaagggattcaataacttttagttaacacacctgaatttttggggaaagcaaacattcaaaggtattattagatgatacactattttgtgtatgcactggcattaaagagccaactggaaggtccaggatactgggtggaacctgctaatgggcttttctacaggctgacctggcagggaccttccagctgcttttagtgttgcactcttaaaaaggaacacactgccaaggatcaccagacaggtaacaaaagagaaagcaaaacaaactttaaagaaactcagagcaaagagagagcagaagtcattttaaatattttattagtaatattctcaaataagtaaaaaaggatggttcagaaaaaagagctattggatattgcaagtatgatagcagaaatgaaaatttcaatcacggtttctttttttcttttttttttttttaagatggagtttcgctcttgttacccaggctggagctcagtggcgcaatctcagctcaccgcaccctccgcctcccagattcaagcgattctcctgcctcagcctcccgagtatctgggattacaggcatgcgccaccatgcccagctaattttgtatttttagtagagacggggtttctccatgttggttaggctgatctcaaactcccaacctcaggtgatccacccgcctcggcctcccaaagtgctgggattacaggcataagccaccacgcccggcctcaatcactgtttcaaaggcaagttgaagctatttctcaggagaaaaagaaaacaaagagacagaaaacagaaaagaggctttcaaaattaaggaatccatgttaaaggcccaatatctgattaacagcacttcatcttccacattaggaagccaaaagataacatctaaaactgcaaaacaaagagagtagcataaacattattttagaaattcagaggtaaatacccagggaaagctaaaagaattggcagttgtttgtaaagaaaagatgggaaattgggaggcatacagcagggcactgctgtttattaaaatcttttagcgttgctgccttttcagttatggtcatgtattactttgataaaaattaaatttaggccaggtgtgatggctcatgcctataatcccagcactttgggaggccgaggcaggcagatcacttgaggtcaggagttcaagaccagcttgggccaacatggagaaaccccatatctactaaaaatgcaaaaaaaaaaaaaaaaaaaaaaaaaattagctgggtgtggtggggcatgcccgtaatcccagctacttaggaggctgaggtaggagaatcgcttgaacccgggaggtggaaattgcagtaaactgagatcacactactgcactccagcctaggcaacagaatgaactccgtctcaaaaaaaaattaattaattttaaaaagtttagcacggcaaacctcaatttttgttcacttgatgaaagtcacaagtttatgcacaagaaaactgccctctgtgaaattctacatgcaagacaccatacaaaatatggtatggaatgaggaggagcagtagttagcacttaggaatgctgcagactgcagaggtgatgatgcatggtaggaggttaggtgggaaggtgacaagctaagcattcaacacatcccatccctccaatgtaactggaaccatatttccatctggtcaagggtcttcgcacaacacaaaggcaggtgcctctccagtagtccagctggagacatcctggtcatctctcagttactctacaaccacaggggaaataccaagggagtgacacctgaagcctatggcttttgaacatcatcctagtgcatttagagttctcaaatatgtaaatgtcatgatgttaaaaacaggatagatgaggcctcaaagtgtatgaagaaaacttggaattacagtttgtttttattttgaacttcagcttaactataaatgctatttcttaccgaaagaaatgtctcaatgttctcgtgaacaaaggaaacaatatcctgccagtccagaatgtctcccagccagctattctgacgactgacatgcaacttctgtcctttgtgccttccagagtgtgttacattctatggaataaaacagtgcagacatgaaattcccatcttaatctaaagaacagaaagtataaatgtcacattttgcttcaggtccccttcatcacttcagtaagtactccaaggaaaagaactttgcattatttaagaaatcagctaaggccgggtgcggtggctcatgtctgtaatcccagcactttgggaggccgaggcaggtggatcacaaggtcaggagtttgagaccaccctgaccaacatggtgaaaccccatctctactaaaaatacaaaaattagccaggcgtggtggcacgtgcctgtaatcccagctactcaggaggctgaggcaagagaattgcttgaatccaggaggcggaggttgcagtgagccaagaatgtaccacggcactccagcctgggtgacagagcaagactctgtctaaaaaagaaaaaagaaatcagctacgaactccatttaaagacctgaaatataaaattcttttgtttatattctaggtaccttgtctaagtctcgctccagtgcttccctcctaaatacatttgcaaagacatcttatttctcagtatctacaacacactaaacagcatttactttctttttttttttttttttttagtttttaggccctccacctttctcttgatttcccatctttgctttttcctcctttcctcatttttttttttttgggacggggtcttgctctatcacccaggctagagtgcagtggtgcgatttcggctcactgcaaactccgcctcccaggttcatgccattctcctgcctcagcctcccgagtagctgtgactacgggcgcctgccacaacgcctggctaattttttttttgtatttttagtagagacggggtttcactgtgttagccaggatagtcttgatctcctgatctcgtgatccgcccgcctcagcctcccaaagtgctaggattacaggcgtgagccaccacgcccagccctcatttttctttttaatttaccatacaaggtaaggaaaatgaggacagaagaatataacaagcaaacgtaaggcagtaaatagaatttatctatctggaagacattggcagagatatgagaataactaaatttgaaagagataagggccaggtaaaatggctctcatctgtaatcctaccactttgggaggctgaggcgagaggatcacttgagcctagccgttcaagaccaacccaggcaacatagtgagatcctatctttataaaaatttaaaaattagacaagcatgatggtaggaatgttgtcttctttttttagagacagcgtcttgcttgccctgtcaccaggctgcactggagtgcaatggtgcagtcatagctcactgcagcctccaattcctgagcttcagtgatcctcccgcctcagtctccccgagtagctaggactacaggcgcacaccaccacacccagctaattttttgtagagatggggtctcactatgttgcccaggctggtctgaagctcccagcctcatgtgatcctcccacttcagcctcccaaatagccaggattacagacatgagccaccaggcccagacaacaaatatgccaattttgtacaaagaactggagcatccctggattttggtaccagaggggtgtcttaggaccgatcacccatgatactgggggacaattgtacttaaccacttaacaaacctatgcttatgaaacactgaccttcctctactataaaataaagctcaggaggtgtgaggggtaataaaagctatttgtaagcagaagccccagagttagcaaaagaaatagatatacctttctaattatctggtttttcagcagatgggatcaaatctatgatactcacctagatattccctgaatattttttcccaagtctttgaaatctataaaaactaacaatcttccttcaactcatcccaaagcaagagtacataatcccaaacaagtcactaagcaacaaattcaaatttaaaatcagccctcctccccctccaccctacattaagagacttacatatatacttgctctccttacatgaactctgagaatcatcaccaccaactctatccactctatacacagcacggctcctgctagcccacaggccctgccagatccagtgtataggatggtctggacaacatggcaaaaccctgtctctacaaaaaatacaaaaaaattcaccaggcatggtggcatgcacctgtaatcccagctactcaggaggctgaggcaggaggatcactcgagcccaagagacggagtatgttatagtaagccaagatcacaccactgcactccagtctgggtgacagagcgagaccctgtctcaaaaaataaataaataaataataataaaaaataaaagatctctaagcgtttagattcagtttcactttctcaaagaaaagttattaatgcctacagttgtactgtctaaaacagtagccagtaggagctagccacatgtggctactgagcacttaaaatatggctagctcaaaaactgagatgtgctgctggtataaaatgcatgctagatttcaaagacatatggaaaaaaaatgatataaaatatcttattaaattttttctaatgattatatattaaaataatagtatttggggcatattgggttaaataaaatatcactaaaaaactaaaacaggtaaaattcgtttagtataagtattagaaaatttaacattaccttatgtggcttgcattacacttctcccgcacagagctagtctaggggatgagatgtccgtgacaacagactgaggatggaatactgacgcaccagagagataggcaggttctgccatggagactaaccatcaactcacactgacttttagtgacctgaggcttaaggttttgctgttttgaaatttccatgaatgaaatcccactgtgaatataatcctatctagttgatgagtcaataaaaggactttattagtttacaacaggaaactttagctaaaataacttacctttacaaaccaagagtgatacagtctgtcccaaagttctagtacttgcttttcaattacagcagtattgttcaccttatctcctagaattttatggagctagaaaaaaacacagatacgacgtggtacaatatttcaggcaacaacagagtaaaattaatatatgctgggtatttacatttgttccaaagcaaacaaaaatgttccagactatttatctctagccatattacgttctttccttaaatctactcctgagtattcccagtaaatttcctttctcatgtttttgcttctattttctttgctctattcttaggtctctaagagagctacctcacgctatcagagaatggtgcaaatgaagccatgattgctgacttatctgatcttacctgtccagagaaaaatctttcccctgtaatcccagtgaccttccattatacatatgtctcatgttacatttatctctattattaagaattaccacagaattttaagtaaaattttaggatgttggctataaacacgaatccttcctctatttgcatgctgagagatgtccggtctcatttacaattgatcagactggccccgggtttgtggaaatcaagtacactgagacaacgtaacttagaggaaggctatcattataaaatgttgtcccacttagttattattaaaaccatattataatataaaaaacaattttcacactttcagaggctgaggtgggcagatcgcttgaacccaggagtttgagatcagcctgagcaacatggcgaaaccccatctttacaaaaatacaaaaaaattaccaagtgtggtggcgcatgcctgcagtcccagctactcaggagactgagatgagaggatcacctgagtccaggaggttgaggctgcagtgagccgtgatcacgccaacatgctccagcctgagtaacagagtaagacctggtctcagaaaaaaaaacaaaaacccaaagaatttctagaagtttgtaggcccacttccttaatacaattgtttccatttttctatttcctctgcaactttctgcctatttacatagagacaatttagaattttttctacttcattataaacattcaatctttagccttcatcactaaccttcatctttaatacttttatattaattcattacgttctggtattagctgatcattacccactctaaggatatacaataaatccttctttttttttgagatagagtcttgctctgtcacccaggctgaagtgcagtggcgcgatctcgactctcattgcaacctctgcctcccaggttcgagcaattctcctgtctcagcctcctgagtagctgggattacaggtgtgcgcccccacacccagttaatttttgtatttttagtagagatggggtttcaccatgttggccaggctggtcttgaactcctaacctcaagtgatctgcccacctcagcctccacaagtgctgggattacaggcatgagccaccacgcccacccatgaatcctaatttttagtgtcatgagtaacactgcaatgaacatccttttacatagtttttaaggatatatatggatgttcattgcagggttacttgtgacataaataaatgtactgcaaccaaataaaatgagtttttgttttgttttttttgagacagggtctcactctgtcacccaggccggagtgcagtggcatgatcatggctcactgaagcctggacctcccagactcaagcgatcctgccacctaagacagccaagtagctgggatcacaggcgcactgacaccagacagagctaattttcttattttttgtagagacaaggtctcactatgttgcccaagctggtctgggctcaagtgatcctcctgactcggcctcccaaagtgctgggattacaggcatgagccaccacacccagccgaaaatgagcattttaatggctcttgctatgcattggtaaactgacttctataataagaaatataccaattaatgctttctaaaattacataaatgacccaatttcctcaaagccttatgaactaactggaaaatttttagggaatttaacaggtgtgaaatgtagccattatttattattttcttctttattaatgaaaggagtgaccattttcccacgttagtttacaacatctatttccttactctttgcctatttgatgctggccttacagatatgtgaaccagttactagacatattcaatgcaaacgtatctgttcatatttgttcctttatatttgatttattcataaactgaaaactaaatattcaatataataaagccatttggccaggcatcgtggctcatgccttgtaatcatagcactttgggaggccatggtggaaggattgcgtaagcacaggagttcgagaccagcctgggcaacatggtgaaaccacgtctctataaaaacagaaaaattggcagggcatggtggtgcatgcctgtagttccagctactcaggaggctgaagtggtaggatcacttgagcctaggaggtggaagttgcagtgagctgagatcacgccactgcactccagcctgggcaacagagcaagactccctctccacaaaaagaaaaaaaaaactacacatcactgaaacacaagtactgttggtggtgcctgatatgcctctgcatatgagaggcaaccaagcatgaagcatagtcagaacatcatttgagagccatctaatttgaggtaaacaagctcatctaatttttttttcttttttttgagatggagtttctccgtctctgagagtagagtgcagtggcatgatctcggctcactgcaacctctgcctcccgagttcaagtgattctcctgcctcagcctcctgagtagctcggattacaggcgtgcgcaaccacgcctggctaacttttgtatttttagtagagaccaggtttcaccatgttggtcaggctggtctcgaactcttgaccccatgatccgccgcctgccttggcctcccaaagtgcttggattataggcgtgagccaccacggccagcctgattccatatatgtgtatacagcgtatcttccattatattatttttttagattttgtttttgaattttcaatatggaatcacatactaatatatttttctaggcacaagtcttactgcaacaaatcctgtcgattcttacataatcctaattatttcagtatactaaaagtgcaaattacctttattcctacaggcaaaactagggagggaaagaatatcccaaatccatatggtggaatctaatccttaactgtgctgcctttcctctatcattcatttccccttcacaaagctccctccacttcagtcaagatcatttcctcaagcacactcctgtctcagcatctcaatcatctcttcaagcacactcctgtctctgcatcttggctcacacaaatacccttcttaaaatccactcttccttgatctgccattccttcaaggtttatctcaagtgccacatcaaaagcacttaatccagttctgggcacacactgcgagcatgctacagtagaaacaaaggatttgaagttaagcttcagtttcaaaccaagctctgcaatttactacacgaccactgggaactgactcagccttgctgagtcttgtttcctcatctgcaaagcaggcaaaataattcatactgcaggcttcttagaaacagtaaaagaaaaaaaaacaaatattaaatgaaaataactggaaactgccaaagacagttatcagcagacaataagatttaatatgcattaatacctttttctctacaaagccttatttgactacccaaaccaagtgatcattctgtcctaactcacaagtaatgaatcacatctatcttgaaaaagtacatgaccaacctctcagattgttcagggtactacccctattcaatgtgatctttcaaaagatttcattgtatgttgcttacctgtttatttaagcctatttactgctgtgaatagcatttctacttatgttttatcaaagcaacaagcaaccaccagtaaagaccctgaaaagagaaagccacaaagaaagtttcttcccttaccttgtgagttatccattctcgtccatactgatacacgttgttagccgcagaattcagggctctttggactacctgagcctcaggaagccaactaatgtaaaacaaagaaaaaaatgaaaaaagtacactttctgtgtagtgtaccaataatgctttgaacttgatatgcttaatccataacagacagactgttgatcattcaccaatacacagataccaaagcatcatgagcaggacttccaggcttaactgtcctaagtctctaacattcaggatgtcctttcaatctttccttagcttttatttattttattttatttttgagatggagtttcactcttcttgcccaggctggagtgcaatggcacgatctcggctcggtgcaaccctgcgacttccacctcctgggttcaagtgattctcctgcctcagcctcccaagtagctgagatcataggcacgtcaccacgcctggctaattttgtattttagtagagatagggtttcaccatgttagtcagactggtctcaaactcctgatctcaagtgatccacctgcctcagcctcccaaagttctgggattacaggcatgagccatggcaccaggcctcaatgtttccttagcttttagacccactttccccacaacctccctttcattctactctgcctggtttctctgttcacatgtcctgagtcacctgccttattcagcaccaaagaaaatggttctgggagactgggatattcaacatctgggacagggttctcaaagtgtggtccacaaaccagcagcatcagaactttttggaaacctgttagaaatgaaaaattgggggcccaaacctagatctactgaaaaaggaacacgactagggcccagcaatctgtaccttaacaaaccctgcaggtgatactgatggcatgctacagtttgagaatcactaatctaaggaagtgaagaaatcagaaagaatgcaggaaatgaagaaggtgaatcattatcctcaagttggttatctactgaagatcttttaaagatagaattcctgagcaaagttccaactatgcaaggaactatagcccacagctttacttgttgtgcagtgagaggtggcctcctcattcttctgttgactaagcaggctgtaccatacaccttaatcaagaatcctttacacaatcctaatgttttccacaagagaaaatatgttcacgtattatctaaattgttcctcttaataatatacgctggagatgttgacattcacaaatttaacagtcctcatttcaactattccagagtgaagccaaaaggtgaaggcaagcagaagctagtcatttactttcctgaggccccaaaatgacacatcctacaaacctaacacaaaagggtcaattaggtaaagtcaaatgtgcaacatcctcaactcacagcaactttatgtgctgtgtatgagaaagatggtcataaagagaaagtcagttgccactgacagccacaaagtcatggtgcctaggaaagtggtctttaaccagaaaaaaataagagatcttttgaataaattaaaaagtagactattaaaccagtagtgggttgaatcttaagtattaaccagtttgtcccacactccaaataaagtatctgtgaaacttcttggcaaatgcctcagtccactcaaacatttctcagcaaggccagcacgctggctcatgcctgtaatcccagcactttgggaggccaaggcaggcagattacttgaggccaagagttcaagaccagcctggccaacaaggcaaaaccccgtctctactaaaaaatacaaaaattagctgggcatggttgcacaaaactgtagtcccagctactcaggagcctgaggcacaggaatcacttgagcccaggaggcagacgttgcaatgagccaagatcataccactaccctccagcctgggcaaaagagcaagactgtctcaaaaaaaaaaaaaaaaaaaaaaaaaatttctcagcaagtaagacaaaatttcaaacgtttagagacacaaatataataatttacagtataagcatataaacaggaaatctgggtcactaaactgaaatgtgattcgggagaaattaagtagcttttaaattactcttttatacattcatcagtggcttgaagggactgctaaatattttcaattatatggtaacttataattgatattatattgatatattggtattatattgatattatatattataatgataacactctcctgtagtgttattcaaaagtgtgaagatgggcagggcatggtggctcacgcctgtaatcccagcactttgagaggccgaggcgggtggatcacctgaggtcagtagtttgtgaccagcctggccaacatggtgaaaccccgtctctactaaaaatgaaaaaattagccaggtgtgttggtgtgcgcctgtagtcccagctacttgggaggctgaggaaggacaattgcttgaacccaggaggcagaggttgcagtgagccgagatcatgccattgcattccagcctgggcggcaagggcaagactccatctcaaaaaaaaaaaaaaaaaagtgtgaagattcatagaggtatctggacagatccttaatgattcacaaatgtctattgggcctgggaaaacgtcttattggccactatgaaaacactttcccaatgtactcacacaggtttcctaagagcaacaaatgagaggagctgttttggggacaaggtagaggtactggctcagtcccagcctccctcaagagacatggggccagaaacacaggagctgccttagctgggctgtactccggccttacacctctacagcccctgaactgagctccttccttggagattcactgcctcagcctatcactaactcccctactcactcaagagggatccctcagcagaaaccaatgccctacagtttagactggtctgccttcaccttcctgggtaaaggttaatctctatcacctactacctaccaagagaacaaccctgattaaaaacaacttagtttagcctactgggtttctcccaagtaagcgaagggataagtgcaactgagaaccatttcagtgccatctcctaatgagggtcctgaggcacaggaatcaacaggcttgagacaagtcaggagaaagcagaaaatgagctcccgactaacaactgccgaagacaagaatcagtatgtataacatcattattttctttagagctccactaagatgatcctaatctgtctaatttacccaccagcttacgaggcacatccagcagaagtcaagggactacatgggccatataaaaccacaccaagttggaagaaaggacatctggacttattcttaactgtatcttctccactaggagtatctacatgaatcccctacaaggtcaactgccctcctgctgacagaatccactgagtactgagagatgcaggaaaccattatcattatttcatgccgacccctactatttccaatcccatccccacctatctgctgaaaaagaatcagaccttctatgaatcaccaaagtctaagcaacttcaaaaagccttccttggccggacgcggtcactcaagtctgtaatcccagcactttggtaggccgaggcaggtggatcatgacatcaggagatcgagaccatcctggctaacacggtgaaaccctatctctactaaaaatacaaaaaaaaattagccgggcgtggtggcaggtgcctgtagtcccagctactcgggaggctgaggcaggagaatggcgtgcacctgggagacggagcttgcattgagccaagatcgcgccactgcactccagcctgggcgacagagcaagacaccatctcaaaaaaaaaaaaaaaaaggccttccttttgggaggccaaagcgggtggatcacttgaggtcaggagttcaaagaccagcctggccaacatggtaaaaccctctcttactaaaaacaaaaaacttagccaggcatggtagtgcgtacatgactgtaattccggctacttgggaggcacaggaatcgcttgaacccaggaggtgaaggttgcactgagccaagatcacaccactgcactccagcctgggttagagtgagactctgtgtcaaaacaaaaacaaaaacaaaaaccttcctaaatggaacattaattggcaataaaaaagaacaaacttgatacctacaacatcttggatgagcttcaagagaattatgctaagcaacaaaaagccaatctcaaaaggctgcatgctccatgactggatttacgtattattctcaaaatgattttatagctatggagaactgatcagtggttgctaagagttagggaaatattgaaggaaagggtagaggatgggtgtggctgttaaggggtggcatgaggaagcctgcaatgtaacagttatgtactgagtgtgttgatagctgacatgaagctacatagaggatgaaatctgaaggtcagtgtattatagcaatgccaatttcctggttttattgtactatagttatgcaagatgacaacactggaggggatggggtgaagagtatatgggtcttccctgtatatgtctttgcaactccctgtgaatctataattattacttcaaaatttcaaacaaaagacaaacctttcttctactacctgatctggggctgctcagattgtgtgcctttgatacagttgcagagagaatgctgctactattcaaaaccggtacaaaagggctctgcattgacttccagtacagaagaatgacccaaagaaaaggagccctctggatgtgagggctgaggctgagccctagaggacaacatttggaaggtctatcatcctatgaaaggctctatccacttgcctagatcccaggtggctccttcctaaaatcccatacctgatacatgttggttcctcctttttcccattctccttttaaaatgtattatatccaaagagccagaggacagaagacctcacttcttacttcaaagatgtatggcccctaatttcccgccttccccgctccactgaactcacagtatttatatccatatccattctgacctgctttccccagctgttccattcgtgccatggattcatctcatgcttcatcctcagagaaatgcactaagaattatctctctcctaatatttacaaccccttccactctaccagttctttccctggagcatacaaacaaggcttctccatcttaaaaaattaaacaaaactgctctatacctccttcccagctacgttccataggcaaacttgggaaagagcagtctatacctgctttctctagttcctcgttcccaataatttctcatcacactgcaatctaatgggcttctgctacaccaattaaatgaactgctcttgcagctgctaaacccaatttcactcttagaaaatttctgcagcaatttgacattgctgaccactactactgtctcaaaacgttctctttccttggttttcctcttacctttctcatagcccattctcattttcctttgtgaacctattgttttttgctcacccttaaaggcttaagatatccacagggcgcacctccagacatcctctctgtaccttacatacattctttatgctgatgcttctcaaaactcaagatccaacccagacctctcatctgattcctggacttacacagcaactgcccattttttaacttcaccccatctctcctgaaccgcatacctacatagtcaacagcctactggatgcctctacttacaacagtcacctcaaactcaacaggtaaacaggggaattagtttccctaccaaatctgctcttctatttcctgtcttggtgaatccaccatcactcactaatttccaaagctagaaacataagtcatgctagatttcttcctcctatatccaattaatcaccaactaacccccttaagaccttataaatctgtccctcctgttcacctccactgaaactgtctacagttcagggctttgtcacttctcatctggtttactctagaagcttttaatttgtctcaaaggtttacatcttgtataccttcaatcttttctccacaaagcagctgaaaagcctgttctagaatgaaatatgatgattctacttctctacttatatccttaatcaaaataataaacatatctatcactcctaaaaatttccttgcacctatatgtatgtcctccctagagctccaccccaatccacaggcaaccattaatcttactgtcactacagattagtctgcatttcctagaactttaaataaatgaaatcgtaccatttgggctttttgtctgaattttttcactcaacttacttttttattgttgtttttttgagacatagtcttaccctatcatccaggccggagtgcagtggtgcaatcttggctcactgcaacctccgtctcccgagttcaagcgattcatgtgcctcagcctcccaagtacctgggattacaggtgtgtgccacacacccagttcatttttgtatttttagtagagatggggtttcaccatattggccaggctggtctcaaactcctgacctcaggtgatcctcccgcctcggcctcccaaagtgctgggattacaggcgtgagccacccaccgcacctggccaacatacttattttgagagtcatccatgttggtacatgtatcattagtccattttttttaatgctgtataatattccactgcataaatataccacaatttatatttcaaaagaaatatacttcttttatgaagattcaaataggccaggcacagtggctcatgcctgtaatcccagcacttcgggaggctgaggagggaagatcacttgagcccaggtgttcaagaccagcctaggcaacatggtgaaactcctacaaaaaatataaaaattagccgagtatagtggctcatgcctgtagtcccagctactcaggagactaaagtgggaggaatgattgagcccaggagatcaagccttcagtgagacatgattgtgccactttaatctagcctgggtgacagagcaagaccctgtctcaaaaaaaaaaaaaaaattttattctaaatcaagttcaagtaatgtcctaggcaggttttatataaaagaataaagtagaggcaaaggaaaaaaatcaacttaaatctcaacttataagcctaaaactggcagaatatttcctgacttatgactgtcttgaggttaataaaaggcaggtcatacaatgtgtcatcaagttgttaggtggataacacagctctgctgaacatcccccacaaaaactgaaaacccttcttccagaagccaaattacacagagatcctataaaacagaagttggcaaatttttctgtaaaggactagagagtaagtattttaggctctgcagaacatataatctctgccacagctactcaattctgtttgtccttgaagccccaaaacagccagagaaaatatgtcaatgagtagacataggtatgttccactaaaacttcatttaccaaagtgttgggaaaagggcttgtggggtgcctgtataaactggccacaaaaatatgggacaataagttgtggaaagccatgagaggcctctgagtagaaaagtctccgaattgccatcatgttcccatactcagagcaagacctgctctcttatctgtaaacactgtgttcaaggagaaagacactcccttgaaacactggaatgtggacagatgtgcaggctcctagttaagcccgctcccactagctactctccaacaagttaaagatatgctgtttgagcacaaaggagattgatttaaaccgctattgctatagattacacctatgatgtactgcctccctttcagtgttttcaccctgaacatctgctttttagatctaagtgattacactcaataaacagtgtggagaccagagctcagcgccttttgcagcctccattatgcaactggccccgactcccaccttcatgaactcttaacctgtacctgtctcttctcattcctttgtcgccaccgaacttcaggtaccctacgggtggtgttgaggctggtccccaacacaaaaggaggtggctgaatttggccctgggccatagttcacctatccttcctcaaaaataatacaatatgggaatatgtcaataattataaaactgggcatggtggtgtacacctgtagtctcagctactccagaggctaaagcaggagaactgcttgagcccaggagttcaagatcagcctggacaacatggtgagacctcatttcttaaaaataaataaataacataaatttaaaaattatatagaaagttgaggagttacagtttccatgttatagtggaaactttccttcagttgatcagaagcagtggttataaatgactctgccactgcggaattattatctcaagttccttaacctttgatcttgtttcctcatgtgtaaaatggggataatttcttcaatctatctcacacagtcactgtgaggaacaaatgacataagacagatgaagtgctttgtaaattataaacatgctgtaaacctcaattataaaacaaagtatcatttaccatgaattgtacctaaaatcctgagcactttcctcccaccctctgtattacatgacattcttcttcaaaaatgacaatatttatcaaagctctggcaaaccctatcttttatcttccaatgcagctgcatcaatgaaggtcatttcgtgcaaacagatgctgaaactaggccattcatctctcttctttttcaaaacaatattcttactttgcccactcagggtgatttgctagagtttcattaatcaaattacttgtgacttcaatcatgtgtacactctcttgatgtacctgtattacagataaagaaagaaaagaatctcagtaaaaaataaacccaatttaacatttatttttctactctattattggaacaatgctttgagagccaaataaatacacatctttgctttaattaatttagaaacatgcagcgcaaagttactatacattatatctaatgatacgcactacgggaaataaaaagtacatgctagctccctgttcaacacattacttaagaaaaaaatacataaatagatatgttcaaatacttgacacgtatatgtacatacatttcatttgcatgaatatatcgtataaatgtgtttgtgtatctatgtaagcaatatcagcactttgtgagctaacaggttcatcacgcagtgtgagacaaacaggcaaataaggaactaactttttttttttgtttttttttttttttttttagccaggttctcgctctgtcacccaggcttgctggtgtgtagtggcgcaatctcagctcgatataacctccaccccccacgttcaagcgattctcgtgcctcagtctcctgagtagctgggattacaggcactcacaaccacgcctgtctaattttgtatttttagtagaaaaaaggttttgccatgttggccaggctggtcttgaactcctgacctcaagggatctatccaccttggcctcccaaagtgctaggattacaggtgtgagccactgtaagtaaactgcaactaagtaaggtttctgagtaaaaaaagccaacagaagctgcacctctgaatttaccttgcccaataaccaacaaattgagggagataaaatgggaattaatcagttgaaaaaaaattttttcacccaggacatccaaacaaggaaagaaacataatctgatacaatttggaactcagccatcaggtaaagaaacaaaacattctggagcacaacagagaggcgtaacagctcactcctaaactgaccccatcacccaggagctacacaggtgagctgacaaatatattacgattcacgagtaacagggagaaaagaagccacatcgttatccttttctgatgacagagggaaagaaagtgtaatgagggagaaaaggataaatcagaggaaagagatcaaagtcccccacccacacccacccctcatctctgtccctttctgcagtgaaagttccatagtatgccaggaattgagtgagacagtacaaagactgacggtatttttccatgggcatgggtatgagattaaccaagtagcaaaatcactagggcaagtcacataccaacccagaacagaacagagtctagataccctaacaaagatacatagccacctaagccatcaagtgataccacttccaattctatcgggccccagaaaagtaggaagaacacaaaatacaaactgcaccaagacggggaaaacaaactgatttcagacacaatgaggggataatcaactcaggtgcaatgcctgaaaaacagccagaatgaataaggcctgacacgttcttgtgaggacttaggctagcattttgtgggatatggaaaaagagagggctgtaagctaagggacataatcttacttagatgtttaaagtaagtttggacgctgtgttgaaaacagactaaatgaggctaaggaacaattcaagagagaacggggatagctttgagcaggacagtagcggtactgagaaagaagtgactggatttgagacctatcttacattaaccaactgttggatgttaaacgggttttacattcccgaaataaacctcacatagatatattttcctttttacatactgcaggatttaatctgttaatgttttgttaaggatttttgtgtctatttataagggatactggtctgcagtttcccttctgtgaatgcctttgactttggtatctgggcaatactagcctcataaaatgagctgacaagtgttacttctttgctaactgaacaacactgtgtagaacaggcagtatttcttcgctacatgtttgataaaactcatcagtgagatcatctgggcctgagcgcttcttggtaggaagaatttcaaacactaattcaatttcttgtcctcatagtgggctacaatttttctatttcttcttgagtctgttccactccttctctacaaggaatttctccatttaatgttatcaaacttgatggcataaagttgttcacaatattcccttatcctttcaagatccgtgacatatgcagagatgtttcctcttttgtacttgatattggtaatttgtatcttcttttttcttcatcagtctggctaaaattttgtcaattttattgatgtttttcaaagaaacagcttttgagtttattcatgttttcactattgtttctccttttcaaatttccttgatttgcacctgatccttattatttccttcctttcatttactttggatttaatttgctattatttgctagcttctgaaggtggaaacttaagtcactgattttcctttttcaaatataagcatttaatgacataaacttccaacaagacactgcttcagctgcatcccacaaattttgatatgcagtggcttcattttcttccattttaaaatcttctaatttcctttgaaatttattcgattcacaggtttagaagtatgttgcttaaaagacttagaaccaacccaaatgtccaacaatgatagactggattaagaaaatgtggcacatatacaccatggaatactatgcagccataaaaaaatgatgagttcatgtcctttgtagggacatggatgaagctggaaaccattctcagcaaactatcgcaaagacaaaaaaccaaacaccacatgttctcactcatagatgggaactgaacaatgagaatacatggacacaggaaggggaacatcacacaccgggacccactgtggggtgggggggaggggggagggatagcattaggagatacacctaatgtaaatgacgagttattgggtgcagcacaccaacatggcacacgtatacatatgtaacaaacctgcacgttgtgcacatgtaccctaaaacttaaagtataataaaaaaaaagttaaagttcttattttaaaattattaaaggctttaactaatgttatatacaccccttccccgccaaaaaaaaagtatgttgcttaatttctaaatatttggacattccctaaatttctgttactgatttttaatttaattctgtgtcaggaaatgctttttttgtttgagacagtgatctcgctctgtcacccagcctggactgcagtggtgcaatcacggctcactacagtctccacctccaaggctcaagcagtcttcccacctcagcctcctaagtagctgggactacagaaatgcatcacaatgcccagctaaatttttaaattgtttttgtaaagccagggtctccttatgttgcccaggctggtctcaaactcctgggctcaagcaatcctcctgcctcagcctgccaggtagctgagataacaggtgtgtaccactgtgccttgcctaacacttccaaatttattgaacatattgtttattctggtgagtattccatgttttcttgaaaagaatataatttttgttataatattatatatataatataaaagaatataattgttaattaggtcaagttgactgaccgcgttttttggcgtgtttcgtttttgttttcttttgagacaaagtcttgctctgtcacccaggctgacatgcagtggcacgatcacagctcactgcagcctcaatctcccgggatcaagcaatcctcccacctcagcctctcaagtagctgggactacaggcttaagtcaccatgcccaactaattttttctattctttgtagagatggggttttgtcatgttgcctaggttggtcttaaaactcctggagtcaagggatccacctgcctcatcttcccgaagtcctgggattacaggcataagccaccacacccagcttttaaaaggcttctaaatatccttattattttctaactacttattccctcaattactgcaaggagtactgaatcctgaactataatcatagatttgtttatttctccttttaattctgaatgttggatttcatgtattttagagctcagctgttgggagcatatacatttgtaactgttatcttatgtcaatattaactcttatccatatgaaaagtccttaatttgcctctagcaatatttctttttgacaatctattttgtctaatatagaatcaactgcacatattttctgtggacagtttgcacagtgtatgttttttaatatttttactatcaaccttcctgtgactgaatttaaagtgtgtctctaacataccaaaagcaagttggaacttgctttttatattcagtctgacaatgtatgctttttgactgtttagttgcttctcgtgtaacctaagtattgtcatgaccagggttaggtctgccattttgctactagctttctatttgtcccatctctattggtcctctgttgttcctgcactgccttttgtgttcagcaaattttagtataccattttagttcccctaatccttaggctatttattgcctgctgtttaacttatctaaatcttatctcatcttttaatttatcataatctacttcaagttaatattgacttatatccaggaaaatattttaagaacttcataccattacagttctacttgccagccctcttctttgtgctatggttttacatatacatagctcatctatatatgttataaaggccacaacagtatttctatttttctttagtcatatttgtttaaataaattaaaagaagacaggggaaaatataacccacatattttccaagtgctttcatccctttctttggatccagattatttctggagtcatttatcttcaccccgaaggagctctgttagcattccatataagtgcaggtctgctatcaacaaattcagtatctgtttatctagaaatgttttcattttgcctttactttgaaagaacagtttcactgactataaaagtattgtttgagatttctccctatgactttaaatatgtcactccaatgtcttttagtctttgctgtttattaagagaattaagtcactaactgtattgttcccctgtttgtgatgtgtaatttttctcttgcttccttccagattttctttttatctttgtctttcggcagtttgactatgatgtagctaggcatggttttgtgtttgtgtatgcttattctactgaaggtttgttgaacctcttggatctgttaatgtttttcaccaaacatgggaaagtttttagcagttatttcttcaaataattttttctacctttttctcttcctcttctcatcttctgggatgcttattacatgtctgctagatgtttgatattgtcccacaggtgtctgaggctctgctcatctccaattggacttgacaccaaaagcacaggcaacaaaggcaaaaatagacaaatgaagctacattaaacctaaacacatctgtgcactgaagaatacttccttcaagaaaagctgcaggttttactgcccatgcaagaatgtcacctgtttttacctgtaaagaaaaagtacctgtttttaccagctacagtagcagcttttcatcaacgaaagatctcctagttgcctacctggtcattttctaatgcttttaaatggtgtttttaataatttcatgttgttttattcttgatttctgtggaaaggaattacctgacttcctcaccctgctattatcccaggacatattaggaaggtggagccaaaaaggattttctggcaaactggatgtggatacaaaacaaaaacagtagtcaaagatgatcctgagactttccatttgagcaagcagaagaatggagttgtcactgaagactatgagaagaacagacaactggaggaaggtctggaattcagtctctgacgttacatttgagatgtccattaaacattcaagtagatactgtcatggatgtttcagagaatgacagctgtactggccaggagaatgaattagataaccaataaggttccctcaaaagctcagtttggatgaattctacacccagaaataaatggttcagtaatacttgttatcaaagttcagagaagcaaaagctcactgaagcaggggatgaacaaagaaaaaggacttaaaagataaaactgagatggccaggcaaaagatgctacgcaaagggaccaagaaggaaaagtagaatagaagtgtagaagagaggagaaaggaaaaaaaaagaccatactaatgaaagaactggaatgtaagattgcacagtagcaggtttaagcaaaatatgacaaaaagcctctaaataagtctgcacagtatatatacgtgactatacataattaatatccaaagaacagataggaactatacaaagactgaaacagaagtactagaagagatttttagaagcaaataagatagcttgagggtgtactgaagctgagactaagaataggacttccaagcagagatgccactgaagaaatagtgcagttctttagcaaattggttaattagattatcaattatagttaccaacatgtctctatgggaactaaaggaataaaaaaaattttgtatccatgatttcacataagcttcaccaactccttgaaaagaacataccaaaatctgggttgtggagttcaatacggttcagataaaataaagattaaaatgtaccataaaagtgggggggaaatcttgtcagacttgataagcctaaaaaaaatagtaagagatatcactataaagataacattttaggtgttctttagagaataattttctttgatgagatgaaaatggggaaaggaaatgtaagctggaaggacctggaaagcgagaaataaaggtgctatggtatatatcagcagaaggatcaatgagacaaggatggaaggtggtaatcagcaaattctgatctagtgaagaatactaactagattagaattcataagaccagatcctaattctcctattaaactaaaaaaaacaagcgccacttgttcttcattatctcatttttttcatttgtatttactcccaagggtttcgataaaataaaaatgcatgtaaaagaggtctgaaaagaaaatatactaggcaaattcatggcaaaattagtaatatacaaatcataaatcctttagctattgtacatacttttaaatcaagttaacattttccatgccccttctgctagcttttaatccagactacaattctaacaattaagggtttattaatgagaataataatcactgtactctacctttgcagtcaggagtagggctaaaagaagagttcctatcactaacaaaaatatgatgaaaatgctaattattttatctaacatcttctccaaccagatgatcatctgcacaaaaacgaaaaagagaattacttatctttaaagtagaactttaaaaatacatatactcaattgtcataaagacaaaacaggatctccagcatggcaaagcaaattatggcataataattaaagcaataaaagctttaagcaactttaaaaacttcacagtactcattactgctgttgttatatagtttattactgtcatagctaagaaaaaggcagtcgatttcaacataatccatatctatgttcaaattctcaaactataggatatctatgtttcaaattgtaatttataacctggtaagtattctaaacaaaatattgacaatccattagctgacctaaaatcttatgaagctgtatcatcagtttaacaaatacacacgactttagcaaaagtatatacagatagtatttataatacttataatacaggcatggactaaaaaatacagataaaattggagcaaattaaaagaggagttgcattcaaaatattttttccatttgatatcattagaattacaaaagcagtaataaaaaaatctaatgttaaggcaatgacaaataacaaagataacagttgcccaaggagcgaggggttgggaggtgaatgcacaatcaaggaggggcacaaaacagccttcaggttaatttgttttattaaggggggagtcattggtagatagtctttacatctttttatgtttgaaatatttcataatacataataaaatgctttttaaaatctgatattctacttgaagtttctattcttctgaaaacataagctttatgacatgactataattgatataatcaatgtagtagctgtttcttaatcagttattaaaactgtgctttccctaaatgctatctgacattatcttgctataacttccttcatctttcacaaccacaaataatcctacattttaaacaacttgtgttttcagaatatatacttgatagattgctagaattcctttcatgcaaagctaccatctaacatttcaaaactacatttaactagattaataactgctgaaacaccacaatgcactgctcaaccccaaggtgagcaacagcattgctaaataagttattcttaatttagatctgatttatgctctccagtgaattaaacatccaaaagcaaagaatgttggttaaaaaaacaacatgagttctgcagcatttactttcacttgacgtttataagcttgtgccccccttatctgtttttcatcaagggcactgtcactaagagatcaatgctaaagtgaactcaaagataaaaagttaatctttaatcttgacaattacagcttcaaacagaagagttaattttcagtgcatgctaccaaggcatcaaagacaatgcagagacttaaaaaaaaggaataacaggtttctaagatatggaaggtcagatgtcatattctgaagttaaattctaaaatcaatgaaactgaaaactttcaatcagaaaccaattgaaaactagttatcaaggcagcttcctggggaaagagctaggtttgtatcactcctctttgtatctccaaaatctaagtgcttagcacgtggtaagcattcaattactatgtgtttgaataagcaagcataaataaaataatttcagaattaagactgtatttgtatccacaaattacaatttctgaaaataatgtagagcctctattttttttttttcagaaaagtcatatcctgaaatgtatttttaaatgtaaatgatattctacttagaaacatgtttgagtatttttaacatataaaacatagaatattcaaaaacatattaggtacattaacattacaatatccaattttttagttttaagttagggtaaaatttttctatcacaagccataaaggttgaaaaaaattcagtcacctaaataaaaacgtatatccaagggatgacagtgagggttggatgtttcattgaaatttaaaataaacaaaattatttaagatgctcaaaaaagaagctaagaagttgttgttttcgtcacatgtggccagttaagttagctgagaacaggacaagaagggagacagtaagagagaggaaagagtgggaaagagaaacagagactaagatttattcaagaataaaaggaaacagagaaggtcaagcaaaaaaaaaatgggggcacggggagttgatacataaaactaaggacgaaaagaggaaaaaaagtgaagaggataaaaaacttagatggaggaaaagatgaaccaactcccacaaagactgaatagaaaaagactcacaaagaaacagcaactcggagagataggaagagaaacataaagagaggaagcaatggagaaggggaccaaaggccagacgtgctatctcacgaggctgatcctgtcccacgttctgctttgggcaaaggaacccaatccacctgccctcgcatggaaattaccaagtctctaaatgtccccaatctttccatgctgaaagactgagaagttactttaatttttaaagtttatttttcaaaaaaagagaagtaattttaaaatgacattccgaatgtttcaaatgtgaatgaagggcatgcattttttaaatttagagatgtcagtaaatttatagttacaccaaaagatactctaaaacttctacactaactggcctatttatcaagctattaagaaagtattccactactgagtttttcttctctttcattattctgggcctatatatttttcattttgctttgtttttaaacaaaattccacttgagttttagtgcaaataatcaatactaagaaataaaacaaagccaggtgcagtggctcacacctataatcctaacactttaggaggctgaggcaggctgatcacttgagctaaggagttcaagaccagcctgggcaacatagcaaaaccccatctctactaaaaatacaaaaaaaaaaaaaaaaaaaaaaaaaaaacaccaggcatggtggtgcacacctgtggtcccagctacttaggcggctgaggtgggaggattgcttgagcctgggaggtggaggttgtgtagtgagtcaagatcacgtcgctgcactccagcctgggtgacagagtgagatcctgtctcaaatttaaaaaaaaaaaaaggaaaagaaataaaacaagtaactcttgagaaatgggttacatttcaattaacccatgtgtgctctctcaccctctcttctcttgaattggtttcctaattcactccacttgaaatttctacataccaacattacccagtgctgcaattttctgactttgagatgtaatgtaataaaatagttctcaacttatgtatgtcctttcttggaatgtacccgctcaaaatctcaagcagttactctatctttacaccaatgctttactatgttatatggaatcatcaaaggaaagaaaaaaaggacttgatcttagagatcttttaaaattaactcgatgattcagttatgaagtagtctcataaattaggtaatctagctcatttagtccactgaaggttaaatcaaatttaatccaatgaatttaattctcctttcccccatctcttgagggcaatttcatttcaatataacacaaattgaagaaaagtacaaaatcatcgcttgagcccaagttcacagttgcagtgagctttcattgtgccactgctccagcctgagcaacggagcaagaccctgtctctaaaaaacaattagaacaaataaaaattttttagaaaccacattctttggtcaaaattttaaaacgtgacttatatttgcacatcatttgccaaggattgaactcacttacccatactagttttatagggaatggagacatacacaaccatgtgagagtgtgggagtgtttattttacacaatgcttcctttcaactcaactttaaaactttaggcattgtcaagtctcccctctcctctatttcaacagaaaaaaatgaaatcctaacccatccaaaagtctcattttgatctattttcaagaagtactacatctttcttaaggcctgatataatatttccacaaaagacatatatatagttttattatgtttaaacacaacatatataaatgatgtcatctcttgctatctgtcctagagattcattgaaattattatttttttaagaaacagagtcttgctgtcacccaggctggagtgcaatggtgcaattattgctcactacaaccttgaattcctgggctcaaacaatccttctgccctagcatcctgggtagttaggactacaagtgtgtgccacaaggcctggctatttaattcattaaaattaatttaaacattacgatatgtggactatatgtcgaggtacaacattcctaatgtatctggattagcctttattgaagttattaaaagtgtgcctattataatgccataccaatcatgtgaagcatttaccatagacacaacctcataccttggagaaaacacaaaattcgatgtcacaggtcatgactactatctgttttaagttaaaaataaattttgaaatactagttatttaaaaaaagacaatatataaaattatctgccaaggaaaccatacaaatatttcacagatttgtctttttaaaaaattcctgtgtcttttatagaaaaagtatcaaacagagagttctctcttgcccttacaataactattgcctaatgtgttttcacacatcaaaggagactagaatatcaggctgagccacatttacagaactggatttacaggggacaaaaggactatgagacagaacttcttacaaacacctgagcaaggagataccatccatatcctagacagcctttgctgagtttttaccaaattatactgtgatagtattcatgcttcacaaccttccatagcttataattaaaactttgaaaacaaaaacttagtttgacacatggacagaaacatagagtgaaaaaggcgatacaggggcattacggaattcaatagtaaaaaccaacatctgggtgttcatttaccttcttatttagccagtgccagagcttgaggatagggggtaaggtgagaaagagaagataagaacagtggagtatcattagagaatgcaaccatagtatgaaaagaaaaggaaagcatgagaaggaaaccatcccagacaaaggaaaaactagggacggaaaaactgtaacacatcaaagttttaaaatcaacggaatgtagtattcctttaagatatataatgattgaaatgatgataaccacatctttgttgggaatccaacaattaaaaatacataaaataacctgcatgctcgtaggcttagtgtctccatgcctttgcactgctccgtctgcttgcccttctggccatgtctacctaagaaactcccgcctgtgcttcaaaacttgctccagtatcacttcctctgctaaccttccctttctcatgaccctatgaacagtgagtcatttcttgctcagtgctgccactgtatcccatacacacttttcctacacaaattcctaatacttacatagagctcactgtgtaccaggcaataatctagggattttacatatattacctcatttaacccttaccaccattctacaaggtaggtgctattgtacctattttactggtatggaaaccaaggcacagaaaggttaggaaacttcatggattcatagtccatgctctttaaccactaaggctctaaatctaaccgccatctctgaatttttatcaactgctgtctttccccaataaacaaggcttctgtatctggttttccatgattcatctgattttccgtaggacttaatacagtatctgacatatggtaattactccaaaaatattcactaaactgagccactacctagctacataattttaggcaagtcgcttaacctctctggatttcaatttggtcctaatataatgaaggaattaaatcagaaaatccatttctcccatttttatgaggaaaaaatacttacacaagccttatttaaagtaaacccatcttatccttgtgtaaaccataattttaaacattaaactttcatcatagaattagatattacatgtgttatcaacagttacaatataaacaccatagaatggaaaagttcaaaccacgaaatatattaactccattaagacagcccaagtccttaaaatacaataccttgctatcaacttttaacaagaattttccaagcccgacaatgggccaaggcgcgagagctccctgccgctccttcaggaagctttctataatgccccaccacacatggtagcgtttctctaggaaatccacaactccaaagtgaatgacaagctttttgagtatccagactaaaaaaagacaaaaaatacatatataaacaaaatatagattaacaagttgtaacatgaaaaggtaccttaatttcacaaaacctttctaaaacaacaaagctagtattaaaaagaagatcaatgttaaaaagcagggtgggactcaaagtactccccacacagatggaattggaccaagtaacttttcaaaccatccccacctgcctatatattatcttcttcctgaagtctgaatccttgtagagtcagggattattttacagcccacataaacaaaagataatctcatcgtgaagatttcagtgactacaattctggccccttgcatattcccccttcctgggtaaataatacaaacccctgacatttcctcatctccttggcttttatagctgttcttgtcaaatattcttcttttccttagttgctcgttatttagtgaccagaaaagtataaggtattccatacgcatcatgattttgtaccactgcagagtaatgttgttcctatttccccatttgatgctgctctcaacatctgaacagatgccagggttcagtagagaagcaagctgaatactagcagggctgctacaaatggcccaaggctgtgcacggcaacttcagtggggaccactctcaaaccacactgtctcctcctggagttgggcagtgaagtggctctttaagcagaggttaagcttcctgttagaagccaattaagaaggtggtagggccagaaagaagtgttactcaactgtgaggcttgccttcaagtttggaccctgtatctcaatcagtacataatttccctaactctagagatttgtgttcttagctctggccttgcaacctaaaggttcacaatttgctgttttgaaccatgagctcagtgttacacacaagttcaacaattcctttattaccatttttaaatccctacaaaagccctaaaagaactcctatagtttcagtaagtccagggtaattacaagctgtagaaaagcttttaggggccaccttattcacagcctgctgtcccaagatcatgtcaaattcctatgatgactagaaggttaagctataactaagagaaatgaaattcctgctaacaaactttaaggaaaagagagttgcaacagcatttgacacacagtttgccagcataataaaatcatctggaaaaaaaaaagtatggaacagggccgggcacagtggctcaacgcctgtaatcccaggccgaggcgggcggatcacgagatcaggagatcgagaccatcctggctaacagtgaaaccccgtctctactaaaaatacaaaaaattagccaggcgttgtggcaggcacctgtagtcccagctactcaggaggctgaggcaggagaaagtgtgaacccaggaagtgaagcttgcaatgagccgagatcccgccactgcactccagcctgggcaacagagcgagactacatctcaaaaaaaaaaaaaaaaaaaaaagtatggaacaatctagaagagcaatttaaactgttccactcagtttaacaggaagcatggcatggtatctgctctgtgacttgcttaattaaagctgtatcttgttccaactgcctaacagaagttctgtttgaggacagaagaaccacatataggccggggacggtgactcacacctgtatagtcccagcactttgggaagccaaggtgtgaggtttgcttgagtccaggagtttgagaccagcctgggcaacatggcaaactacaaaaaatacaaaacaatagccagtggacgcacctgtagtctcagctatctgaggggctgaggcaggaggatcacttgagcctgagagatcgaggctgtggtgaatgggtgacaaagtgagaccttgtctcaaaaaaaaaaaaaatacagatacaaacttcaaccatttatattgcatgctccctgaggacaggcactactataccatgctctggtcataataaatgttaaaaaataatgcctatttaattaactatccaattgagtgaggaaaaataaaaagaagtgatgaaaactaatggtctagaaggtaaatgggctaataagtttagacttttagactacagtggagagcagcttccaaaaatcagattacgttttaatcaatagtgaaaaaccttgacataggaaatgaggagtaatcaaatgtagaaggtactcagaaggcaaaatccacagcagccactaaggacttaataaatttggcacaaaatatggctgccataagaagagagcccaaataatcaggaaaatattaggtaaaagatgtttctacaatgcacctgtcagagaaaactctcccttgctctttctagtcttaggagaaagacagttttagagagaatcaaaacaatagaggtgggccttaaattaccacagcattaagatacaaagacctgatttaatggattatggaaaactatgattccattttgatgtaatacatataatatagatatacatgtaatttaatttttctgccaaatcacaagactttgcatacatgtatttctcaaagcctacatttcctttgaattaaaaaggcaaggtaaaacgtgcttccctaagagtagcgctcaaaaatcattcaatctcagctaggcgcagtggctcactcctgtaatgccagcactttgggaggcggaggtgagcggatgacttaaggtaaggattcgagaccagcctggccaacatggtgaaactccgtctctactaaaaatacaaaaaattagccaggggtggtggcgcatgcctgtagtcccagcaactcaggaggctgaggtgggagaattgcttgaacccagggggcaaaggctgcagtgagctgagatcgcgccactgcaatccagcctgggtgacagagcgagactccgtctcaaaaaaaaaacaaaaaatcattcgatcttcaaattccaaaacacagatattgttaacattctccttcacagaatcatggatggctaaacaatcaaatctctctatggagctattaatctcaaatactacatgaaattgtaagaagctaaacacattttttgagcttaaaagtgaaatactggccgggcgcggtggctcacacctataatcccagcactttgggaggccgagatgggcagatcacgaggtcaggagatcgagactatcctggctaacatggtgaaacgctgtctctactaaaaataaaaaaaaaattagccgggtgtggtggtgggcacctatagtcccagctactcgggaggctgaggcaggagaatggcatgaacctgggaggtggagcttgcagtgagctgagatggtgccactgcacttccagcctgggcaagactccgtctcaaaaaaaaaaaaaaagtgaaatattaaagatgtatcaaagtaataaattaaccaaatggtgtttgtttactatttaaatgcaaacataagattgttttactttgcaagacggtaaatgtatctcaaatattaaaatccaaaagtaaaaaaagaaaaaaatcaatcttcaaagacaagacgagatcgtacttaaccagataacgacctgcaatcggcactggcagcaactgcacaatccacaggttcaaccagatctgcatgacgacaatggcccaaactagagacacaaagtagatgtcactagttttcttctttctaagaaacgttcctatttcaggccttcgtctgcccagagtaggtgaaggggaagtgggtgaaggggaggagggtgaaggggaggtggacaacgttggagcggattctcccctgtccactgcttctgaaaaggaaaagaaaaacaccacacaccgcattagtccacatgaggaaatgggaatacagagccactcattaggctagcctgtttcaggccttcaaaatgtgctgatatggtatgattacatcgggttaaaaaagacaaaaatatttggacctatgtttgcatatgcactgaaaaacatggagaattacaatgccaatagagctttaatttaggaagactaagttagttggtgatagaattgggagtcattaaaacaaaatacatgacaaagtagctgagaattataattatcccataaaacttattcaaactatttaaagaaacaaatgctaacatatactagaatttctatatttaaaaatcccttttctttcaatagaactttagattaggtgtatttatatacatttctgacacaagaagacttttcagtgttatttcacctaaaatggaaccaaccaatcttacaagaacccagggctttcaaacagaatatataaacatgaatgagatacaaaaacaatgacagatttcttgggtgaggattttcaaataaaggaaaccatactggattatttcacataagacactgttttctaacaatgcaaccaccatgttacattttactatagggtgctattatttctatttcctagttttaataagatataccatacacatcagaaatcataaaactcttaaagtagtattactctatatatactataataatgaaaattattaagatcctaaaacttgcattttgccttccattagaaaaaaatgttaattacaaaagtatgtcacgttgaatgtgtggattgttaattacaaaagtatcatacgtcagaaaaaaagtctagaaaaaagagaaaagaaataagaactcccataatcccaacctcacattttccccctggtcttttacatagttgtagcatgttctacttatcctttctcattctttctcttcagttgaaagtcagctccaccagagctaagaccttgtctgttttgttctccctccactgaattcctggcacatacaatagtatctcatatataggaggtgctcactaaataagtgaatgaatgacttccctgttgtttcataattttcataagcaatcatacagtagcccaccaagtgctgtatcataatttccttaagtgtttttaatgttaaaagttcagctatgagtcaatttttactactgagatcacttgcaccctggtaagtcagctcacctcactaggaccaacattctacccttaaaagtgcagggctaaagcccaagctagttaacagatgcttttgtttgactttgctctgagttatctttctaatttggaaacttcatgatggtgggtgtgacagatatttggaagaatgagtccaaaaccaaaatatcatttcctctccactttggaaacataattccatgtgcaagaaaaataagtgttcctactacaccaaattcctttatcttagctgacatttctaaagtcagttcttcaaggagaattcactctaaatattccctaactccaaatacctctggcactaatggatctctcagcacagactaaggtggccttttacattctggaactctgcaagagtacagcatgactctacagctggtatatctaccagctggattcctcaggagcctgcaattcccaaagccaggccacacaggacaacgagtccaaaacaaccagaggggtctgtttgaggggtcaatatattaacacatgaagcatgcaaactttcagagaaagaatgacagagaaatggatgactgcaagatggaaaataaaagtcttccccaaaaaaagggttgggaaaagggaacaaaagaaagaaaaaacaacaggaagagatagggcaaaataaaatcatggaggagaactgacagttgtagaagaaagaaatggaaaataagaaatcaagataagatatgcgtaaagtggagggaaatgtgggaaaggtaaatggagacggagaaaaggaaaataagaaaaacaaaagcaatgaataacagaagaaaaataagaaaagccttttttaaaaaggaaagaacaaagaaccaaggtaagaaactcaagaagttacataattacatgtatttaaaaagtgatatatgagaacaaagatgagagggaaaagggcataaaaataggaaccaaagagaataaatgaaggatcagcaggagtaagtagcattttgtgatgctggtgtcctgaattttactttctatgtacatttcattttccagaataaccttgaatgtcaccagaacatcagtcacctgcaggctgagtggagggctggtcttcactgcttgattcataccctgtgatagagatggccaagtttgccagagtagaagctgccatggagataacctgccctggtaactctgcccctgtaaaagaagcatccattttcaaaactctttaaagtaggaaataatggctgcaaatttaaacacagtccaacattttcaacaacaacaaaataaaatggttactactgacccactgaataagtggttcttcaccaaggaagaaccattaagaattgacatgaaagtgtgctaaaaaagcaaatcccttgactctctgtataccttcctcctttgggaacttaatgctggtggatgtggcagacactacacatgtaaacttggagtcccacacttacatttgttaacaagttgattttaatgcatacttctattgaaaaacactaccacatcaagtctgtgagctccctgatctgactgtcttaggctatgttgtatgactaggtctcatgttagtacgagataatccacaattggtggtcataacaacattccacaaatgagtatgcgaatatatggctattatgcaaaaccatatagatttataaattacataactcagtacaggcaaaatccaccacttgaaaatctaaaggaacatcatgacgttgtttcacattatatatttccatgttaaattcctaataggtagtaccaagctcaatcatttgcactaaattcaagtaaaacattcactggcaaaggaagtctgtcaacctttaaccttctatagcagacaaggaagaatagctcacatagcatcgggttctagcacactttcttgcacactagactggagagctaaaaaaattgtatttcttggattcccctgcagccgaggtctcacatgtgacacagtttctaccaagcaggtacacctgtgcaggacttgagagcctgaagtggcacactgtaatttgaaagccagagctcttgtatcaaacacagtcagtcaggaaggcatatggtttttccgcagcaacttagcagaagttctgatgtctgatctctaacttcacggcgagcagcagcagccgtggccctctgcccaaacagtccttcagtgtcactgagcatttctcctgattgcactgcttccacctgtgtcagattccaagattaattgtctggtctttccagaaattccatgtgcaaaaattgtaaatgctaaccaatacctcctactatttatttaaactacctggggtagattctattgttcacaactaagaacactagcaattcctagtcaccaaatcatacacccacactcatacaactgagacattacttttggtaggccaagactccgtatggcaacataggattctgtcaccccaatgaaaagagccatgatccttcagaaagccgatgaatttcagctccaagttaattaactccacatacccaaatatccaaagctagccctctcccagatagcagcaagccagagcctgaggtggatctttggtagattcagacatcaggataagagtactcaccttgctcagtcatactctgtccctcctctaataaatgcccctgtgacctgaaagagttcatttttagatagggtatcgtatctctcaatatgagagaaattcaaactcatggtctgagaggaaagcctaagttagatttctggattaggaccttactctcctggcctgtgtatccaaggtcctcctgaaatgccaataagacagaaagggctgacagagaaaaacagtgtctttcatttcttacatgtactgtgtgctggggataaagacacagaccctgcccccagggagtatagtaaaggtatgaattaaataaccacacaaataaacgtgtgtatagaaattatggttgctataaaaagaaatgctgggtatcttgtgacatcctaacaatatcttgggcagaaggaaagctgtgagaagaacccggcatattaaagacagtgaaagaaggtcagtgtgtctggaacacagacagctagtaagaaactggtatcaaataaacaaggctggagaggtaagccagatgatgcagatcacagaacaccacatgaaggactttagtgtttattctaagaggaagaagaacgcactgaagagtttcaaacaggatagtagtcttcttctcactgaaattttattgagataaaagtatactcatatgcagttgcaagaaataatcccagtgtaccacaatttgtccagtttcccctgacacaagatacagaacagcatcatcactataaggatctctcgtgttgaccttttataaccacactcaactgcctctcacccctctcaccaccctgtaaataaataatccatttgagatataagaccattcttgcttgtctggagaaaaagagactagaggggacctataacgtatggagaaaagttgttgcagtactataggcaagacatgatgccagtgtggtctacagccacaacaggggaaacagggaaaagcggctgtgttaaagagacgtagaagagtcaaagcggaccacacttgatgaggaagcaatgaagggaatcaaagagacgaaggtatcccggtttccagactatggttaggtagagaatatatagcagagctggatgaagattcttggcatattagagttatttttagactttcagatagaagttccacaaacaggctgggtgcagtggctcatgcctgtaatcccagcactctgggaggccaaggcagacggattacctgaggccaggagttcgagaccagcatcgccaacatgccgaaaccccgtctctactaaaaacacaaaaattagctgggcatggtggcacacgcctgtaatcccagctactcaagaggctgaggcaggagaatcgcttgaacccaggaggcagaggttgcagtgagccgagatcgtattattgagctgagatcatgccaataagccaagatcacaccactgcactctgcctgggtgacagagtgagactttgtctcaaaaataaaaagttccacaaacaaactgacctacaccagagatggggcaagacttagctttgcagcagtacacccaggagggatctcttaggccccactcaagagcaaagtttgggaacacctaatggcctgggacagtacagtagaaaaaggaaaaacaaaaacaaagaccttcaggtcaaaaattttaaaaattaagaattctctcttacataagattacagactagtcaagggtctttaattactgaactggcctcttcaaaagtaatttaattaaatggttactcatcttgagacactgtaagaaaagtaagtcccttgatggtttttgcaaaataacaagatcattggatagctcttcaaataatggactttcagttcagctgcattttatcttacatttctaaatgcctactaagcattcattcaccaaataggcgactaggctatatgctgatataagagactaagcccctggtctcaaattcagtctgatacttaagagctaatgtaaagtaagtgtaaactgttagggagcagcgtggaaatcaaatccatgcagggaggtctgggaagggtttccaaaggagctgtctgacaagaatattgaaagatgccatcctttaaatccattttaacaaaagtaagctagataaagaagacagaacagttctatcttggagaggaagctcctgagagactggtgtcttagagagcaggggtagaaaagtgtttcaggaagacaaaaaaacaaatatgaagacacaaaggcaagaaaaagcagaggtgccctcttcaaagaactctaggaagttcaataagaccggaagatagtgtgaatgagaagagcagagtggcgtaagaatgcagagggaggttgggaccagggcatagaaggtctcacatttgctatgaggaagcagcacaattcagtggctggaagcacaggtgaggaaagaagactccccaggttcaaatcccaggtctattcttactacttagatggctataggcaagttagttaacgtcgagatgtcccagtctcctcatgtgtaaaaatgaggcttacataaattcgtatctcatttgagaatgaagtgaaataatacatataaaatgctggctgggcacagtggctcacacctgtaatcccagcactttgggaggctaaggcaggtagaccacctgaggccaggagttccagacctgcctggccaacatggtgaaaccccgtctctattaaaaatacaaaaaaattagccaggtatggtggcgcatgcttgtaatcccagctacttgggaggctgaggcagaagaatcacttgaacccgggaggcagaggcttcagtgagccaagatggcaccactgcactagcctgggcgacagagagagattccgtcttgaaaaataaataaataaagtttagaacaatgctgggtatgtaggaagtactcaataaatgttagctatcatcatcatcaatatcaatctgttggcttcgacagtataaactagaagcagaagccactaacccttctgtagtatttctttgtacctctcctcccctttctactttatagtatagccatctatcttcccttagtagacatttttagatctctccacagagctaagcaaaatatcttgtatctgtagagtaggcactgaaagattcgagaaaaagctaaacccaatcaattaaatcttcaaaactgtggcttaaggaataactctccaacttgctaatggcactaaaatatgcagtaaatatgcagtaaagcttagctacatcaatggaaactgcactatttttctagttaatacacaaatgactcagcacatttttcgagcacctcagacttcacaaaagcatgaaaggagtagcacacagagaaaataaacaaagtatttgaaaattatgaatataagatttggcaaactgcttttatccaacagatctgtattttaatgacttctgtctcaatgatacccttcagcacctcaaaaaccacaaggaattggcctggaatcagagtccaaaaaaaaaaacaaaaaacaacagtccaggcagggagatgataaactgaacagaacaatgccaggactgagaatcttggccaagttgtggtattagaatggtattgtatttaaaagccacagctaaaaataggcacataaacaagggaacataatcttgggactcaaggactaaagaaaaaaaaggaaagaacatccaaggtttcaggtatcaatctacccagagacagggccagcattaagcagaagccaaataacagggatctacacaaatccaaacaagcatgctactgacattagcagcctagcaccagggggcagaaactcagagtccggcacacaagaaagagaccacaggtcagacagtgtctgttaatacaacaactcaacgatgagcagactaacttttttaataagcatgggtaaatatactttaaatccagtctaaataaggagatacttcttgatccactccattctttttcacagggatagcagcagttaccagaaatacatccaaacatgcttattggaagcaggcaccgcataccaaataacacctccccagcctgcaaagttccctttgaagaaggcttctgtttccattactaatgtggaaaatacaactccctctcaatggcttctagtatcacgtcacaagggcctggagatggaccagtagacttttctctaggcctgtttaacttgcagtatcagaagtggggactgggaggggagcagtaaaacatttggtttgctccctttttccaatttgggcttgactgaaccaaacttgttcactcatatctcatgctatcccaaaacaagtaaggcaactatcaggattcatctctgcaaagacatttctagtcatttacaaacaattaccaatgccaggaggaacagcactcagctgtacttgctggtacttctcaggctgggtatccaggctattatagatatatctgatgattgtttcactaacttttgaagaaatttcttatactcagagaaaatggctctctgagcctaagtttcttcatttgtaaaataagcataacaccaatctcactagactgcttaaaaaaaactaagagtatttttaaagagtctaacacagccttacttataggagataacaatgctagtgtacctctttcctcagacgccaagggaacatactgaacgtggattccaggtgctatggtttgagtgtttgtgctccaaaacttatgttaaatttaattgccgttaccacagtattaacaggtgggacctttaagaggtgattaggccatcagggctcagccctcatgggtaggattaatgtcattataaaagggtgagttcagccccagccatctcttgctcgcccttgtaccacgtgatgatacagcaagaagatcctcaccagatgccagcaccttgacattggccttctcagcctccagaactgtgagccaataaatttctgttcattgtaagtttccaagtctgtgttactctgtcacagcaggacaaaacagactaagccataaggtttctactaagtaaggtttctgggatctaggaggcaaggaagctaggtcatgtagttgtgttaagtcaacaggaccaatatggaaaactgaaggagctgacaactacaactgatgcaagaaggatgagtactcaatactttttcaggatgactgacacttactcaaagagcctggggaggggaaagaacgctgggcttagggtcaagaacctatgtttatttatttattatcattattattacttttaagacagggtctcacctctgtagcccaggctggagtacagtggcatgattactactcactgcagccttgacctcctgggctcaaacaatcctccatcttcaaccctcccagtagctgggactatagatgcacactaccacacccagctaatttttattttattttatttttatgtatttatttattttctgtagagacagggtctcactatcttgaccaggcaaggttagtcttgaactcctgggctcaagcaatcctcccgccttggcctcataaaatgctggaattatagcatgagccattatgcctggccaaggacctaagtttaaatcttagctccactagtcacctgtgtgactgcaggctagtcagttaatctctagaagtatcttcatctgtaaatgaagataccatctatcttacaaagatttatttgtttgagttctgttttgtttgcttgtggatttaaaaagatagcacatttaaaagcacttgaaagttcttggctcatgacaggcacttaaatatttttcccttattatcttaagcttttgggaaatactatgttagaacttctcaggtctaagagaaaaccactgagtaagacccttgggttcagaagcaaccactgaaactaactcagcaatgatccacaagaagagttttctgaggcggaggtgggagcactgcttgagcccaggagttaagctgcagtgagctatggtcacaccaccactgcactccagcctgggcaacagagcgagtcttagtctctaaaaacaaaataaaataagaataataaataaatagaagagtactctgggtctaggaaccaaactcaggctttgaattctgatgaaatccaggactaattctgtgagtctagtgaaccacagcacaaaaccttcaaagctcagaagacatagagaaagatacccacacaagtgactggaaaacaagagcaagtgatacaacgggacactggaaatgacaaggaaagagccgatgcacacactgttgtggcagtatactaaagcattcctgtacctacctatattacagtgacatctacagcaggaaactgactgtaagtacaagagaagggctgtcccattacacaccagatggtttgagttctgattcttaaaaagaaacgatgttcttaggggcaagaagaaaaaaatactcagaaatttaggaaaaagaaacacttaaaagatttattttatgatgaggattatttagactagaagtccagaaagggattctagatcaataatcacctatcttgacacaggttgaaatgaaagttaaacaaaataaataaaaccaagatttccaaatctgtactcaacatttattctgtgtgtctgtgatttccttccttgtcatagcctgtaatacaaataacagcaatctggcttgcatatcagcacatcactactctaagtttatggctagtattcataatcgaccatggtcttctttttccccttgctcaaaaattggtcttagaagtcttattacccttacagttttctaggctgctgtcatgagatgactagaatttacaccgtagagaaaacccaaccacaacctttggtttagacttgcattacttatattcttataacaattacttacttggccctggacaaaagcagtcaaaaggggaaaccattctggcataagaggtaaagggtaagcagaactgtctgagtcacttgccattaggtgaaagaaaacaaaggagataaaactaaccagaaaaacaagtcgaaactgccaagctttctacagcagttgccaaaacaggaaatttacttccactagtcagatatataaccacagagtctaacagattataaccaggaagacaggctgaacaaagaaaacttagacaccaaaatataaaataaaataaaataaaatcttccctattttccactgtcagagagatatatagttatggttactttgtttcaggaattttaaaattctaaatatatatttacaaataaaaatatggcttacaattgttagatattactcatttatcaaataaaataataaaaagcaaattaatttttaaaaacttttacaaggtacctgtacaaatacaccagagtaccacaaacagcctcatgatgagaataaaatgaagatgttaaaaataatgctctataagtgtattcattgacacagaaagttcctcatgacataattaagtttaaaatgtgggttacaaaacagaatgttcactgtgatctagtttttttgtgtttttaaaagcctaaaggcaaaacaactattagttaacattttggtataatctgtagacagtgagattttgagtgatttttagtttcttccttttgtttctctgtatttcctaactttactgcaacacacatattatctgagaaattaattctttttaaaacatactgcagctagtaatctgctcttggagtttattatcgccatcagaaagaagcaaggagtaaagtattggtcaactgtagaagctttgtgttcagatttacctctccagtcacagctgcttccacacggctgggtaaccagaagtctgatctgatgatttgaggaccactactatatcctgacaacctccccacttacaactcattagagacctctacctttaacaaactatttgcagatataggtcactcacagccagggtacctcaaaataatctttaaaagcacatggtctattcaactttgtactagaaattccaaccagagcaatcaggcaagaaaaataaattacaggcatgcaaattagaaaggaagaagtcaaactatccctattgcagatgactgaacttacatatgcagaatcctaaagaatataccaaagaaactactgaagctaataaattcagcaaagctgcaggacacaagatcaacaagcaaaaaatctgttgtatttctacccagcagcaataaaccatccaaaaggaaaattaagaaaacaattccacatgatagtatcaaaaagaataaggaataaattaaaggtctaagacatatacaaagaaaactacaaaacactgctgactcccatgtttgttgcagcactgttcacaatagccaaaatttggaagaaacctaaatgtccatcaacagataaatggaaaaagaacatgtggtacttatacacaatggagtactattccgccaaaaaaaaagaatgagatcctgtcatttgcaataacatggatggaactgcaggccatataagctaagtgagacaaactaggcacagaaagacaaacacctcatgttctcacttatttgtgggatctaaaaatcaaaacaattgaactcagagatagagagcagaaggatggttaccagaggctgggaaggatagtgagagggtacggggaagctggaagtggttattaataggtaccaaaaagtttaaaaaaatggacagggcgtggtggctcatgcctgtaatctcagcactttgggaggccaaggcaggcggaccaccagagatcaggagttcgagaccagcctggccaacatggtgaaaccccatctctacaacaatacaaatattagccaggcatgatggcgggtgcctggaatcccagctactcgggaggctggggcagaagaatcacttgaacccaggaggtggaggctgcagtgagctgagatcatgccactgcactccagcccggccaacagaacgagactccatctcaaaaacagaaaaaaaaaattaaaaagagtaagacctagtatttgatagcataacagggtgactatagtcaataatttaactgtatattttaaaataactaagagtataattggattatttataacaaaggataaatacttgaggggatggataccccattttacttgatgtgattattacacattacatgcctgtgtcaaaacattccatgtaccccataaatatatacacctactatgtagccacaaaaattaaaatttaaaattaaaaaaaacactaaaaaattaaagagtaacgaaataaatggaaatgcatcccacgctcataaattgtaaggtttttgtggttttgtctttttatattgtaaagatggcaatgctcccccccgcccacaagtgatctctagattgaatgcaatccctatcaaaatcccaaaaggcttttttgtaaaaacaggaaagctgatcataaatatggaaatgcaagggaccccaaaatagtcaaaacaattttgaaaaggaagaacaaagttggagaactcacacttctcaatttcaaaactacagtaatcaaaagaatgtgttaactgacattaaggagagacatatagatcagtgaaacacaacagaaagggcagaaataaacccatatatatatggtcaactgatttctgacaagggtgccaaggccatcttcaacagtgctgggagaactgaatatacacaggcaaaagaatgaggttggatccttacctcacatcatttacaaaaattatttcaaaacggatcaatgacctaaatataagagataaaaatataaaattcttaaaaggaaacttaagggtaagtatttacgaccttggatttggcaattgtttgtcagatgacatcaaaaacacaagcaataaaagaaaaagtagataaactggacttcatcaaaaaaatttctttgcatcaaaagagactatcaagagagtaaaaatacaacccaccaatggaatatttaaaaatcatatatttgataagggtctagtatctagaatatgtaaagaattcctaaaacgcaacaacaaaaaggcaaacaatttaattttttttaaaggggaaagaatttgaatagacatttctccaaagaagagaaacaaatggccaaaaagcaaatgaaaagatgctcaacatcattagtcattacggaaatgcaaatgaaaaccataatgagataccacttcacacccactggactggccattatcaaaaagtggaaaataataggtgttggcaaggatgcaaagaaattagaatcctcatacactgctggtagaaatctgaatggtacatctgctgtggaaaacagtttggcagttccttaaaaaattaaacacagaattaccatacgacccagtaattctactcataggtaaacaaagaactgaaaacgtgtattcaaataaatacttgcacacaagttcatagcagcactattcacaatagacaaatggtagaaataacccaaatatccatcaactgatgagtaaataaacaaaatgtggtgtgctcttaccatggaatattattcagccataaaaaggaatgaagtactgatatatgtacagggtttctttctgaggtaatgaaaatgtcttggaactagatacaggtcatggatgcacaacattgtgacatattgtatgcctgtttttttttttgagacggagtctcgctctgttgccaggctggagtgcagtggtgcgatctcggctctcactgcaacctccacctcctgggttcaagcaattcttctgcctcagcctcccgagtagcagggactacaggcacatgccaaccatgcccagctaatttttgtatttttagtagagacggggtttcaccatattggccaggctggtctcgaactcctgacctcgtgatccgcttgcctcagcctcccaaagtgctgggattacagacgtgagccactgcgcacggcctgtaggccatttttacgtgattactgcacctgtagccctcgctacttgggaggataaggttggaaaacccctgagcccaggagttcaaggttacagtgagctatgattgtgccactgcactccagcctggaaacagagcaagaccttgtcactaaaaaataaaataaaaatattttattttataaaaataaaatattttaataaaattaaaatacaatggcttatggttaactttaagttatacatgcctcaataaaataataccaaaacaaatcatggtctaacaacctaaaatattttaaacaatttattttccactcagaaaccatcataggtttttaaatagattcaaagctgtttcatcatagcattttttaaaaagctactctccaaaatacttcaaagagtagtattaatagaatgccctatttcttaccagaagactcttttccattctgtttttcatagagggtacccacagacatcaggaaaacaataaccaggaatactggaattctccatgagccagccagggatgctgcaaattattaagaattaacatttttagtgaaataaaaacctagtacttgtttttacaaaactcagttttgtagtttgacagaacaatctggtatatatattagttacagaattacttatcaggcaaaaaaaaaaaaatttaagtccattagataaacttcaagatttctcaaaattaagttcatccctgctctcagaggcccctggtcaaatggatagggtacatgcctgcctacctttaatggggttctattaaagagagtctattgtaacgtataccaaaggtctaaaaccatcccgaactcaaaccatctacttcaccccagaatgaccagaattaggcatagatctcaaagccataaagtctgccttggtttcttgaaaataccaccgggcgtgaactttctctcccaagaaagagaatggcccaaaagagcacagcaaaaccatcaatgtctcctcctcagtgtataatgcaaaaatgtttacaagttggctgggcgcagtggctcacacctgtaatcccagcactttggggggctgaggcaggtggctaatttgaggtcaggagttcgagaccagcctggccagcatggtgaaatcccatctccactaaaaataaaaataaaaaaaaaaaattagccaggcgtggtggtacatgcctgtaatcccagctacttggggggctgagacaggagaattgcttgaacccaggaggtggaggctgcagtgagccaagatcacaccactgcactccagcctgggcgatggagtgagactctgtctcaaaaaaaaaaaaaaaaaaagttcacaagtcaccaagaaacaggtccctacccataaccatttccctgagtccacctagaacctcataaaacatccctgcctgcctgcctccctcctctgccttccctgagttcaaaatgagtcatatctgacatacgggttcttgcagataaattcctctatcattccaactcaacaaagctagagaataatgctttgtttgacatcaaacgaagacagagacatagctgttttttattttatttttaacaataagtagtagctctagaaactactttaaggctatctgctgctctgggttactgaattgtgttgttaaattagaacttagtgtttccattggctcaaacttgggagatgaaagtctcaaccataagtaccacgctgaaaaatcaacatctgagcagccacccagctaacataacagggaacccattactctgagcagctctgacatgaatcatccttatgtggaaaagagatttgtctctctgaagctaactcacaactctgacatctctccctcatggttacagagatctgtttaaagcactctttcacaggacagtccttcaaatattagaaataggctttcatgtcttatatcctccttacctctatctccttcccaccctagagccccagttccctcctcttatccagagtaaacatctctagttcctttaactggttctcacacatgtctctgagcacctcttatcgttgactgcttatctatatcttcccctaagtatgacactcagaaatgatatgagaatccaagggtgctctactttttaagatgtattgacttttaaaaggaccttttggaaaatgaacataattaaagacattttaaagcacatcattttcattaaaatttaatgaaagattaaagcataacattttctaaagattaagaatgttaaatgcaacatatgacactacaaaaaattcactttcattcacacagtcagcctctgctgaccttaggctagacttaaaaaaaaaaaaaaaaaaaagaaggaacccacctaaatgaaaaagcaatataatccagacaggaattgaaactgctctcaagtagcgttcagtgcttgcattccacttgaatgaaacagtcaacacatagccaaccaccaacgtccagatcttaaataaatgaaagacacagctgtaaaatctatacacgtgaaaatgaacatacaattatacaaaatctgtaagtgtctatacagcaggaatgctctggacatagcacagaaaagatgaaggttgatggtgtcaaagaaacgtacctaggttctcctcgtttggagaacctaagttttgaaatactaggcatttgaaatctcatgtagtaatattaaatagttgtttaacaaaagatacatagttcaaaacccatcttatacacaaaaatgcttgagataaaatattcaaagcataaaccatggatttaaattaagaatctaatcttatggaattcctacagttttctctgttgatcaatgtttagaaaagaaacggaaagaaaagaaaaaaacaagaaaaggaaagctttccaaaaagaatcaggttaaaagattctatttcagcttataaaatatgcttgttactggggaaataactctgtaaaagtaagaaagcagccagctgaagtgtgaccctgctgaaataatctaggcaacaaatgattagaacctaatccagagttatgatgcaccagctgaagaagtgtgcctgaaaaaaatattattagaggaacaaacagcaggacttcagaacagaagaatcagccaggataccctcttcagttcttcctacactaaagttaaatgaccctagagcttaagacgcatcaaaagaaaccagcgtagcctacacagaaactcatattttaatagaacatttataaaacacagagggaatacataatccagaacacatctgagcacaaagaccttaattaacataagaccaagaagctaaaagtcaagtatgacatgaaccttgccaaaaaaaaaagcaaattaagacaaaaagaaacttcgagctatataattcagagcatgaagaaaaaagaactgatgggattactaaaaaagacagaaaaaaactatctcctacgttattttggtcaaatctatcaatacaaataatcttcgcatcttaaaaatgtttatagcttctaacctcagaattcaactttcagactttatccttactaaataatgataaattttgaaaaagttttaaatataaagaagctcatcagagtatgattcagaacagtgaaaaaagtgattacctaaaaggtcaacaactgggaaatgattacgattcactcaataaaatgttatgcaaccattaaaatcacttcttaaaaacaaagactatatagtttaaaaactcacaatatcatattaagttagaagtaaaatacaaaaaatacttgtgctgtgattacatctactatatggtgggaggaaaagaaaatgtactaagaagttagtggctgtatttgggtggtaaaattttgtttttcctttcacttttttctgtattttccagactgcctttaataagcactaattcttttataataaaaaggacattaaaatatttcttcaagtaactctatcagatgaaatattaaagagctttgaagctcaaaaatatgaggacatgggaagtgagactacagctgcttcaaaaagtccagtcttgctggaccagaccaattaaccctgggaattcaaagaatttgagatctgattgcagagcatagaaaaaaatctgagtacaataatagtacacttatataacactcctatgtgccaggccctattctaatgctttatgtatactaactcatttgatcctcataaccccacaaaataatattattatgatcctcattttacacatgaaagaaacccagatttcagagaagtgacttgcccaaggccacagccaataaatgacagaggcaggattagaacccaggaatctggctccagagtgcacttttctaatcttaaggagaaagaagcatggtgctagaatactaaagataagcaaaagctgctcagattttcacaagggaaaataaaaacagtcaatttagacaactacaacttgttgaaattaaaaaaaaatccacagtaaatggatagtcttcagaggtacgtcagttagccccaccctattaaacattacgtcagtcacttagatgaaagactagaggcacaataacagaaaaaactgattttacacaaatcagttatacaaaactgagttgtcaataaatattgagataatctatcatgattcaaaaagatatcctgaagccagaacaatgggctaatccaaacaagattaaactatatgaaaagaaatgcaaagttctgcttcgagattcaaaactcaactgtacaagtatggaatggaaagagaacatctgaaccacttttcagttcagtatgagtcagcctatgactagtagaagcacttatttctaaaagtacaatactcgtatcagggaaagtgattgtttcaattaattttgcgctaccaaaccacacaacaaaattcagcctgggaaaggaaatagaaatcacaacatgataatataaatgtagctaggggaaaaagaaaaaaaaagttttgctcagaaaagagaaggaaatatcaagattttgtagctatcttcaaataatttttaaaatgtcatctgggagaggcataagacttgattttctgtggttctgagagcagaaatacgtgggaattaggaaataacacagctcagtaaaaggacaggtttttccaataaactatagctatctacaaatggaataatcattactaaaagtgtttgagcaaacgttgaacagagatgacaaagtaagtactacccttagtaagaagctgaactggaggtcacaatttatacagtacctccaagaagtttttgtttcttatctgtatgcataaggaattagtatcatttgcaaggagagaaaaaataagagactgcatacttcagattttttaagagaaatttattgtctaacaagaagcatgtattttcatctatcaacctgaaactcacagattacctcattccagtttaaaataaccattttaaaatatactccccaattctacttttaggagtgttttacagaagcacactgtgcagacacatataaaaatattcacttgccatttacaatataaaaaattgagaacttaaatatcattttatagtgaactgtttaaataatgctatctccaaaaattgagtaattagtcagactttcaacagtatgatgaacatcaatatacagtgctacagtgtcaatttattcgtgtgtaaatttataatggtgaaaatatactcaacaaaaaatgttttaaaatattatctctagatggcagatttcaaggagtaatctgcttctttatgttttattacaggtgctcaattttctactaaggttatgtagtatctttataaacagaaaaagaagtatttttaacctttaggaaattcttttggcttctggattttttccagtattttgaagtgtttcctcagaaaagattcgcagaagtaatattagttcaagaggtaaggccatttataaaaacactttagagtttatattaagcccattatgattatacaattaccaatggttaaaaatgtttatcaaagtattctaatacaaattcagagctaagaaaatctgttgaaaacattttctaaaaggcatggtgggggagggggagaaaaaagatttatactgtagcagtattaaaaagaaaaaagtggccagggcagtggctcacacctgtaatccttgcactttgggaggctgaggcgggcagatcacatgaagtcaggagttcgagaccagcctggccaatgtggtgaaaccccttctctactaaaaatacaaaaattaaccaggtatggtagcatgtgcctgtaatcccagctacttgggaggctgaggcaggagaatcgcttgaacccaggaggtggaggttacagtgagccgagattgcaccattgcactccagcctgggcagcaagagcaaaactccatctcaaaaaaaaaaaaaagaaagacgtatatctctaagtgctaataaggaaagatggccacagtacaatgataaatgaaaagagcaaggtacagagctatatgtatgttatctcatctttgttttaaaaaacaaaaaacaaaaaccttctactttatatgttcacatggacaaagaaatgaatttaggagcctttacatcaagcagttaatagtaacatctgaatagtgggaatagtggtagagaaaagggataattcggccgggcgcggtggctcatgcctgtaatcccagcactttgggagaccaagatgggcagatcatgaggtcaggagttcaagactagcctagccaacatggtgaaaccccgtctctactaaaaatacaaaaattagctgggcatggtggcagatgcctgtagtcccagccactcgggaggctgaggcaggagaattgcttgaacccgggaggcagaggttgcagtgagccaagatcgagccactgcactccagcctgagtgacagagcaaggctccatctcagcggggccaggggcagggcgggggaaggaaagggataattcacttttaccatacaaacttctgttctgcttatgttttttcaaatgtaacaagcatattttacttgggtcaacattttgaatcactaaatatcctttaaaataacaaaaataaggatttgtacatgcatgtttcacacacaatttctagtctaggacctcttaggagttttttaattcttaaatcttcactaacacggaaacatgaggttaacaagtcaactttatatatgtttagcctctgagcaaacctattcaagtgtgaattttattccaggcattaaatcaatgagccacagttacagataagagggcatatttttccaaacttatgttctccaaaacaacatgtccttttcaaaatatacattccatagtcgtttttatagcaccaatgtgctagacactacataagactgcataaaatttggcaacatttacttagcacttcaagtaaagggaactaataggcaatcacattttcctttcatttcacacgattatccacatatacttttctggttaaaaaacatattaaatgtagaaaacattaagtagagactctgccttttcaaccatctttgtttcatttattgtcatctgggtattaactggaaaaacaacttggttgcttctgttacatatttttgcagaacagtttcccaagctttttttagagagaataaaactacaggaagggtgcagtggctcacacctataatcccagcactttgggaggccaaggcaggggaatcacctgaggttaggagtttgagaccagtctggccaacatggtggaaccccgtctctactaaaaacacaaaaaattagccgggcatggtggcaggctactcgggaggctgaggcaggagaatcacttgaacccgggaggcagaggttgcggtgagccgagaacgcgccattgcactccagcctgggcaacaagagcgtaaatccatccccaaaacaaaacaaaacaaaaacaccacaactacaaacctcctcccaagttatggagccacagccctaatcatagcctcaagcagcaactgcttcaggtccttaaattatccacttaattctaatgtgaaaaccattctctttgtcatatggcaacttagagtcaacatttttatattcaaagtctttaactgagaaaactaagcactagaaactttcctctccttgtttcttgctgccaggcaagcagaaacaaacctagaaatgtgtttaaaagtagaacggtgtcagcagtgaatggctgactaacgtccactgctgaagagcctcttgtgatgtgtaaaatagaacatcgtgaaatcttagaaattgttcaagccaacccctcactttatgcaattgggactgaatgtcccagaggagggccctggtctgcccaaggtcacaaagttagttactggcagagccaagtttagaacttcaggtgtttttatctttcagccactactctctccacctcctgcttctttaaaaagatgggaacaatgggatcagagaccacagaaaaaacaaatctattactactgcaaaaaactaaatggtcttcaaattctccaccaagtctaaattaacagaatgaggaagatcagaatgccccccaacagagaggaatggtggagcagggcacgccatcagctttttcaaatttaccttgcacagctccaccatgggaagatgccaagaactgagtaacatgtgaacctggtgcaacagctgattttttttttaggtgttctgaaatcacttactaagtcagtgcaatctcctaacatatttgaaactgctgaaaaagaattactcatcccataaatgattagtgtttcacttgtaagaagcacggagttttaggagactgaagaaatctacaagtgacatgaagaggaactgaactggaaagaaaaactagtgacgaagaaaaacataggtccaggccaggcgcagtagctcatgcctgtaatcccagcactttgggaggccaaggaaggtggatcacctgaggtcaggagttcaagaccagcctggccaacatggtgaaaccccgtctctattaaaaataacacaaaaattagccgggcgtggtgggtgcctgtaatcccagctacttgggaggctgaagcagaattgcttgaaccggggaggcagagcttgcagtgagctgagatcacaccattgcactccagcctgggcaacaagagcaaaactccgtctcaaaatataagaagaaaaaagaaaaacataggtcccaaagacactaaaaaggaaaattgatgggacctggaaaactgcatagatataaaaataaaagggaagaaagaagagggacgaataaggtttctagatgactagaatgctgatatttttctgattttttcctagtaactggaatcttttttttttttttttttttttttttaagacagagtctcactctgttgcccaggctggagtgcaatggcgcgacctgggctcattacaacctctgcctcccggtttcaagcaattctcctgcctcagcctccagagtagctgggattatggagtcggccgtcacacccggctaatttttgtatttttagtagagacggggtttcaccatgttggccaggctggtctcgaactcctgacctcaggtgatctgcctgcctcggcttcccaaagtgctgggattacaggtgtgagcaaccgcacctggcctacaatccactaaaaataattaaacacaatgtattagggaaaactttttaaaaatccttattgaaggttactacagagttttgataacagcaggacttcaactgctgctaggtctattgaatgccatttactgacagcatcaacagttctctgaattagttttctcacatatgaaatccctccctcctagctcataagacattgagagaatgaaataacacccatgtaaaagaacctaatctagtgcctgggacatggcagatgctcaaaagttggatcttaaatggatgaactgtcaagtcatcaaaacagggattcgcttaaaggtaacttttctctctgcctctctcatctatactgctcttcagcagcaggctcatggttaaagtagcctagaaagcataaagaccatgttctataaccagacagccctgcttgggctcataaagccaaaccgctgtgaactgtgggatggaaaaggtccagagtgggcctcctgcccagtcacataacctactttcacttaatgccaggccttaatctgcactttctttcttattttaaaagactgggggtgggggaggtctcactatgttgcccaggctggtctcaaactcctgggctcagacaatcctcctccctcggcctcccaaagtgctggggttacattaagccactgtgcctggcctttaatcagcacttttttttttctttttttttgagacagggtattgctctgtcacctaggctggagtgtactggcacaatctcaactcactgcaacctccaactcttgggttcaagagattgcctcagcctcccgagtagctgggaccacaggtgtgcgccaccatgcctggctaattttttgtatttttagtagagacggggttttaccatgttggccaggctgatctcgaactcctggcctcaagtgattcacctgtgtgggcctcccaaagtgctgggactacaggcgtgggcaaccccacctggccttaatcagcacttttggataagagcaaggactccttgtcttctcaagtacacctcacccccatccaaccatccatccttaagtgctgcttgagcagaatgcaattccatgccttgtttttcttaaactcagattgacctgaaggttctttcaaatttagcccttctaccactccctactcacaaatacttaactcatacttttatgttgagtttgtttttttttaaccctctctctttttccttgctcccaacacttgagccaaacagctgaatttcaaggtttttttggtttttttttgagacggaatttcacgcttgtcacccagaatggagtgcagtggtgcaatcttggctcactccaacctctgcctcccgggttcaagtgattcttctgcctcagcctcccaaatagttgggattacaggtgcccaccaccacacccagctaatttttttttttttgtatttttggtagagacggggtttcaccatgttggccaggctggtcttgaactcctaacctcaggtgatccacccgcctcgacctcccaaagtgctgggattacaggcgtgagccaccgcgcccggccaatttcaagcttttaaaaaatcattaattagtttgaccttctttctcccactcccaggtctaatcagtgttggcccctacttctcttccactcatccacaacccacaaatgaaatacaaagatgagggtttatcttcagtaaaaagatactcaaaggtatacgccgagctgtggatgtttctttacaagtgctcaactctttccactgagtatctgagagagactggtagaaatgcctcataatcatgccaaattacttaggtattcaacttcttactctagcatgaaaatatactatttacatgtggcaggcctttcttttctactttcctatagtttgatggatatgctccttgagcagtatcaacagtcaaaaatgttagcagaatctataaatgtgtctttgacaaaactgaatttcttcaggaaaataaccaagcttatttttcttagaacatagtgttctgccttctagctaagaagcattcgatccacttaactgaattgtgaaactgcaagataaaggataaagagcgctgaactgggcctccataaaagtgaaccacagatttgctcatgagctgtgtgactttggaccaatcacattctctgggcctgtggcccacaacggatgagtcatgaacatttatctgtatgtctgtcatctccattagaatatgttcatataggattatatgtaccgtgaagacgggacctgtatcttagtccttttttaaacctctcacaaagcccaacacctaacatatgctcgatcaactttaaacatgaaccaagaggtggtattgagggaacaagagaagaagggtgttttgggtcattcatcactctgccaataacctcaggcaagccaaaacaccgctagacagataaggggaattaatattttccaacttaatgacgtcaaggtacactgaactttatttcactgacaaaagaagtgaatcaatttgtaaatggtactgtttatgaatcaattggcattcttacgcactaaatctccacttgtttttaacagtctccagttaaatatgtggataattaactagtccacaatatagtctgagttaggaattgtgtcactagattacctttgaaatctttccaattctaaagctccctggttttgtaagagtaagctcaggttaatccaagcatcacaaatctacgtctctccccttcacgcggtcagctgctttactccaggcgggaggaggtgtgctgtggtacaccagtccctgcacaacaaaagcagttacctaaaagtaaagcgtggagaggaagaagcacaggcagctcagcacccagtgccttgcacaaattatacaggaatcacctgaactgagaggcagcaccagccagtgaagcaagctttgttttaggacttgtaagaaatctaagacacccaaacccctctttgtccctaagtagccctagcctggtaagaggtcacctttcctatctgcaggatggcaagttggcctagaatctctaaggtcccttccagctctgacattcagatgcgcagaactgagggtggccgaagcacccccgccctctccaaccagaagtaaaaccaagccccactgccatgctctgaggcctctctctgcaaagcgaaataacgattctcaatccagggcactgtccccctaagagggcctattaggattgaaacaaggcgaaaagcagggaggctgtttcaaatcacgcccgccccctttttggaagaatgtccgccaaattcctgaggtgtgagaaggaaagcggagacggacggtcactgcagcacaggtgtggcccctcgtcgcccctgcaccgggaggaacagctgcaggattgcaccccagagcgccgggaccacgggcgggggacgggggcggactgccgctcactcacccacaggctgctgaagtagtccagcccgcggcagatgagcgtggcagcgtgcaccagcagcacctgcacgcccaagtagctgccgaggcagtagaggccgtacaggagcgggccgccggcgccgagcagcaggagcaggcggcggcggcgcagcgcctgctcgcccagggcctcgacgccgtagtcgacgaagcagagcggcaggagcagcgcggccaggacgatgggcgtgtgcgcgcggtgcaggcgctgcagccagtggcggcccaggcgcgtcagcgagctcttgaaggggtgcagaaaagtgccgcatagcacggcccagagcagcggccgcaggaaggcctccaggatgaagtagaccagcaccgcggcgccgcagcacaggcacacgaacagcacggccccggtgttgtagaaggcctgcttaatgggcttgtcgaagcgcagcgccagcgccgcggtccgcggggtctccccgccaccgccactcggcccgaccgcgcgcgggacccgcggcgccggcccgggagagctccgcaggcttggcgcgtccttagggccgccgccgtcggccatcgttcctccgccacagccgcccccgaggggcggtaatgggagtcgggctagaaacgcgggcgggaggcagggcgggaggcgcgcgagattgtgggagttgtagttccccgctggtttacagacccaccaagcgcttgcaggaaactacaactcccgaaggggaaatggggaaaacgcctccgcctccttggtgtccgcaaggtcctgctaacaagtttgcagggtctatatcttcctggagggggggggggggggaagctcctttcactcattcgttaatgtcaatttctcgcgaggcgagatcccaaaaggcgccacattcagatattaaaacccaagctgcatactagaataccgtgggggagtacttttaaagaaccaatgccccgattctgttttactgatttatttaacagatatttttaaagtgttttctttggtgtatctgacaggattttaaatagagattaccatataacaggccctattctaagtggctcactcctattaactcatttaatccttagaacaaccctacaaagaaggtgttattatcctcattttaccaacagaaaaactgagacagagccgttaagtacgcagccagagtcacacagctaccaagtggcacaggcaagattcaaactcagggattctggctccaaaggctatacttttatctaccatagtatttggcctgaggaaagaactcttggcatttttcaaacgttcctcataagcctgtaatttgcagccgctgttgacaactgtttgtgcaggtttcgctgtggacgcaatctaaactcttaaaagagtcgtagatcaaagtctcaaactgccactgtttctttttgagacttgatgtaatgtcagttaagcccccaatctcaagttttcctctgtcacatggcgatgataataataatagcttttgctttagggttattgtgtgggggaagggaaactctggggcggtacaaggtgcttctgttcccctattggaaaagtgctgggatccaagcctgctacccataaaatatcccaatcaacattttgatttaaaaaaaaaaagaaagccttgactgagtactcaacatgtgattgcttcaaaccttgcaagttgtccctttcctgtttcaatagtattcctattaatttctacataatttttgtttcccttctaaagcagacaagacaggtaacataatccacagtttgcagataaagaaactattgcttgatagatttggagacaaagggatttagtaaaggaagtaaaggaaaaagtaattccctatccatctcgattgtaagttttaggtctcagtatttcagatggcctttggagttttataaccaaaacgcaggtttagtcgctcaccacttgcagattccaattaacaagagcaaggtctggtataaagaaagtgatgtattccaaagctagcttaggggaagaagtacaggtttcctccctaaggctactgcttcaattgtggagcagaaagcaggcacttttaaagcgaaggaagcaagcagttgtcgggggaggggtctgcatgccttatctactgggtggtcaagctggtgactgctggcaccttcgttggcaggactaagccaaaaacccctcagatggaagagagtttcatatttctcaaggcagtctcccggtgggagggagttttgtagaaattggatgttatctcttgagttcctttctggagctcctaagcacatagttagatgaacttgccctgtagggactgtctggtgaagacaacgtaaaaggctatatttacctttattaaattatttatttatttatgagacggagtctcgctcttgtcacccaggccagagtgcaatggtgcgatctcggctcactgcaacctccatttcctggcttcaagagattttcctgcctcagcctcccaaatagctggaattacacgtaccccccaccatgcccggctaatttttttttttttacgaggtttcaccatgttgaacaggctggtctcgaactcctgacctcaggtgatccacccacctcagcctcccaaagtgctgggattacaggcgtgagccaccgcacctggcctacatttgcctttttaaagggctaagtaggaagggagaaactgggggagtgagaaaagaagagagaaagaaaaaataaactctgtctcagaaaaaatgagggtactcagttacagtttgactctgtaaatatttttctttcagttgttcctacattgtactttgcttctttatttgttcaggctttctgggattatgattacaaagtatggtcacatttgccttcagtccatgttacactgacttaagctcccatctacataatagcaaaggcctcaacctccttcctaaaaagtccttggtgatttctatgggggggtcccaaaaggggtacctcacatatacccagagacatgagtcagctgctaccaaccaccctgctgcccacacagctcactgagtctagtgcccatcggaagatttccagtgcctgtatcattatccccaaatcctacatactcccaaacttctaaccctcaaggtaccaaaacagagctgggtttaatcctgataaggggaagaagtctttctccctcacttgacaaatattttgtcacccaagccctaaagcaggtcagtgtgccaatgttttagtttttagttttttgggtttttttttttttttttttttttttttgagatggagtcttgctctgtcacccaggctggagtgcagtgatgcaatctcagctcactgcaacatccgcctcctgggttcaagcgattctccagcctcagcctccggagtagctgggattacaggcacacacgaccacacctggctaattttttgtgtttttagtagagacggggtttcactatgttgaccaggctggtcttgaactcctgacctcaagtgatccacctaccccagcctcccaaagtactgggattacaggcatgagccacagtgccccgccaatgcccagtgtttataactcctctcgtgaatagttccttccatgtctggacttcagtcctctaaccacatgggttcaaaacccttccaatgggtcagtgagggaacaaagactgaaccctcctctctgtcctactccaaccaaagactctcttcctctagttacaaaatgagagctcccaagttacgcaacagaagcatttatcagtggatgcaagccgaaacgggacaggacatggggtgttaatcctgcctaaattgtgttgggccacagtttagcaacaactcagcaaatcaaaaaaatgccctgtcatggtgctttgcttccaagtctcagtgaaagtgaaaattgctgaacatttcaagattgttctaatggccaaagccgtaggactgacaggtgtcactcagcatttctagtcaatggaactctaacagaaatgaaggctgaagcactagaatctaactagactagtctttatgtggcctagcacaaggctgggttcacacagggtttcactcacccctcctgtgattgtcctcaccacactgcagtcaaagttagtggtttctgtgtctgtctccctacagagccccttgagagcagggactgggctttcttcatttccgtgggcccagcacctggcacagcataggacgtactgagtaggagctaagtgtttgctgagcaaaagaatgaatgagtggcgtcctttcaaaaaaagcctgtctgtgcttcctgcgagagatgaaattgaaagctggggatgtttctactgagcatccatgtggttgagaacagagaaaaattaaaatactggaacataggacctaaaaactaaatttgagaaagaagcccattgtccactcaaatctcaaggtcatatgattttaggtgtctcctccaaaatacgaggctacttgggttctctctgttgaccttaacatgacaactcactccaacaacctcagggacaaacagcctccatcggcacgcaggatacagtagaagtgaaagacattcagagtcgtggatcaagctgaccctggagaccacactgcctcttgctttccagttgcatgaatgaatgaattttgtaatcatttaagccagttttggttaggcttctattacttgaaacagaaagcttcctgatttataaaaatggttgctgtgaaggtgaaataagaaagtatgtataaaagcagcagcacagtgtctctgacatggtgagaatctgacagtgactcttggggtaactcttacttttgtcctagaaaagataaggggtatctcttaaacaactgatactcccaaggtatcaagataacatccaccagagatattacaaacacaggcagggagacgattctccagcattgtgtctgttttagagctctccaagtgtatccacaaacatttactaaggtgtgctgagtatctgctttgtacaaagtccagtgcttacaatgtggtatgtgcgttgtgtgtaaggtagtatgtacaatgcagaagaagtgatcatgtgaaaatgaaatcagggtgacatgcattcagattccaaatctgccacttattatctgtataatcctggacaagttacatagcatctctgagctcagtttcctcagctataaatggtgcatgatccttgttcataaggtggcagtaaagattaaattggagaataacatatattaaacacccagaggccaggcgcggtggctcacacctgtaatcccagcactttgggaggccaaggcaggcggatcacctgaagtcaggagttcaagaccagcctggccaacatggtgaagccccatctctactaaaaatacaaaaattagccaggcatggtagtgggcgcctgtaatcccaggtactcaggaagctgaggcaggagaatcgcttgatcctgggagatagaggttgcagtgagctgagatcacaccactgcactccagcctgggcgacagagcaaggctctacccaggacattgtggtatctctccatggtccagggccaccactttgcgcaattccagggatacaattcacatttgggggcactatttacatttggcatcccgtacagatgtgcaacaactgccaagagcacattgagctccttagaccaacaaccatacattggacatctcttctatcttcataggaccagccttccagatatataactctcctcttgcctatctggataattcccattcatctttcaagcctcagctcaaaatcatctcctttgtggaattttcctgatccagggaaacttagcagctacctttactgtgtagcacttacagctatctcttctcaagtaccaaccacattatattgtaatcattttcacaaatatctgaattccccattggatcaaaagtcatcgataagcttttttgcatttgctccagtactttgcacacttttttttaataattaaaaaaagtgagtagacaccatattattgtagaggctgcaggatgtgctggaaagaacacaagcttttaaggcagacagatttggattataatcctggctctactgctttcttgctgtatacccttggataaattaacttactgagaatgtttcctcatttgtacaagagagataagaaatctacattgcagagctgttgtgaggactagaactagtttatgtaaataactaatatggtacttggccacagagtagtcattacttaccttcccttgggctgctttatacacagcacttagctgccatgaactgaacccagctatgatggttactttacaatagaaattcaaacagtgactactggaatagttataacaaggtcttttattacaattactataaaccaaggctggcaattgcatggcatgtgaattactactttcctttgctaagtccatggcaaacattattaatctatcactgaactatcactgaattctttctcttttttttttttttttttgagacagagtgtcactctgtcacccaggctggagtgcagtggcacgatctcagctcactgcaacctccgcctcccaggctcaagcagtcctcccaccccaacctccctagtagctggaaccacaggcacatgccaccacgtttggctaattttttttgtatttttggtagagacaggttttggccatgttgcccatgttggtctcgagttcctgagctcgagcaatccgcatgccttggcctccaaaagtgttggaattacaggccaagattttttaaaaatctcagtggctgaaggataaatggtgcaagcaagtctgatcccaacaggccttgcctaactccctacctacttccccctcatccctcccactcccatagctggacatgtggcccctactcacagtgcaggtcctgctagttcaccgagtcaagggtagcctttcctgtccttttggtctgtgccatccagctgcaactaacctcccatacaatgtcgtgccatgtcaacgatttaccagttagtgaaatgtttcagtgaaaagcttatcaaatcaattcaaccaaccttgatgaaactgacgtgcctgggagagggccagatgaataaaatgaagtgtagagatacataattttttttaagtctgcaacaagacacctccttcgcttcctaaggtgggaagaaggttggtgtgaaggatgggcattgcaagcgggactttgcgacgaacaattatgcaccgaaagtcagaattccctctctagaaagtggctgaccttgagtgtccatcactggtcgttccccctcttcacaggaatggctcaagctttacctggatagttgaagtttaagccttagggctcaggatttggaattcttagcccattgcttccttagctctattccctacgatatactcacactaaggctgaggccaaccagtggaataaacaaccagccttctgctgcaaacctgagcaagactgaaaaacaggagatggttgatgcatttcaaattgcccagactaggccaggcgcagtggctcatgcctgtaatcccagcactgggaggctgaggcgggcagatcacttgaggtcaggagtttgagaccagcccagccaacatggtgaaaccctgtctctactaaaaatacaaaaaattagctgggcctggtggcacatgcctgtaatcccagctacttgggaggctgaggcaggagaattgcttgaacccaggaggcagaggttgcagtgaactgagatcgtgccattgcactccagcctgggcaacagagcaagattctatcttgaaaaaaaaactgcctaatctttcttttaaacaaaaaatatttatttatttattttgagacctaattatgaaagtggctgatttttgtatttttggtagagatggggttttgccatgttgcccaggctggtctccaactcctgggctcaagcaatcctccagcattggcctcccaaagtgctaggattacaggcatgagccaccacgctgggccagactaatttttctttatgtgtaaagaaaccatctttatttgtagattaagtcctgctggttttgaattctaagtgctacatatttgtacactctgcaccacactgatgtcacttctgcctctaactagtctttaagctcatcctcttgctccactccagtcaacatggaagccagcatgatccttctaaaacacaagctagtctctccctaagcctccttatcccctgtgagaaggtgtcaaagttctttactatgatttgcaaggtcctctgtgaacaggaccctgctcactctgcctcacctctccccatcctcacttcatcctttatcctctggccttgtgatgctaggaataatgacccccaaaggtaaccaagtcttaattcctggaacctatgaagcattaccctacattgcaaaaggcaccttgcaggtataattaaggatcttgagatagggaaattatcctgggttatttcagtgggccctaaatataatcacaagtatctttatcagagggagattagactacagaagaaaagaaggtcatctgaccagggagacagagactggagtgatgaggccacagcctaaggaatttggtcagctaccagaacctaaaagacacaaggaatgaattctattccctggagcctccagaaggaaccagccctgtcaataccttacatttattttttatttatttatttattttgagatggagtctcactctgtcacctgcactggagtgtagtggcacgatctcagctcactgcaaactctgcctcccaggttcaagcgattctcctgcctcagcctcccgagtagctgggattacaggtgcctgccaccacgcccagctaattttttgtatttttagcagagatggggttttgccatgttggccaggctggtctcgaactcctgacctcaactgatccaccaacctcggcctcccaaagtgttgggattacaggtgtgagccactgggccccgccaccaataccttaaatttagctgtgtaagattcacttcagatttctggcctccagaactgtatgaaaatgtatttctgtagttttaaaccactatgtttgtggaaactgttttcaggagcaatagaaaactaagataagccttgtcagatgacaatggttccagaatacatcctgctggtctttcgtctgaggctgttgggttgttctcccctttcttggtgatgcccctgtacaccctttgcctaacatatttctacccctttgttttaatcaatttaggcttctcccacaaattaccacagacggactggtttcagcaacaaaaatttctttctcatggttctggaggctgggaagcctgagaacaggcgccagcattgttgggttctggtgagggccctcttcctggttcaaagatggccagtttctcattgtgtactcacatggtggagagtggagaaaagaagcaaattctctcctgtctcttcttatatggacactaatgctattcatgagggctctaccctcacggcccaattacctaccaaaggctccatctccaaataccaccacattggggattagggtttcaacatatgaatttgggaggaacaaatgttcagtccacagcaccccttccttaaggttcacttcagtatcaccacctgctttcctagttgccccaggctgggtgaggacctccactcaggtttagcatcagacctgagcttttccttaccactgaattcaccacaaggtactgtcatggtgtgtgtttgactctccaaacaggcccccagggtgagccccagggtgggggcagaaatcaagaactgttcttcctagagtcctctctgtgtaatgtctagcacaaggacgagcacataagagtcttcgataaatatttattgtctgggtgtagtggcttacacctgtaatcccagcaatttgggaggctgaggtgggaggatcgcttgagcccaggaggttgaggctacagtaagctctgatcgtgccactgcgctctggcctgggtgacaaagaccctaaaaaaataataaataaataaataaataaataaatattgattgattgaatgaatgaatgaatggttaaagcttcttaacctcctggacgcaggtggctctcatgtccattgcagttcctctgtctcttcttatagcttatcatctgatccttgtacctgcgactgagccctaagaaatctccaagtcaaacattagccaggatcagatttgatagctgggctgtccactcaggatactgcaaaataaatactacacggaacaagcagaatactaaacaaaggacaaaatatttgaattttttttttttggtgaaaattagagctttgaatgcagaatgtggtaatgcctgattcttttttaacatgccattccttgatcttctcaagctagcccctgtagtactggcagctcaacgacctccctggtgattcattatgctctacaactaaactctaat

SEQ ID NO: 333 - DNA, 31238 bp, Homo sapiens
acaagtccactgtgacctcagatgtatatacatccacatctctaagagtctcctggttactagggaattccgcacaagttcctcacaaaattcacaagcaagaatatttagaatcatgaaattctaaatctgggaagaaccagagaaagtccatctggtctaacttttacattttccagataagaaaactaagtcccgagaagggactagttagggaaagagcaggcttttagactgctctttcctttgacctttgaaaacattttaatcaaagaacaatcataataaggggagtagaggaatgttatcattcacagggcttccaagtgactgtggaaaatcttgggaggctttgctttggactttgttatccatttagggactggctgttctgaattgttctctgtgctaggccttatctaaaccgcttgccttaaatctttgaccttcatttaaattgctgacactttccccttgtgaaactgtatcataatttcttctgtcttctttaggctagcagcatttccctttcttattcccagaagagctcagagaagcttatttttttagatgagtgatgcataaaaaggaatgtggctgcacaattctaattatttcataaagttctgaggtatttttagggtgttgcaaagtgctaataaaaaataatcatattcatggacatacagagtggaataatagacactggagactccacaaagtgggagggcagtgagggatgagaaattacctgttgggtacatcgtatactactcaggtgacagtcacactaaaagcccagactccaccactgtgcaatatatacatgtaacaaaaatgtaccctttaaatctataaaaaataaatcctttctagcccagtttgctaagggttttttttttcatgaagaacatttataataaactctttgttctgcataaaaaaggaataatgtttatgtctttatttcccattatgtgacttttaggctgctttctaaaattttgatttcttttcttcaggtggttaaaacagtatgattggacttgtttagagcatggtgctctttcacagaaagagaaacttgttccaaggcttcagcagtatcctaaccccctaacccagctggccgtctagcaaatattcacagcatacaagtttcgaaagtcagaatggctcggtgggagcctatggtgtcaccatacggaacacagtttgaaatgtgtgctcaaaccacgaagtattcccatatgcaaaggttcccacaggtctcaattgaatctgtataaaaaattaaaaaataaaaataaagttcccacaggtacaaagcgcagaataccttttctcagttctttccccttctttaggacttgaaaatcagaaatgcctctagtagaatctccgtgtcagcagaccatttaaaatatggctcatatgttttgctgctattcagttttaaggtcatttcctaagtttcaaactttgtgggaaacaggtgcaactgtgaaccttcgtgtggcagggaagagctggagcagtgaaacatgaaactacaaatcagttctctgagtcacaaatctcttgggctgctgtggaagacagtgatgactcagcagaattgcatgggactggtggagggtgaggcggctgagggctcagtgccctgagtaccaacctgttgggggtgctgccaaatgatgggagaccgagttggatcttcccactgctgagcccttccgcagactaagtcagaccccctgacctgggttctgaatggatttctgacccacccattgccatttagcacaatgatattttaaatattatacgcaaccacatcgtatatttccctagggtttgtttattacactaatgttacagatgagatagctgagtctgcctggctaagtggccaacgaatcagccatttaacctagcaaatgagatgcagcaatatggtcctcttcttgggaaaaagctatttgctttgtcaaaacaatgaaaataacaaagccttgagtaacccttcatcaaaataagacaaattttctgtctatgctttttggtttatgagaatgagaatgagaaggaaggtgacacactgatactcagttgtacaacttgaaaacactcctgaaggtacatcttttcagtggccaaatgattcaatcatcccgttgtgatgcctggagttggtttattagccaatgactcagagcctcaacttagaatgaataaaactcaataagcatcttcactagattcagatggaggtggtttttctgttcaaagacaacttccctttgaccatattttctccattataggaagcagaggatggatccagttatgtgaaagtctgaagaaaattgccaaaggatgggtcagccaaggtatacgcttgctcgtgactgtagaaggatacaggttgggatcaaagcagggatagttcaggatgttcctcaggaggtgtggcctcccaccttgctttcagaattaaagcaaaggactttcttttccttttgtattttgagaaattcacttttaatatcctcttcagtcctgagagtgaattgagctcaacactaatcaattaaatagttgactggtgtttaatgagtcaaatgctatgctgagttcaaaaagtatatcttggcttctactactatctggttgatgttagatatatgaaacgataatatcaggtagaaaaggacaagaggggtaggaattcagcggagaggaagttcatttggagttgtgataatcaggaaagtttgaaacatgttgcatttaaactgggcatgaaggacccgtaggatttagataggtggtgaggatatggataggcatttggacactaggaatggcatggaaaaggcaatgagttgagaggagacaatgtatattcaggggacagagacgatactgatttgtctgaagcaaagaatgtatagaataacaaaggatggtaatgctgaaaaagtagattggcaaactgttgaaaggcattgggaggcattgagggtttttgagcatgggagtgacatgatgaaactgctggcagctgtgcattggatggatcagaaggggacaagctcattgggatagacaaagatcatggatgtgctattagaaattttgggatcctcaacattcctgatccaggcaaacacagatacttccttttttaaaatttctagaatggagctatctgatgtaacttattggaatgatggaaatgttccatgctgcccaatatggtaaccactagccatatgggcctattgagcacttgaaatgtggctataaagactgaggaactcaattttaaattttaattaagtttgatttaaatagccacatgtgattagtgactactggattgggcagcacagctctagaaggcaggacagaggctatttattgattgaaaaccaaaccacacagttgccaaattagatcttaagtctgttggaattggtggggccaattctttaatataacccacaatcagcatcaatttacctgatttatcattatggtctggttttccgtgtatcaagacctcagcaacagtacccatttgtgccaatcactggttctgctctacaggcaaactgagtcaccccaaaaccctgccatttcagtttatcgctgtggccacatatccctcaactgaatagctgttaaatcatttgtaaactgctaaatgtctgttgctgcgtggataagctttagacctgttctatggtttgacctgcattctagcacatatgttgaaatatgaagttgctggttatcgtttggatgctaattgaagttactattgcccttgctttcggattaatgaggaaaatgatagtttaagaatttccaggcctggctggacacagtggctcatgcctgtaatcctagcaatttgggaggccgaggcgggtggatcgcttgagcccaggagttagagaccagtttgggcaacatagcgagaccccatctctaaaaatagtaataataataataaattaattaattaaatttaaaaaaagaatctccaggccaggcgtggtggctcactcctgtaatcccagcactttgggagtccaaggcaagaagattatttgagcccgggagtttgagattacagtcagctatgatcatgccattgtactccagcctgggggacagagcgagaccctatctcagaaaacaaaaaaagaaagaaaaaacccagcttgaagttagtgtaaacaactaaagcacaaaactatgatcttatcccactggacattttactatctgaattcactcacagtacttggtccctaagtctgtgtaaccattgctggctgcctttgacttaagggctcagttggttaaagcccaaagctgaggctcaagtcatgggtccagtctcattaatggccagttattttgctctgttcttattctatatcccggaccccactttctgtgttgcatatttatgacgttggtcacgagggtggcttgaccagagagggaacagaggaaggcaaatccatcaccacagctactagcaaaacaagcacaaatcctgtgaatggaggataagatatgttttctcctataaaaagcaaagtgtttcaaaataaaaaaaaaaaacaagaatgaggcactcaaagctagtgaatggtgctgtttggaaatactgcacttcagactactgagtatactggtgaccatcacaagctggaacatacaacaggacagttagtctggctatgagtcatttgaaatcatgggacactagccgggtgcggtggctcacgcctgtaatcccagcactttgggaggcggaggcaggcggatcacgaggtcaggagattgagaccatcctggctaacacggtgaaaccccatctctactgaaaatacaaaaaaattagccaggcatggtggcgggtgcctgttgtcccagctactcaggaggctgaggcaggagaatggcgtgaacccggcaggcggagcttgcagtgaggccaagatcgtgccactgtgctccagcctgggctacacagcaagactccgtctccaaaaaaaaaaaaaaaaaatcatgggacactaaacagacgccttatatgctaaaatggataatatttttctcatggtaagttgtcatggcctaacacttgcttattatgttctgatggtaacatattttcaaatttaaatgtaatgtaagaatgttccctctgctcattacctatatgagtcattcataaacattataacaacaaaaaagataatcacaaaattttaaatggaaaaataatggagtattttatttattgatagagataacaaaactttttgtaataatcctgaatagaatttaatgaaatgtaaatccaaacacaaacagcaagaatctgttctggcaattggagatgattagtgaagcggagaatcctgaatggtggatattcatctaagtactattggaccacggggtggagaaggagggagtcgaggatggtgaagaggtattactgactctcaaaccaaccaaccaaccaaccatatgtgtctctacctctctctcacacacacaattggatgtttgacagtgagcaagcctcttgacctctctagacctcagaggcaaaatgagaagtgtcctccagctagaaagcatcacaaattaaatgttttgctttaggttttcttccccaaacactccatattccttatgtaaaaatagagccattactacattcctatgatcgtattttaaattattgggtaagaagtatctctttataaaccaaattttcatcttaatctttgccacttctgcctcctaccccaaattaaaataaaaataaattctactacattgcaggagatagttataatgtaatgcttaagtgcttgggctctcagctagatttttgggttccacttaaattaggcaagtcactgactcgttcagtgcctcagttcctttgtaagaataatgatacctgtttcacaggatgggtaggaggatgaaataatacatttagcacaaggcctggccatagtcaatgctgagtaattattttttatttttattttttgagacagagtcttgtactgttgcccaggctggagtgcagtggtgcgatctctgctgactgcaacatctgcctcccaggttcaagcgattctcctgccttagtcttctgaatagctgggattacaggtgcctgccaccacgcccagcttattttttgtatttttagtagagacagggtttcactatgttggccaggctggtcttgaactcctgacctcatgatccacatgcctcagcctcccaaggtgctgggattacaggtgtcagccaccatgccgagcaagtaattgttatttttaaactatttccatttctccatttgcattctccatttctccatcttcaatatatgtatatgtgtgtatacatatatatgacagaggttatatatgtatatgttataatcatataacctcagacacagggtttcacagctagaaggaatttctacatcaagtacaaaactcttgttacatctgtgtcctttctgtcagattcagagggttagagtgatttggttagtgacggaaatgatacttaaacatgagattcctggcttgaggctgcatcgtttttacttttcttccatttacttttatcttatttaaataacttcctatagaacaatttcctttaaatatgaaatgttccataggtttttggttctcagtaaattatgatattacaataatgcggtttattctcctgattgctgatctcttcataaattaggacgtgtattcacttaaagcagtctatttgataatgaaaacccagtgatttctaaataggcagtcagaagaatctgctttatgaaacagacaaacccctaacattgggcctttaaaatgttcggatatcaagaccacgaatatattatctaaattagagcccctgagcaaggactcaagctctattttatgccccatccctgactcacagtaagatcctgggcaagtcacttgaccttcttatatttcagagtgtcaaactgtgaaaagcatgtccataaaactgtgcaagcatgacctcattataaacccgatgaacttgaaagcaaagatgtgctttgatacattaaagaattaccaaaatagaactctagtttgtaaaatatgaagaatcaggaaaataaattttactatactaagtaaaaggattctgaaatgtacagtttttagcaagtaaagtcataaaaagtttcaaaatgttatatttaggtgaaataaggttaatgacagaggaaaaatattattttagagaatgcttggctttcaaaaccatagattgtagcaacttaaccaaaataatcacaaggaatggaagactatcagaaacgagtagatccttaataattaaacacatttctaggccattatttccccctacttatacaatgcatatcatgttttaaaatgtatttcactggctgggagcggtggctcacacctgtaatcccagcactttgggaggccgaggcaggtggatcacttgaagtcaggagttcgagaccagcctggccaacatggtgaaaccccatctctactaaaaatacaaaaattagccaggcgtggtggcaggcacctgtacctgtaatcccagctactcagggggctgaggcaggagaatcgcttgaacccacaaggcgaaggttgcagtgagctgagattgcaccactgcactccagcctgggcaacagagtgaggctctgtctcaaaaaaaaaagaaaaaatgtatttcactaactactatatgaaaagccccagagaaagaataccaatacccttaggaaagaagcagttttagtattattattattattggatggagtctcgctctgtcaccaggctggaatgcgatggcgctatcttggctcactgcaacctccgatgccctggttcaagggattctcctgcctcagcctactgaaagtagctgagattacaggcacgcgccaccacacccagctaatttttgtatttttagtagagacaaggtttcactatgttggccaggatggtctcgatctcctgaccttgtgatccgcctgcttcggcctccccaagtgctgggattacaggtgtgagccaccgcgcccggccaagatgcagttttaataaggagtttggccatttaggcttgtaactgactggattattgcatattctttaaaattaatttgtattagtcccttttcttctatttccttatctccaactctcgcattagtatgcacgctttattcctactcaggttttcccctatgagcccaggagtattattattatttttttgcagggattaggatcaggtttgtgaagtgaatagtgtctttctaatctgcagagggaaggcagcatcccctggcttgctgctgcagcctctctttaaattaaacagcaggttcactctttctgcggcattccagaaggaacatcagtaggaacagctccacagatgctgacgtcttgtctaaggttatcccaagaagtcctgtggcatttgcaatgtgcctgtacatttttccttttttaaaaaacatattcctgcagactttgttgaaagcagaaacaaacacaagcaagcaaagccctttctagcacagcatgttaatcacacactttgccatattctgtgaaacagtaagcaaatgataacctccaactgttgcccgggccctgtaaaacagaagatcaaattctgtgttctgccttggcaagaaaagaaactgcagcattttgtctagatttttacaagtcctggggttcacattactggctgaaattgttctttctctactttacagaaaaatggaaaacactagtaaacttaaagatttaaatattattttaaaaggaatataataaaaaatggaaaacactagtatatttaaagatttaaatagtcttttaaaaggaatataatcaaaactgtagtttaaaatacaatctagctccataagagaggcaattggctgtgtgttccacttgtaatgcagaggatttgaagcatctattttttcccttgtttctatggatttatgaataaagactctgacccttctcaggatcaggaaaattacgaaaaatttaaagcctgggtttaaggtctgtagaagctgcacaggtacactaattttagtaagacgggcgccaggaaaaagaacaaaatagtaggggagaaatattcaggcatcctaaaaaatattcagtggaaacgtaaaaacattaaagactgattaaacatcgcagcatgacacagatttagcaactgagcataaataatttgactcggatactgctccaaaatccgaagaggaccaatttcttccaggaggacaactacctcgtcctctgcagacccctctcctcggcagctgaaggagtgtggccaatctgcctccacctccccgcggaccccctactctcaggacctcctgcagcaccccaaactggaagtggccgctgcagacccaaggacgaggggcacgcgggagccggcagccctagtggagcggttggagatgttgaggtgggagggtcacccaggtggggtgaggctggggtaggtagcggagtgaacggcttccgaagctctgggccgcccccaggttggactaagcaggcgctctgtcttcgcccccgcccagggtgggcgtctcctgaggactccccgccacacctgacccgagaccgcgcgcccagcctagaacgcttccccgacccagcgtagggccgccgcgactggcgcgcagggggcggcgggaggcctggcgaacccgggggcgggaccaggcgggcaaggcccggctgccgcagcgccgctctgcgcgaggcggctccgccgcggcggagggatacggcgcaccatatatatatcgcggggcgcagactcgcgctccggcagtggtgctgggagtgtcgtggacgccgtgccgttactcgtagtcaggcggcggcgcaggcggcggcggcggcatagcgcacagcgcgccttagcagcagcagcagcagcagcggcatcggaggtacccccgccgtcgcagcccccgcgctggtgcagccaccctcgctccctctgctcttcctcccttcgctcgcaccatggtaggtcgggagtggcaaatgccggcgtagcagctgcccgagatttcttcccagatttctagttgttttgtttgttttttgtttgtttttggttcttggaggtttttcttttctgagtgttacgcagcagctgcgcttaaaggaggttgcattttggatttgcatctcggcgacctctgccagggagcttcatttattggttccccttggagctggacttggtcgtaggccgtccacgggcaggggctccggccgcaactgcagcgggggtttctgcatccaatccccctgccccccgcccagccccgcacccactgcatccactagcgccgcacccgggctgcctgcagcgcagcgtttcggcctgggagccgggcggggccgggcactagacccccccccccggcccgcccctccccaccccgcttctccgccggcgcgaaggtggcaggtcgggcgggcagtggagaatgaatgggctggagctggccggtggcgcacattgttccggccgggtgttgaggggcgcagtcagcgcccgccacctccccactttggccggccctgctgggcgccctccctcggtcgctctcccctccttcttcccggggggcgcggcgcgggcgtgggctgggaaggaaggagccggggaagggtggggttgggggcaggaaggcgaggggttgggggcggagagggcggaagcggcggccgggccgccctgcgcccgggcggggccctgcggtgtggccgtggcttgttcctgccgctttcgcaccctgcggccccccacccagtgcagcagtgcgggcgggcgtgagcctcggtgcaccaggaggcacttcccgcgggaggcgctgggctcgcgctaattggggcggggggggggggcggcgggggaggagggaactggcgcgcggcttggtttccattagagacgcaaagtttctgctccgggaggaggcggcggcgccgcgggctcgtcgcctgggggagcagaagcgggtgggaggtgcgggtggccttggcctcagccctggtgcgcgggggccgggggtggtgaccctcctggccgaggaggggcggcgtccagacgcccgctcgggggccgccttcccccccacgcctgcccccgggcacgcgccctgcccggtccctcgccccgcgccacttccagtccgcagagagatgccctccacgtttctgctttctctgcagcctctagattgccagatgcgactgtgcgcctcgctgggtgtgttttccacagccccttcctcctcggcgtgcagggctgacatcaccgactgcgtttctggtttggcgggtggggagatggttccccgcagggttctggtacacctttgcccccagggctagcgccatttgggggaggaggttttcgttgtcgagaaagttggatgctcctggtaacccctctaacaagagagttctgtagcgaggtgggactgttctccccataaggtgacagtttctcttgcgaggtgtggcagcgcttcctgttgtacaagacagatgttgccttggcgttacgtaaatcatcgtgtctccgtcatttaaagaaagccaatttttagtgattgaggtagaaagaaagatccgtttataatttgtaaaaacaaattttcacccagaatcaatatattggaacaccattcctactgttaaagttttcacttaagagtataaacttcatcagctttctattaggacttattttgtaattggcttcttaggcatccttctttaaaagagaaatccacgttagctctccttgaggtctcgagttccctcggctggaggcacaggttcagtggagaccaaataatgcaggtgaattaccttcgtggccattactgcctccaacgaagtgtgtttattaagaacagttcttatgtcattcttaaggtaggtagggttaatactctccagcaaatttagtagatactctttgccagaaaagagaggagtatatatagtttgataattattgtgtagttttctgtgtacttaatttttgcagttttgtaacacttcatttgtaagatggtaccattttttcctggcttctgaatcataggatagtttgacccagggcattagccattgtaatggtaggcttttaacaaataactgcctaatttaaaggattggaaagcatttgttacatggaaatgaagttggtggcgtacccagttgctgtatctttattttttctacttaattatttctcataaaatggatataaaagcctgttaatccaacccaatgccattatgtaacgccagtttggagatttcgagggcctggagcagtgcgcaaggtgcgctgaaagcctgcccctggatgagatccttatcctggctgtgatggcagtggcagtgggctgggtcccttgttgagtggaaagggggactgcggtgtccatggtgcagtaggtggcgctcttctgtcttagagcctgccgccactgcagctggtgccaaggggccttctgccactagaggtgccatttttcacatgatgaacttagcctagttagatcgcagagcaagctgtaagccatgggcccagaaaagaaaacttgaagtgagcagatgttgtcacttccttgtaatcctttgttaaaatagcataaggagttttctttattctatttactttcattaaatgaccgtgctacaggtttcaaaggattttaagattgatttttgaaagatcacaatattaaaagtataactggaaaacctatgttgaaatcaaccaaacatgtcgtggactgaatgataaccttttctttcttcatataggctgatcagctgaccgaagaacagattgctggtaagttgacaactccaaggagtccccagaaggccagaactaggcactgactcagttttggtgactcctctgttcctccccgctacagtctgggcagttttctaagaatttatttaaataagaacagtaagcagaaacactgaggtcagatgttattcttgccagtactttatagatgaggtgaaaggaagtaaaactaaggatgcccacatgttaaactctggagaatttgaccatgtttcacaatgtgcaaagtttgcgtatgattaattgtactgagcctgctactcagcggtttagtttacaattcttatgccatgggtctttcagtaatctgccacgaaagcttgtgctcgctatcctaaaataaatggaaatgggtgaatatgagtgttaggaccactgtagtaattgggaagaaagttacattagttaaactctgttgcccaggctggtctctaactcctgggctcaagcaatcctcctgcctcagcctcctgagtagctgggactacaggcatgtgccaccacgtctggcagattttagctttttaatattcctggaggacttgttttgagactgtttctcgttaggaaaccaggaatgcttctgaaatattctaaaagtcatgtggagagagtttacctgggaatgtacatttctagtaaccattttatttgttatgaaacaagggattcttatggctttagaaatgtaacaggaagggatttgaagggggcacatggaccaatcttgtcagattggatttagtcccttgaacctgggaggcaggggttgtagtgagctgagattgcaccactgcactccaatctcggtgacagagcgagactccattgtttaaaaaaaaaaaaaaagattggatttaggactaatttaagcatgttccagcttagccgccttgaaacctttgggaatattgtggtgtgtggcactgtttattgggagcagtgtttgctttatgggctgctgtatgaaggccagtccaacaggactattgtggtcattatttcagtagataaagaccagacttctgatacgttgcacaacttgaatggctggctttggcaagcccccggcaagtgtgtattgtgactgggttggataaagacattgattctaacgggtcaacttttgttttcagaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaagagctttaaaaccatgaatgagggccattgttgtgtaattcaagttcagacatgttacaggattgtctttcaggtccccagagcaaagcaaatgtgcaaagatcctttctgtggttgccccagggccattgacaattaaaatagaagatgatgggccttgcgtccatcctgcttagtgtctagaatgttttctgcatgggatcactattgttttcttcctgcttggtgcgacctagagctcaaatctatttttttttttttttttggagacggagtctcgccctgtcgcccaggctggagtggcactggcgcgatctcggctcactgcaacctctgcctcttgggttccagcgattctcctgcgtcagccttctgagtagctggaattacaggcgtgtgtcgccacgcccagttagtgttttgtatctttagtagagatggggtttcaccatgttggccaggctggtctcaaactcctgacctcgtgatccgccctccccggcctcccaaagtgctgggattacaggcgtgaaccactgctcctggccgagctcaaagcttttatcaactggcccatgagtctgcactgagtcttgaggggggaggtgaaattaaatagccatagaaagtgctttttaacaaacttactgtgtttaaagaggaggaggaacccccagatgaagtaggtgacgagcactcttagaagttaccataaaagtgagtacagtgtgagctgtagatgtgtttgctgcagaggagcatgtgaggtttggaggcggatgtgtggtgactccaggggatagatttgcagaacctaacggaaagggaagctgtaaggtgcagggccagagggaaccagcagtaaccctgatagcggtctgtcatctgttcctctcgactctacagcagcggacaacagaactttgattgctgatttccatcagtaagcaggctttgaagcacacttccccacccctaaaaaaaaaccacgtattttggtaaatcctatatatattctaatgtactgtatgacagtatagaacatgatttttaaaagatgagttgggaggagaaaaggataaaagaaaaaataaaagaagcattaagaataaacaattcggatctagattttactttctagatgattgactcgagggtggtgtagtaaaatcgcttgtctggtcacaaacatttggcagcagagcttttgattaggttctttgacaaagccttcagcacgttagagtggttttcactaatagtgttttggaaagaaaaggttgtccatagttctctagtttgctaagatgatcagctacccaggaacgtggagtaacttcctcttgtttgtgggagccccgggaatctgtgcctggggaggggagaagtctgttaggctcttggattgtgtggaagaaggagaagttgtgccaggctacagaatcctgtgtttgcactgagaaaacaggatggtacctgaccttctctgcatggctgtgagatagcttaaaataatttcttttgtttttgatgaatatgaacaatatcttaaaatttttgaggctaaaaaagtcttgaagggatccctgaggtattttctttgaaaggtactggtgaaaatgagtaacttaacctaagggtttttctttctaattttatttccatttagttcaatgacactgttagtctggagtgcttgtctttgggggtattcatctcttagttttaaagaggagttgtttggagtactggccgtagaacagattgttctgacagttccctaagtgttactagtctgagctgtgagaatgctcctgagcttttcccttaatgggaaataaagatactgagttggaagaaaacaggtggctaaccatcatagcgtggccaagaaatgatcctggagaagacttggtaagacttcatggcccatgcatggcataacagaatcaatgttcctctctcataatcttttctcctctgaaacactttatacacttaacctgcagctcagttctaggccttttttgtgttactgctgtcactaaccaaggcagagtgagacctgagtgatttccctaactcagggatggcagtcgggggcgctttcttccctcggagtggaaagattcagcctgcggagtggtgtatgctatttttctcttgaactgtacagcccttcatgacccttccatgggcttgaatccagatgtgcagtttcctttgtataattaaatactatcctgggcactgatgatgagtttgaaattatgtgaaattgccctgtgaagtgtttgaacgttttagacctgcagatgattgaacctagtaagatagtctgcccctttgtcctagtacatgtttaccgttccgtacagtggttctgaaatgattactgcagagcagcgttaatggagtgcttactttacatgagctttttgttttttaattcgaggtaatggcaccattgacttccccgaatttttgactatgatggctagaaaaatgaaagatacagatagtgaagaagaaatccgtgaggcattccgagtctttgacaaggtaatccagcatctacatagcagatggtacttaagtatggcttcttccgctttcacttctaaaagctataataatgttatagacagaagacttaaatctaactgcctgagcctctgatctcactttcaaaaatcctccttatggtaaccgtatcaggggagggtaggcataataaataggaattttggaccatgtttcttgactgttactttgaattgttgtgagcttttgcaaatcctgttttctgcattagctgtttgcatgtatttagtaggttagaggtgggaactagagatcagagaattgtttatggcagcagagttagcagtaacttgagagggcatagctaagtcaaagacctacttccccacactacatcattagcaataacaattgctgaatgttcacaggatggcaatggttatatcagtgcagcagaactacgtcacgtcatgacaaacttaggagaaaaactaacagatgaagaagtagatgaaatgatcagagaagcagatattgatggagacggacaagtcaactatgaaggtaaaactaaattctctgagctcagtgtttcatagtcttacctttagatctgtaagcaagccaactgcttcactagacagcctttgactttattttatgtacagtaaagatgttgtgttcattaaagctgttttcaaagataaccaaaagttactattatatttgtcttttcagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtctttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccagggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaactgcgaactgtgtaggtttctagcttgcatagctttcaattccttttgctctcaacaagatagacctgccctcagatgtaatttcactgggtctctagtactgtgagagtgaggggccagaaataaccgtagacacatcccacaaccgtcttaccctagttttaagtagtttgagtgttaatagctgacattttaacctattctcttagcctattaacttgtccatgcttgctttttatgcggaaaatttacaccataaggattagtttccttttaaccccaatccaagcctctttaggacttgtataaagaaatacatttttttcaataagatgggaattttagatgacaaccaagatgataccttggttcatgtcaagagcgggacagctgaggaaagtggggtgggatgcaagtacaatttaggaccttggcattgaagccttccccttagtcaacactggcccagaccctggttcttagatgtagcaggagaggctgcctgcttctgccccctttgcttccagaaaggccttttccagctgcctcgtgtgtttcccactctgcccagaaggagtgagagggctgaaaagcggggcgggataaggccctgctttcgacagaaggcttgagacacatctccagaaagcatttaaagagcccctcctgcacataggagctgggactataaggacatggtcatcaccgtggagacggccctctgctctgaggctttagacctggcttctggatttggttctgtccctccagcctcaggcaggttctttacctttcccaggccttggtatcctccttggtaagatcatattggacttggtaccttctgcctgtggctttctaggattatgaccgacctggtttggcatcactttgtgtttagatagatgaaattgcagcctaaaggatgggaggcaaaattgtgtaggagtgctgtgtcctttgagatgacaaatgggatttaaaaattctcaccagcttcatgttggaggtggagtggaggttaagcttgctattaagacgtgatgtaatattggaacctgggtcagagaaactgattgttaagtgacttccattctcccaggacggaaataggaggctaccactgggcctgtaagggattcagtccaagtgacatcatctggttttcagcagctccggtttagaaaaacacacacacatttccgattcaagctgaactttcccgggcactggggggctggagcacccaatgactcaggatgccttagaaggaaataaaacataaagctttttatagcttggtgcttctctcccactgccctcaactctctgccaaggagtgggaggagttagctcatggaccagaactcccattaaagcccctgaactctgattaaatcaagtggcagttttcctcatgagaattatgttctttgtgtcaggaaccttaggaatgagtgtgaattgacacattcagattgtggggttttttttttctcttttgaggtggggtctcattctcactcaggctggagtgcagtggcacaatcacagctcactgcagcctccacctcccaggttcaaatgatcctcccacctcagcccccccagtagctgggactacagggatgtgctgctgtgctcagctaatttttaaatttttttatgcagacgcggtttcacatgttgcttaggctggtctcaaactcctgggctcaacaaatcctcccaccttggcctcccaaagtgttgggattacaagtgtgagccactgtgccttggctcagataatttttttttttttttttttttttttttgagacagagtcttgctctgtcactcaggctggagtgcagtggtgtgatcttggctcactgcaaccttcgcctcctgggttcaagcaattctcctgcctcagcctcctgagtagctgggactacaggcgcacaccaccacgtctggctaatttttgtatttttaatagagacggagtttcactatgttggcgaggctggttttgaactcctgacctcaggtcatctgtccgccttggcctcccaaagtgctgggattataggcatgagtcactgtacccagccccagatagtcttttcaatatcatatcttagttttattttcagttttacaaaggctaaaaggaaaatccagagtttcctctagcaatataattatttgaacattttgttacaacaagatctttagatcctggctgtatgtaagcatgtttgcttttaaactgatttttcattttgagtctttgtatacccttcaagttgtgattttttttaagttactgcattttttagcaaaagatagattttttcctgcatagacatatcagaatcaagatttgagatagattgttttaaaaatggaaaataagtaaaaaagtaattataaaatcatatcttagttaaaaggaacaggtcatataggtaaaacttcctctgagtgcaggtatccatatctggtgattctcaaacttggaatacttctaacactggacatctaatcctgtttccacaaggcagaacttgggctttctccctttcaatgacaagaagttaattaacagcccattcccatttttatttttatttttttgagatggagtcttgctctgtcgctcaggctggagtgcagtggcctgatctccactcactgcaagctccgcctcccaggttcacaccattctcctgcctcagcctcccgagtagctgggactacaggcgctcaccaccacaccctgctaattttttgtatttttagtagagacggggtttcaccgtgttagccaggatggtctcaatctcctgaccttgtgatccacccgcctcagcctccccaagtgctgagattacaggcatcagccaccgtgcctggccaacccattcccatttttacaaaagcatttttctgaatttaatagaaatgctgttgattatttaaaatttgtgatgtcaaatgacccataacctataaactatagctgagactctgtatttccttttggaatttttttctcaccatatggatgcagagatagggtttacaacatggggtcccactgtatgtgtaagttttttttttaataagcatactattctttagtatgtacaattacatgttgtatatatacgaatatattacaatcttcttactccttataactttttctcctcacgatataatttatgtaccataaaattcaccttttaaaaatacacaatttggtggtttttagtatattgacagggttgtacaaccatcaccactatataattttagaacactttcatcaccctgaaaaaccctgtacccattggcagtgattcccatcttcctttctgcctccttccccccatcccctaatccccggaaactactatattttctgtctccatggatatgcctattctagacccatataagtgaaatcatgtattcatactttttaaatcctctttttcccttttttttttttttttttttttctgagacggagtctctctctgttacccaggctagagtgcagtagcccaatcttggctcactgcaacctccccctccccggttcaagcgattctcctgcctcagcctcccaagtagctgggattacaggtgcacaccaccacacccggctaatttttgtatttttagtagagatggggttttgccatgttagccaggctggtcttgaactcttacctcaggtgatccacctgtctcggtctcccaaagtgctgggattacaggcacgagccactgcacccagcttcttttttactttttctactgaacatttctccatcgctttacattcttgaatataatttttaagatctggctgtattaatacagcatcatttagctaaccaataccctaataaaggccatttggcacattcccattattcttttcttatttctccaagaaacattccattttaagctgctttaactgtgagcacattcttactaggctggaatctgcttccttttaaccccacccattggtgctattgcagcttgtggagctaactctagacatctaatcctgtttccacaaggcagaccttggtcttcctcactgtcatggacccctcccgacttgtcaggcttaacattttgctccttttttattttttattttattttaattaattaattaattaattaattagagacagagtctcactctgtcgcccaggttggagtgcagtggcgcaatcgccactcactgcaacctctgcctcctgggttcaagtgattctcctgcctcagcctcctgagtagctgggattacaagcgcccgccaccacgcctggctaattttttgtatttttagtagagatggggtttcactatgttggccaggctggtcttgaactcctgacctcaggtgatccgcctgccttggcctcccaaagtgctgggattacaggcgtgagccactgcgcctggctggttgtgttttcgttaagtgcactggttttgagttggttgctccttcttttttaaaaccactctttgagagaaatcaacaagatgtagtgaaatttacccaggctgtgtattcaaacatctgtgttcaaatcctggaattactggcatgtgccaccacacccagctaatttttgtatttttagtagagatggggttttgccatgttggccgggctggtctcgaactcctggcctcaagtgatctgcctgcctctgccttccaaagtgttgggattacaggtatgagccaccatgcctggcctacaacatataccaactttaatatgtaagaactgatgcaggcatagcatgaaaatgcatcaagtaagaattaacaatggtaagaataagaaatccattattatagagattttaatatacttctggtaattgagaaatcaaccagacaatagaagatttgaaccacagaattaacaagtttgatctcttgtatatacatagaacattagacccagcaagtagagaatgcacatttgaaatattaaatattaatcagcactattattaatcacaaattaataaacaatataactatgtggttataatatataattgtaaatacaaatatataattatataaacaacaaattaatgatattagtgtaataaagttactaacaaatatcaattaagaagatattaattaaatagataattaggattgactacctgttagatcatagggtaaatctcaacaactactttaaaaatcctatcatattgacctagaaaataattccaaaaatacaactttaaaaataactgtttagaaaattaaaatccacttctaataacacatgggtaagaagaaatcataacgaaaatctagaaaatatttaggattgaatgaaagaaaattctacatttcaaaatgaggtacaacttaagcagtacttagaaatgtatagccttggccgggtgtggcggctcatgcctgtaatcccagcactttgggaggccaaggtgggtggatcacctgaggtcaggagttcgagaccagcctggccaacaaggtgaaaccttgtttctactcaaaacacaaaaattagctgggtgtggtggcaggcacctgtagtcccagctactcaggaggctgaggcatgagaatcgcttgaacctgggcagtggaggttgcagtgatctgagattgtgccgctgctctccagcctgggcaacagagcaagactccatctaaaaaaaaaaatttatagccttaaaatgcttataatggaaaagtagaaaggctaaaaataaataagctaagcatccaacttaggctagcaaaagaatagaataagctcaaagaaagtagaaggaaagtatcaaggataaccacagaaattaatgagaaacaaaacaaagaagatcgacacagacaaaaagtgggctcttttacaaaaagcatggcagtttgtcaaaaaaattaaacatggaattaccatatgatccagcaattccaattctggttacagacccaaaagaattgaaagcagggacttaaatagatatttgtacacttatattcatagcaacatttttcgaaataggcaaaggtggaagcacccaaatgtccactgacggaaggaaagataaaatatggtacagacatagaagagaatattattcagcctttaaaagtaagggaattctgacacatgctacaatgcggatgaatcttgaagacaggctaagtgaaataagccaggcacaacaaaacaaatactgtatgattccatttatatgaagtacttagggtagtgaaattcacacagaaagtagaatggatggttgccacagacaagggaatgaggcgttattgtttgatgggtatagagtttcagttttgtagaatgaaaaacttctgggccggctgcagtggctcaaacctgtaatcccagcactttgggaggctggggtgggtggatcacctgaggtcaagagttcaagaccagcctggccaacacagtgaaaccctgtctctactagaaatacaaaaattagccaagcatggtggcacatgcctgtagtcccagctacttgggaggctgaggtgggagaatcgcttgaacccaggaggcagaagttgcagtgagccaagatcacaccactgcacaccagtctgggtgacaagagacaaaaacaaaaacaaaaaaaagcaaacttgtggagatggatggtggtgatggctgcacaacagtgtgaatatacttaatgtcaccgagctgtatacttaacaatggttaaaatgattaattttatatgttttaccacaattttttttaaagtcaagaaagtgatgagaacattacagaaacctaatgttatcctggaacctgcttatattgcaggcgatgtttcatgtatcattgattattttctcctattattgcattcactcatatgctgtttaattattatagctttaaaataaaatctaatttctggtgtttcaagtgaaaaaaagattattagacaaacttcagggagtgctgattttttaaaaaatggttctttttgtttgtttgttttagagacagggtcttgttctgtcatccaggctggagtgcagtagtgcaatcataaaccagagattttttttttaagtgtattattaaaaagttgatgtggccaagcgcagtggctcatgcctgtaatcccagcacgatgggatgctgatgtgggagaatagcttgaggccaggagtttgagactagcctgggcaatatagctacaccccctctgtgtaaaaaaaaaaataagaaaagaaaagaaaagattgatgctagtaaatatgaagatgcataaaatggacaatttcctaaatttcctagaaaatggactcaagtagaaatcgaaaatttaaaataaactgttcaagaaattgaagcagtagtttaaagtatatgtatttgtgatggatgcttataaaatgatgttactttcccactgaatgagggaaatctttgtcccataatttttttttttttttttttttgatatggagtctcactgtgtcgcccaggctggagtgcagtggcgcgatcttggcttaccgcaacctccgcctcccaggttcaaccaattctcccacctcagcctcccaagtagctgggattacaggcgcgtgctaacacacccagctattttttttttttttgtatttttagtagagacagggttttgccatgttgcccagactggtcttgaatgcctggcctcaagtgatccacccaccttggcctcccaaagggctgggattataagcatgagccactgcacctggccaactgggccattctttctgccatccccatccaggtgccagacatgtaagcgaggccattttggatcctctagacgaggtcattcaccagctgaataacaccaggtagcctcagttgacctacacagagtggaagaaccatccagctgaactctgcttgaattcttcacccacaaaatcacgagataaaataaaatagtggttgttttaagctccataccatatggagtcctctgttttgaactaatagataaagcactactgaaaacaaaacaattatcccagagaatttaaaaaaaatcacactgtgactttttacctattcttgataaattcttccagaaaaatagaatttaaaaaaaagagcttatattaagaccaattaccacacaagaacagaagaaggaaaaaaaattacaggctggtcttatgtacatagatgcaaaaatatacaaatctaaatattaaacttaatttagcagtgcattaaataaaacatatcatgaccatgttggttttcacccaaccattcaacgcttatttcagtggaagaattgagtcccatgaggggaagaacaggctaacaaccaagcccatggaagggcagatgtcctgtggcttcttcggcttttctggaactgaggactcccactcctccatcaagactctgtctctcttgtctcgtgccttgccttccttcccatttcctgcagtctggcttttccctacagcaggaaacgtggccagcacgatttctaagctttacgtcctacagctttagccaggcagagataatctggctcagttccagttgcaacacttgtcatttttattatttttttagagatgaggtctcactgtgttgctctggctggcctcaaactcctgggttcaagcactcctcccacctcagcatccctaatagctgggactacaggcgcacgcccccacacctagttccagtttcatttttgagaaaggattctggtacagtttagctaagctgcccacccttggaccaatcaactgtaacaggaattggagtctagagaaaggactgtgtatcagttttcctcacgggtttgggggaggtggggaggtcagcaagttgatggcagggttcggtcctggaggaatggtcctggctggagagtcaaggcagaacccaagaggctttaatgtaatgttgttctgattgtattcttatagagtctagcatatagcaaaatttaatacattatagcttttttattttaaaatattacagtataattgcctttctcccttgtttttttgtttttttgttttttttttgagatggagtctcactctgttgcccaggctggagtccagtggcaagatctcagctcactgcgacctctgcctcccgggttcaagcaattctcctgcctcagcctcctgagtagctgggactacaggtatgtgccaccacgcccagctgattttttgtgtttttagtagagatggggtttcactgggctagccaggatggtcttgatctcctgacctcacgatccacccacctcagcctcccaaagtgctgggattacaggcgtgagccaccatgcctggcccattgtttttatttatttgtttgtttatttattttttatagaggagggatctcactatgttgcccagactggtctcgaactcccgggctaaagtgatcctcctgcctctgcctcccaaaatgctgggattacaggcgtgagccactgtgcccagcctctcccttgtttttttaaaaactgtgacgaaattcatataagataaaattaaccattttaaagcgtacaatgcaatggcatttagtacattcaaagtgctgtacgaccaccacctctatctagttccaaaacatttgcatcacccaaaagaaacccctgtgctcattaccgctcgctccccattcccccttcctcccagcccctggcaaccaccaatttgtgttctgcctctatggaattacctactcggaaaatttcatataaatggaatcataccatatgtggtttttgtctggcttttttcacttagcatggtgttttcaaggtttatccacattgtagcaggtatcagtattttgttcctctttatggctgaataatattccactgtctggacataccacattttgtttacc

SEQ ID NO: 334 - DNA, 137383 bp, Homo sapiens
tttatgcttacagttatgctataagctaggtaaggaactatgggatgagtttggaagagaagcacatggccagttataattttgcttcaaaagcctaaagatgccttaaacagcctgtttttgaaaatgatccctcgtgaatttatctaagtctatcataaacatattttgatacatattacataattttcaaagtagttatgtagtactgtagcatatttacatgactcaaataataaaaacatgtaaaaaggtatacagagaacttcccactttgttccctttctgtaagttcccatccttcccagcaaggaatgttattattaggtctttgtttttacttctgatgaattattatatatttgctagccaacacagatatataattctgtgttcccttaattttttataagtggtagcatgacatctatttatatgagtataaaatgaggtatgtacatatttattcattgcagcattttttgtagtagcaaaaatttgaaaatggctttagtgtccatcagagggagactaatcaagttgaggaatatctacactatggagtagtatgcagttgtaaaaaggaatgggaggtgatccctatatacctataatgaaagatccgtcagtctgttagggctgctataacaaaatgtcatcagctgggaggcttatgaacaacagaaatttatttttcacagttctggaggtaggaaagtccaaggtgaaggtgctagcagatttgatgtctaggggcagagggaaattatttctggttgcagacagctgttatctccttgtatcctcacatggtggagggcagagagaatacttctttcatgtctttttttataagggcattaatcctattcctgagagctctaccctcatgactgaatcgtcttctaaaggcaccacctcctaataccaccacactggggattaggtttcagcatataaattttggggggaacacattcagtccatagccagatctccagaatacattaagtggaaaatgtaagatatagaacaatgtatacactatgtgctttcgggtaagaaggtggggcagtaagggtatatatttgcattttcttgcatctgaatacagaacaatctggaaaaagtacaagaaacaaataaagtcttaatttagatagggtgaaggaagtatgatgatcagggacaaggaagagtgtgacaatttccaatgtttactgtgttctagcatcttttgagtcatgcaaatacatttcctatttaaaataaaaaataaaaataatagttaattaaatgtacatccctgggatctgataatcacacctccaggaacctagcctaaaaatattttcttacacatgttcaaagacatctgcaaggatgtttgctgcagcattatttcaacagcaaaagactagaaatgacttaaatatctattaaaagtagaccagttaagtgagttaggttgcattcatagaatgaaacactatatagatgttacaaagaatgtgaaacatatattaatatggaaagctctccaagacacattaaagtgaaaaaatgcaaaaaacattgtgcttttttgagaaatgtccattcaagttctttgcccatttttaataagagtagtttcttgttactgagtagtttgagttcctttgtgtattttggatattagtcctttatccaatgtataatttgcaaatattttctcctaatctgtggtttgtgtcttcattttattgtttcatttgctgtgcagaagctttttattttgttgcaactccatttgtctattttcgctttcatttctcaaaagaagacataccaatggccaacagatatatgaaaaaaatgctcaacatctataattatcagaaaaaaatgaaaattcaaatcacaatgagatatcacatcagacctattagattggctattaacaaaaagatgaaagataacaaagatgagaatgtggagcaaagggaactcttatacactgttggtggtattgtaaatgagcacagccatttttggaaacagtatagtggttcctccaaaaactaaaaatagaatgactatatgatccagtaatcccactactgtgtatatacccaaaggaattgtaatcagtgtgctgaagagatgtctgcactcccatgttcattgcagcattcacaatagccaagatatggaaacaacctaagtgacccgaatcgacaaacgaatggatttaaaagatgtagtatataatcacaatggaatgccattcagccttaaaaaaacaaaacaaaacaggaaatggtgtcatttgtgacaacatggattagcctagaggacattatgttaagtgaaataagccaggcacagagggacaaataccacttaggtctcacttttatgtggaatcttaacaactcagaagtatagagtagaatggtggttaccagaggctgggggaatgaggaatgggtggacagggaagggggagacattgatcaacaggttcacggttacagataaatagaaggaataagtgttggcaatctattgcacagcacaacgattatagttaataataatgtatatttcaaaatagctgaaaaaagaggattttaagcattttcaccacaaatcaatgattaatatttgaggtgatggatatgcaagttagcctgatttgatcattccacaatttacacatgtatcaaaacataacattgcattccataaatacatataattactatttgtcaattaaaaataaaataagacaaaaaaagaaattaccaaaaagaacatacaaaacacattctgcttctattttttataaaataaataagatgtatgcatatactcccaccaacataccctgtattcttattttaaaagaatgtgtggaccgggcgcagtggctcaccccggtaattccaacactttgggaggccaaggtgggtggatcatgaggtcaagagatcaagaccatccaggccaacatggtgaaaccctgtctctactaaaaatacaaaaattagccgggcatggtggcacatgcctgtagtccctgctacttgggaggctgaggcaggggaatcgtttgaacccgggaggcagaggttcagtgaggcgagatcatgccactgcactccagcctggtgacagagcaagatttcatttcaaaaaaaaaaaaaaagaatgtgtatgtgccatatgatgcatgtgtaagtgtgtatatgtgcatggaaaatttctgggagcaaataaattgttaacagtggtgagctctgggaaggggatgagaatgtttagggtaggagagttgccttctttttattgcaatgacttttgaattgcatgacttttcttttactgtgtatgtgttttcctttttgaattaaaaaatataaataaataaatgtacaactgtacgatgaagattatacacgtgtaaaacaaacaactgagaaaactatatgtacttatacagaagtgtctccaagatacattgtgaagcaatttttatttttaattttagctactacagggtttcccatactgtgtgctacctgctttacattctatctggagatcaactcacaacatttttcatgactttatgtttgatcatatcacatctctgccttcctgaccgaggaagactattgtttgttgcagtctgttttcctcacctgtgagacttgatggcagtctttgggttgaaatcctagctcttattgcttatgaacataagcaactgttgtgggcctcatactatatctgtaaataagaaaatagatatggtacaggaatgttataagaatgtgagataatgtaagcatgtactacttaccatatgaggactgccattaacactacttgtgatatggcagttagaactgcagaaaggagtgaccacaccttggttttgcaccgggagaggtgaagttttttgtgtcatggccaagaatgttctagaggaagcccagcatttgactggctttttgggctcagtagtctcagaccagtatctcaaagaatgagccacaagtgatagttcagaattcatgatcctgtgggtgcagtgcgggctttgttcttgcctgtgtggaggcatttcactgcccctcttaggggagcttatttccatgatgcaaccatgtgttttatctggtggctttactctcaggatgcctcctgttgtcaattgttgccttcagtgcattaggcatatgtttgaatccatatttatgaacaatgtctttcaaaatagtgaattaaaatgtccatgttgtctttcttcatctttacgaggtaaaggaaaaatagttgcctttccatattctttccattttagagctactcagagctctcagtgcagctctaggtcaagtggtcttactgattatcaagttggctttctgccttgatgcatttataggagcttttattattgactttggagctccttgcaaggtactccaaaaaagcattttaaaatagtctccagtgggcagtttacattttaactgctcctttcattatcttcctcaacacccttatacagttcccttttctagaattaaataaccacacgatagcttttgggctccatgtctttttcggatgttgaacttggccctgttgttgtctttattatgttgtggttcagcgagagtctcatgctttttcacattcatcacctttctcctagtttttgttttcatgttgtatggcaacttgataaattaagggccaaatatttagtgccaccctggttttttttttttgttttaagaattcctttgagaatcactgtcaatgtgataagaggcagaatcgtgtgatacataagaatgtgggtgcaagaagaaagactgaagaccaacattttccaaaagtcccatggttccaggtgaatgtaaagtcttcttccaccattaattaatctatgatttaagactgaagatctgcctgtctcttgagtcttatttttgaggccacagtactttgcagaccatttttctagaaatatagactctgatttcaggttctcttgcttcactttcctatatcacacttccacaaatcccagagcagggcctgccagctctctaggtttctcttctctcatccacactcgtcgtccctaatggcagcctgattgatcttatgctgaaggccaagagctcaatgaattgtgagaatttctggtggaatttcttggtagaaaatagctcttcacaggtccaatactaatgtttccaaaactgtaagtcagagagaactccctaccccacaacacatatacatccctttccataatatgttcctagtacccttgagactatattgggggtggtatacactgggtttgacctaaaatggtaatccttatgtggactaaaaaaagaaatttttctttttctagttttcttgttttaattaaagaaagaacctatgttttgccatctacttcaaaatatgccaaaagggagcaacaactgccacaagaaccagttcatactcaactcatcccatggtgtggcagtctcgtggacacgtagctaagttacaggggatgaaactagcacacttgtgtctaagagagagagaaactaaagatagtaaagaaagtggaattgtatccttgggaaagatcttcaacacatggttaaataaagagacaaccatgaggtatatttcacttatcaatttgagtagaattgaaaaataatgcatctcaatactggtgatgatgtgagaaaattagcactcatagtctgctggtgagagagtaagttggaacaatctggaggtaaatttagcaatctatctcaagagccttacaataggtgcgccttttgacttagaaattccacttccagaaatctattctaagggaaaaatagacataatgaagaagctagcttattggtacttcattatagcatcaattgagtaaaaaattagagtgaccttaagggctgaataaagaaaactggttaaatgtattgtaatacacaagaataaagttatagatgaaaaagggcatggaaagatattcatgatgtatgcatgaaaaaaatcccattaacaaactgtatagagtgttggctaatgataattctcaaaaaagacagctagaaaaacttattgaccaagaaaagctaagtttatcagatttatttcaacaaagaagaacatcttcttgacagagtcttagtagcacatcagaagggaaggatatttacagggtcttagggccatttagggccaaatgattataaggtgggtcttgaaaggcagaaaacgggctgggattgggcaaagtttataatgtaaaagctttgaatccatgcgcactgtaaggtgaggtcttggacaattattgtcgagcaagctgtaggtcttgataagtaagcaaatattttctggagaaagtagcaagttgtttttgtctggtcctagtattgtttggcatagaaacagaaaaatatatttggccccagaattgtttatcatggggacaggaaggtacgttaggttcagttctctttttgttaaaaaaaaagtattcatatttatattcctatctcactagaaaaagtctgggaaaataattatttactaattaaaggtggttatctgtgggcagaaggattaccagtataatttattttttatttcttatctgtattttcaaaattttccctaatgaacctatatgcggaaaaaagatgcattcgtttaaaccttatttagtcagataattctaggattatagcacccagaatcaccctcccctcaaagcttctaacctgtttctaaatataacacctaatctaggcacaagtttgtggctaatttggacaactgactaaattattaactcatcaaaaccatgtgataaaatgagcttaggtagcttttcattttttcagccagacagataaatgctgtacacactgttttagaaggattcgttcttcagaagcaccttggaagcatatttaactaacacagacacctatttctctccttagctctctgttttcactctattttcagaattatggtacagtgggtgtcagggactagaaggaaatgaagagtgagatccaaggtgaacccagaagtctgcaatagtgtctcatgatctctccagtcaaccactaataaatacttttgagcatctaatatttgctgcgtcctagacaaggtgaggcacggcacaaaaattgaataacctacgctctatctcttaaaggagcttagtttgtaattggggacagggtggtaacagtgactaacacacaggaaacaattctagacagactgaaaatggtgtgaaaccaagcactgctccacagacggaatagtactgggttttaactggtctctattatggcatttgtattatgcatctcagcggtctagactccaaggcctatatggatttggaaataagagtgtttggggcattgagatattctacttaaaggaggattacattgaaacttgtttttctcatttccacatttttaaattaaaaatcttcccaaattttgagtatgctttactctttgcataaataaatgcagctgaatgaacccaattgcagggcctcagggtcatgtttattgcacgtggatgtagatttcagtgaatctaagtagaaggataggagacctatataatgtaaatcgactccaagtcatactctgaaatttactttaaaagaaaaaattcacatagacgaatacctgatggccatgtattttctggttattggcttctttccattaaagaagagcacagagagaccttccaatagattgaatgttccaattggttgaaatgtcattccacttaaaataaccctttattgccaaaaagtactcttcatcagagattgtataatctcatagacaaggagccttcataactcccttcgggaaactgaggcccagaaaggagccttgctcaagggcacatggtaatttaatgatggacctaagagtcaaattctcgtttctttgttttcagtcctgacttcctacctctccagtctaatactccatgccttttcccacaaggtaaaacttactgggggctctgggtaggttagctactagacataaaaacaaaagaaataaataaaagcagcataggtcacaacaactttgagtgtaatgagatactctcatttacaatgtcacttctctggaagcttctctggaacaggacttagtcttcctcaatactaggcacagtcactgccatcctgtgccccttggtttcttcacagaaccgttaaggaaaccaagacacagagagatgatgtctcccatgctcccagctcttggtcagcctggagagcagatgccctacattcacacagtggaagcctgggacgcctcctgggtgagcagtctaatgatctaactggctattaaaaaaacaaccaccacaaccaacttggctaatataccacttagaatgccttgggccactcgtggggtaaaagaaaatcaccatcaaacaatctgggatgaattacagaacaggaaatccagagttaggaccagtttcagggtttgttgatttagcaactctgtggtcacatcaaggacccaggttctgtctctgtctcttgctgcgttttgcagcatgttgcctttgccctgaggctgctaccctctcagggtccccagaggacggcagcacttccaggcctcatacccacaatcagaagcagtgacctaaggagtcactttcttaacaacaaggggatatttctcagaagttcctgagtaaatctgccttcacaatactgggcggaacttggtcaggagcccactttgaaaccaaccacagccagcaggatggcccagaccatttgtgctttactcttggaactggggatgaaatcaccctcgctccagtcatctgagggtgggagtgtgtgtgtagggtgggggagtagggaggagggaggtggtggactcctgacccaatcagagctctgcctgtggaagatgggagtcgggatggtggggtgaccaccagctgcatctactgcacctgtcctgagaccctagctgcccctcccatcaagatccacccctgggtctgctgtttcatttcttccaaggtaatgaagtgctgttatgactaccctttagcaatgtgaatgctcatagaagtcttcatcagacgtcacattggcttcaggtaaagcttactaaggactctgggaacctgaacccagagtcagtgatgtggtgttgagagtagggatttcagcctaggaacgcaagccactgagagccaacagagagctctgggcacaagaagaatgatattttaaggaattctttaaatcatacctggactgtcactgttgatctacctccatggatgacaatgcagatgggaaatatgagacactgaaagagcatcagtataattttttacctagcccaggtattatgaaagaatgtttatttagtcttgcaaaaaaaaaaaaattggttttaggatggctggttcacaaactttgtgcttttcgttttcttcttcctcttttccatttgcttttgatttttttgttttgttttgctttgtttgagagggagtctcgctctgtcggtgtcactcaggctggagtgcagtggtgcaatctcagctcactgcagcctccacctcccaggttcaagcaattctcctgcctcagcctccaaagtagctgggattacagtcgaatcacttgaggtcaggagttcgaggccagcctggccaacatggtgacacccccatctctactaaaatacaaaaattatccaggcatgctttgatttttaaaaagaatgaacattttcctttataatgggaaaataaattaacctttatgtggaaaaaaaaaaggtacttcatacttgtcatctaaaacagcacaggaaatccccacctcaaataagaagttagatgaccacttttgtaatatttgaaaataaaccaactttatttgaatcagtcaataccaatcaagactggaacacaaattggtaattggttcagattcatgaggaaaacactcagctgtatcttcattaaaaggcattttacatttattaaggcttgaaagcaagtcctgttattcatcaccatagttaaaggtctcgagaaaatcaagtaactatcatttggagtgtctttgtaaaatgaaacacttgttcttttacaaaagctaagcatcttttgttaagctagttaactccccagcttataaaataggacaacgaggtggccaggaaagtaagacaaattcaaacatcagctggataatttatattttaaatatatgtatagtcaatattgtgaaatctctaactctacataaaatacttcagatgactggatccttaaaagtacattttaccaaaaacagattgcttctatagaaacacagaatagcccaaaccttatattgaggcaacgtattttatttatttttggttgcaagaaaggaattggatctatttctttaacgttaaatgaaattatgcacactttggatcatacataattatgaatcgaaagtatcctgacactaagctgggagatgcatactgacaaaggggaagaatgtgtgttgatgaggagggcacatgttgcttgatttgaatgataaagagaaatggatagaagacaatggggctgtgtgcagcaggtcctgttcgcttaagttttcctaacatcagaatcagggtgcttcacatgcacatgtctttctctgatgctttcttaagattctccttaatgtcatttaaaaaaataagaaagtgatcccttgggaatcattgtacttagttttaaccatgagttaacatttcctttttccaaggaggatgacaccagcatcttgattcaccgtgcagttgagatggcccctggccagtgggaattgaggcgagtcacagaagtacttaccaaatactcacctgctgcttctagtttaatttaattttagacacacactctcacagtgatgctaaactctttacaagatagacccgcagcttcctgcctctgcctctctcttagttctatttgtccaggccttgctgatttctgggactctcatatggtcaagatctatttcaggcatgacctatcttatgacagttctaagatgcttggtattgtctgtctgtggagtggccatggggcacagaactgtgaagagcttctgttgtttcatttgataagggcctggaaagtcagcctgggaaaactcgcacttggtgtggcctttttctgataagatcaagacttcactggccccaccagcacaagaagggaatgctgaggacagggccatttcccaagataaaactagtttgggatcgtgtggccaaataagctgatggactctgtttccgacatttcagctcatttgcttagtgctaggtcactctacctctcgtttaaaagaatatagctatgctcacatctgtgactctgaatttatcaagcatttgactttctttatcaggagatgaagaaactgtgctttggatccatcatgattttacttatccagcttactttttacagttattaaaatcttactcaataccttctctctgggccaaactcagaagcaggcattgctgactagacagtgaattcaactcagtcattctgagtttgactcttgcttctgccttcgtctcccactaccctgcttcccccacccccaatagtgctgtgcaagtcaaagaagataaataaatacaaaataaaataagatctcaacacaaatacatcccctttctgtgccaccaaaatgctttctgagcgatttgtattcattcaggaccaatgaaaaggaagcctcctaccctatagctgtatagttgtggggtcccaactgcagaccctcccgtgctccctgagttgttcttgggacacctaaggacctcaccacactgttgctgagacatgatgtgctgcacatatgataagaaggccagacaggctgaagcatctggagaaagatctcttttgaaacaaaaaaaaaaaggaaggtaatattaatattattgttactttaatataccataataaatctagtcataagacaccataactaactcttagtccatagtcacttgcattatatgataatccagtgctgaaatataaagaaatttctgaattaagtacccagaagtgccttccttctgtactcctccctctctttcaaatggctatcattgatcatataacacccccacctccttgtcttaatatatttatctctgtaaaactagctcaaccacagaagggacatctagaaacagcaatattgatttggtttggcctgtttgtttttaaggactttccagttgctgaattctgaacatccaatccgagtccttggaattctgcagacttctctggggtggagtggcctcaccggaggcttggttctgttttctctgtggcaattggctatgattcacagatgtgtttccagaacagcccaactgtgggtctcagggaagtaaactgcctcttaggtcatcctgcctgtgctgtaaattcggggaaggatttctgagtacagcaggatttcacactaattaaaaggccttcgggatcatttcagccctcatcccccaggaggccagtttggggcttttccctacagtaaaaaaggactctttcctcaccagttctccttgttaaacatctccagggcacaatttccagggggacctggaaaggttccttttgaggtggaaatgaatcaactcattccgccttttcaaagctttctcaggcttataaagtgtcctactgagaaagttcctcttcctcaatgggctctaggagacctcctgcttcctctcctctgatttgatcaatgggttactttttttcttcagagatccctggaggcaggtaggtccagggattgcttgggttagaatttgttgatatttctatggaaaggacccgtgctatcctgcccttgctgagaaatgagccaagtccaggggctttccagcacttgggagcctcaccctttaccagcgaacactatagaagggggattgttgaaggtaagggcctgtggcaaatggattttctcaccgggcgttcactgggagaaggagttgatgagtgcatttttcttagtttcctctgcacaggtccccaagctcaggctgggtaagctttttaggagatgaaacttaaggagaatgacaaaagagtgaaatattagcttaaaaatttttccttttttttttcacctggcagttgagtcagattgtaggaaaattaacccagatgggtctacatttttcttcaagttcaaaccacatggtttcctagtcagaaagtctcatggactttcttcctaaggtgttctatgatcagaccacctcctaaatgtggcttttacccattacaggctacagttgaatcaggcaggagcagctgctggagagcacccagccgacagacctgcattccagaagcagcttggagaaactgggaagacatttttgacccattcttgggtttttactgtaaggttagcagttacatgatgccaccagtccaagacttagatcatgagagaaggcctttttaaaagtttaccagggaacatcgaggctcataaagaactcttttgtcttcacccatctctcctcctcccactcccatccactttctcatagctcaaaaaccactcattggtaagcacagtcaaacccaggcctgtaatcacctctgaaacaactactcctaagcaagcaaaccccatggctggtagaccccgtgggtattttggcatcaacactgctcccctcccctcccatcccagtcactgcagtttagaattgcatgccaatttccttttctggcagggcctggacggcatggaagccagggacagcatgggccaggtgcgcagcagcagcagcgcagcattcctggcactgcaacaaactgagaatgtgtctcaagtgactttccagtctggcccttagtgcccaataaccagagtgtcagaagtagtgagactgaagctgtgtttgccagacacccaagtccatagccagctcggtactcctccattcactctctctgtctcccctaatggggtaatagatctctttctaagaaggatgaagatggcgtttgtccttggccttgtaggtatggacggagaggagggtagaaaaggagttggtgttgcatgtttctaaagcatctgagaaggtattttgatattggcagaagaagctagtggcaatcccatatgtgggctctccaacactgactgaccccaaacatgctgagcccagatcaggctggccggccgaaaggtggactgtgtctatcatttctgctagattcctatgtgaggaggccagggatggtgctgaccttcatgaaagatagcaggctggagttcccatgataccagcaagatgaggcttgattataaaaagtgcgcctcaaggcagtgatacagaggagtctatgaagctggagtcttaggggagtggttgagtccttctgcagcggggatggggcaaaatggctgtgctcaggatcggctgaggcgtttggcgacatcagcgtaggccaactcgatctcactgtcagctgcacaggtgttggtgaactcatcacgggcataggcgttcttgaggtaccgccacaggcctgtcatctcagccgggatatcatagttgcggtatttcttggccacaatctaaaacagagatggcaggacagaggtggtgtgaaggcatgaaacaaatcattagaaagtgttagtggccgtcccagtgtgtgtgcactgcaggaaacctccgtgcatcaccacgggccatcagtgatatgtttgaaatgcaaggtggcagtgctgtcttctttttgttttgttttaatttaatttcttaagtaaacataatttgccctttgacctagtgtgtcaaattctaggaattttttctcaggaaataatcatggatggatataaagatttacctacacaattatgatcccagagctattttgaataacaaaaatggtgcacagcgccaaagtccaacaatatatgaatacatacattatcttacacaaataaaatgtcatagtggagggacattaaaaatgatgctgctaagaaaatctagtgatctggaaaactctccaagatagactattacatttaaagttcaagtataatgcatttggagaaacatgtatgatggctagatgtctatatacctatatattaccagtggttatgtctgattgatagaattaccaacaatttttcttttcttctttctcttattcactttgttttacacaggccagtttttcccttctttatttatagaagggaaaaaaaaccatgaaaagcaagttagatattggaatgtatatgtaggtttagactatgacataaaagtaagcaaatactgatttctgttctcgccctggtttgccacagtcaggggggatgtggactggagagttctggagaagtggtatttatgttgagagaaacaagagcaaagtgattaaaagcatgggctctggataccaactgactggatttgcaatcatggctccacttagcagctgtgtgacattgggcaggttacttaacctttctgagctccaatttctttatctctaaaatggatataataataaaacctactttggagtaataaattagttaatacacatcaaatgcttagaggagtgcctggcaaatagtaaatactcaataaacatcaagtattattataattcattgagacctagcttgtacccatttgcatgcattttcttaatggggacagcaggatggtttctttaatgaggtctctctagctgcggcagcttcatggacctgtgacctgtgcagtctcaccttgcactcagaagagccctgctgttgatttaatgctctggggtcaatgtgtggaaattcttaataatttttaaacagggcccccctgttttcactgtgcactagggcctgcacattagctggtcctcctctagcccttccaggctaggctagggtaggggtaacaggagagtagtatcacttctgactcccctccctccctcttttctgtccctttccttccctccctactcccttccttccttccttccttccatccttcctctctctttctctcactctctctctccttctcttccttccttccctcttttttttggggggatacaagggggtacatgtgcaggcttgttacctgggtataacgcatgatgctgaggtttggggtatgattggtcctgtcacctaaataatgagcatagtttttctacacttgccccctccatccctctgccaagtagtccccagtgtctattgttgccatctttatgtccgtgagtacctattgcttagctcctacttataagtgagaacatgtagtttcatgttttctgttcttgcattagtttgcttaggataatggcctccagctgcatccatgttgctaaaaaggacatgactttgtttctttacatggctatgtagtattccatgatgtatatgtaccatgttttgtttattcagtacactgttgatgggcacccaggttgatttcatgtctttgctattgtgaagagagctgtcataaatatatgaatgcatatgaaatttttttggtaaaacagtttattttcctttggatatataaccagtaatgggattgcttggtcaaatgatagttctgcttttagttctttgagaaatctccagagtgactgaactaatttacattcccattaacactgtataagtgttcccttttctccacagactaaccaacatctgttgctttttgactttttcacaatagccatcctgactggtgtgagggaggtgtctccttgtgcttttaatttgcgtttctctggtgactggtgatactgagctttttttttttttttttaatgtttgttggccacttattatgtctttttttgagaagtgtctgttcatgtcttttgcccactttttaatggtattatttgtttttttcttattcaattgtttaagttccttatagattctggatattagacctttgtcagatgcatagtttgcaaatacttcctcccattctgtgggctaactgttcactctgttgatagtttctatgtgcagaagctctttagtataattaagtcccacttgtcaatttttatttttgttgcaattgcttttgtaacttcatcataaattacttcccaaaactgatgtacagaatgtttcctggttttcttctaagattcttacaagttgaggtaaatctttaatccatattgagttactttttgtatatgatgaaaggtaggggtccaatttcattcttctgcatagggatagtcagctattccaaaaccatttattgaataggaagtcatttccccattgcttatttttgtcaattttgtggaagatcagatgaccgtaggtgtgtggctttatttctgggttctcttttctgttccattcatctatgtgtctgtttttgtacaagtaccatgttgttttggttactgtagccttatagtgcagtttgaagtcaggtaatgtgacacctccagctttgttctttttgcgtagggtggctttggctattccggctcatttttggttccacacgaatttttagaatagttttttctagttatgtgaaaaatgacattggtagattgataggaatggcattgaatctgcatattgctttggacagtatggccattttatcaatattatttcttccaatttatgagcatggaatgtttttccatttgtttgtgtcagctgcaatttccttaagtagtgttttatagctccccttgtagagattttaactccctggttagatgtagtcctagatattttattttattttatttttgcagctattataaattggagtatgttcttgatttggctctcaactttaatattgttagcatacagaaatgctactgatttttgtacattgactttttttttttttttgagatggagtttcgctcttgttgcccaggctggagtgcaatggtgcaatctctgctcactgcaacctctgcttcctggattcaagcgattctcctgcctcaacctcctgagtagctgggattacaggcatgcgccaccatgcccagctaattttgtgtttttagtagagacagagtttctccatgttggtcaggctggtctcgaactcccgacctcagtcgatccgcctgcctcagcctcccaaagtgctgggattacaggcatgagccactgtgcccggccacattgactttttatactgagactttactgaagttgtttatcagttccagaagccttctggtgaagtctttagggtttttgaggaatagaatcacatcaccagtaaagagagagaatgtgacttcttcttttcctatttgtatgccttttatttctttatcttgcctgattgctctggcaaggacttccactactacattgaataggagtggtgagagtgggcatccttgtcttgttgcagttttcaaggggaattatcccagtttttgcccattcagtaagatgttggctgcagatttgtcatagatagatggctcttattattttgaggggtgttcctttaatgcctaatttattgaaggtttttgtcatgaagggatgttgaattttatccaaaggttttctgtgtctattgagatgatcatttcatttttgtttttaattctgtttatgtggcgaataacatttattgatttgtgtatgttgaaccaaccatgcatcctaagaagaagcctatttgatcaatgtgaattaactatttgatgtgctgctggatttggtttgctagtattttgttgtgaattttttgtgtctatgttcatcagggatattggcttgaagttttcttttttcattgtgtctttgtcaggttttggtatcagggtggtgctagcttcatagaatgagttaggaaggagtccttccttgatattttggaatagtttaagtacgattggtactggttcttctttttatgtcaggtaaaattcagctgtgaatccacctagtctggggcttttactggttggtaggtttttttaaattactgattcaatttcataactcaattagtatgttcagggtttcaatttcttcccaattcaatcttggaatattgactttgtatactgaacctttactgaagttgttgatcagttccaggagccttttggtgaagtctgtagggttttcaagaaatagaatcataatcagtaaagagagaatttaacttcttcttttcctacttgtaggccttttatttctttctcttgcccaattgctctggacttccactatgatgttgaataggagcggtgagtgggcatccttgtcttgttacagttttcaaggcaattgaaaagtgtatttctaggaatttatccatttcctctagattttctagtttgtgtgcatagggatgttcataatagtctttaaggatcttctgtatttctgtgagctcaattgtaatgtcttctttgtcatttctgattgtgcttatttggattttcttttttgttgttgttgttgttaatctagctaatggtttatggatcttctttatcctttcaaaaaaccaacttttggtttcattgattctttgtatgaatttttgggtctcaatttcattcagttctgctctgattttagttatttcttttactatactagctttgaggttagtttgttcctgtttttctagttcctctaggtgtgatgttactttgtcaatttgagatctttctaactttttgaggtaggcatttcgtgctataaactttccttgtaatattgcttttgctacatcctagagattttggtatgttgtgtctttgttttcatttatttcaaagaatgtttttacttttgccgtaattttgttgtttacccaaaagtaattcaggagtgagttgtttaatttcatgtaattgtgtgattttgagacatcttcttggtgttgatttctatttttgttccactgtggtccaagagtatgattgatataatttctattttttttaatttattgagatttgctttatgactgagcatgtggttgatcttggagtatgttctgtgtgcagatgaaaggaatgtatattctatggtcaatgggtggagtattcagtagatgtctgttatgtccaattgtcaagtgttgaatttgagtccagaatatctttgttagttttctgcctcgaagatctgtctaacgttgttagtgagttgttgaagtcccccattattattgtgtgttgttgctaagtcttttcataggtctagaagtacttgttttgtgaacctgggtgctccagtgttgggtgtgtatatatttagaatggttaagtcttcttgttgtagtcacccctttactattatgtaatgcccttctttgttctttttttttttttcactattgttggtttgtggtatgttttacctgatatgagaatagtgacccctgctcttttttatgttccatttgtgtaatagatctttcttcagccctttactttgagcctatgggtgttgttacatatgagaggggtctcttgaagacagcagatgagtggctcttattttttatccaaattgccactctatgtctttcaagtggggcacttagatcatttacattcaaggttaatattgatatgtgaggttttgatcttttcgtgaagctgttagctggttactttgtagtttctattgtgtgcttgctttatagggtctgttggctatttacaagtgtgtttttgtggtagcaggtatcattcttttgtttccatgtttagagtcccttaaggatctcttgtaagtatggtctaatggtaataaattcccttagcacttgcttgtctggaaaagattttatttctcctttgtttacaaagcttagtttggtgggatatgaagctcttggttggaatttctttctttaagaatgctgaaaataggccctcaatctcttctggcttgcaatatttctgctgagaagtctgctgttagcctgatggggttccatttgtatgtgttctgacctttttctctagctgcctttaagacttttttctttggcattgaccttggacagtttggtgactatataccttggtgaagttcattttgtatggtatctcacaggtgttctctggatttcttgtatctgtatatccaccttctaccttgctttcattttcagagagggccctagaccattgaccctgggatcctcccattcagagaagccccagatcagtcactctgggcttttgtctccattttggtgctggtaatatgcagagtttcccagaaagttatgctgaagtgaaggatgatgatgacttgatggatgaaaaactcactgttgcagacatgttcacagacatctgggaacattttttcccctctatgctcctaggccagtgttgaacttctgttataacactgagctataatctattctgaatcatgattactgtttcagtaccctttttttttctaacttgtgggcagtgtaaggatagcaatcacaggttcttcacttctgtactccttgataatctcaataatgatgttgatcagaggaatgataataacaaacatttattcactgtgtgctctgttccagggactgctttaagtactttgcaaggtacttaaatctctaaataatcctataaggaagaatctattatattcccatttacagatgagaaaagcaagacaaagggagattaaataggttgggattcaaagtttacaatcttatctgtacatcagacaaggttctctagtgtcaagtgtaataaaataattttaaagactgaagatccctagcaatgagcaaactgaagctacaagagattatgtgacttaatgttacatgataaattaattaatttaaccaatatctattgagttaccattaatatttattacagtccttgctttataatccacagttctttctactttactactcagccctacatagctgataaagcaatgggtcggtctactcagaatccctcatgttccagccattaatttactgttgcttgtctccaaacctactcttctatttactattttttgtgatgctggggctaggactgagcagatcacatctcttctttgccagtgaatcctgttaggttctgccaagaggagttactggagagagccagcaaggttggaggaggagaagggagggagaagcccatgcttttcagcttcctctttctgtcagagtctccatttatttctgggagcagcagctgaatccagtttgctattttgtcaatactcacaggaccacttcatcatacccacgcagagaggccagcacatagcaggaactctgctttagaggctggatcccagccaacctgagcttggaccctggcaccagctgagcatcactttcaccgacattcagctctgcagggtccctcatctacagagcccctaagtttgtaagttttaataattccaacctcttccctttgttcctcctgccctaggagtagtagctgcctcttgaaggtagaacctcctagtatattttgcctttccagttctttactacatagtacttccttaaattctctctgttaaaataactggtttggtgtgggcaccaaagaagccacccccacactgttctgtctggcttaggtaactacaagcaagggtgatgaagtccgagtcctttgataaagctctcacaatgagagatgccaccacgatatctccccagtccctttctgttcactgaaagatgatgatcccttgggttgggccaagttcctttgagaagaggctgtcttggctaagagcaaattcatgcaggagtggtggcctgaccaagagaactggctggaatttatcagagtggatgaaaagggtctccaataagataaagggatccaaaagtatttttcacagtgacacactgattcatagagtagcctcaagtcatttcatactgaaattttattttcaggattttaaagggcagaatgttagtttcaatacagcagaaatgcaatttgtaaatatatacttctattgatgttggtgttccccttcttgtttgtctccagggctgaacatcgtcactatgctaggcaaggatcccagtgagcaaggaaaggcctgcagatgcctctcccaacgaagacctgtgcaccctgggccttggctgctgagctggtcatttcttcacacattggcttgactttgggagatgagaactaggagggggccagacaatgaatgttcaagccaaactctcatggagagcctgggccagagcaactctgcttccagggatggagataaacctgaaagcgagccacgcaagaggagagtgagcatgaaagcagcaagggggtaaggatgcacacggagatctgacgttcgcagggacttccatgctcatgttctgaatttgctctttcatatgaaaacagttagctcccacagcccagattaagttttggcatccgaagccaaactggaggcctgacttggcttccccttcgctctttgtgaactttagaggtttgccaggtttctgggatctgataagctggatcagcagaaatccaaagagataggggccaagggctggcctttgttctttcattggccatcttctttttgatctccagcttctctgggttaaccacccactgaattttctccaaggacagggcttcactgagtaatttaaggcaggtgggaattgaggaaatcacaggatgaagcccaaggcttgggagattcatttgtttgctttgttcaacaaatggtttttgagtggtagtgaatacatgtttgagcaagagaaaaggaaagaaggagggaaagaagaaaggaaaagaaggcaagaaggaatacaatccacttctgttcttctaggcatgagaaaaatgaattccaaaaagattaaatgatgtgcctcagctcatgctgctagttggcagcaaatacaggaccggaactcgggtctcctgatctttgcattgtatcactctgacacagtgtgactgagctggaattatatcatccctttcagtggtacttgttcctaaggagaagaagaataaaggatgatgggtggggcatgcagtagttaataacttcaaagagacatagattggctggacctacaagtgactattggcttggccccaaatccaaaatgttcttttctaaataggttgtatttgcccactccatttttatgcatgattccctctcagtcttcagctctaaggcatacggaaacaccagtgtacacacaactgagtgacttcagctcaagctggtacatgctctggttggagaggagatagcatttttgactcgggacttgagctgaaaaataataggcatatactcagctgacagatgattgaatctgagtcttctcagtgaagcatagaaataaactggatatcgtaaagacttacaccaggtgatcaaatgatcaatcaatgagtatttattgaatggccactgtgtgcccaccatcacactttaaaaagttcctttcctcacagagtttgctgtctggctgagacagtaagatataagcatgcgtaaaatagagcacagtatggctatctgatactaggctgacgagggtcaggaaagaatgggggaagaagtgctcattgacagagcttagggggatacaactactgtcttcaaatgaggtgaaggcaagcaaagctgttctctgttactctagagaaaaaatggatagcagggaggcatgcttgggctcattgtaaagaacaatgatttaataatcagagctatctaacatggtagggctggctcattaagcagagggctcctcgttctcagaggctgcagtcacagcttcacagaagcctgtcacagaaacagcagaaagtggtccaggttgaagtgggagattgttttggatgacctctaaatgtcctttccaactctcagattcccagggtttgttatataggagaggatgacactacatgctgcaaatggttagtaagtgcaatgatagcaagaaagtgacatcacttcttgcaacctccacctcttcatttgatagatgaggaaaataatgtgggctcaccttaggaagttgctggaggaagtgagaaggtgggtctgtgcacaaagaaaaaatgcatatgagggcacatttaatagagctgtaggggtgtagccagggaaatcctatgaggaagaggcctttggagtgatatgactgtatacaacaacgataattgcgactattacacatattaagcccccacaatatgccaagcactttcacgctgtatttactcttccaccaacacttgaagtaagcaatatatgcctattttataaatgaaaactgaagctcaaggaggccacacagccaacaagcagcagagggtgaccttgggtccttattacctgacttcagggtccaggttcttgaccaacaggtggtactgtccttgactcatccacacaggtgacctgggcctaagatggagctggatcttgcaggcccctgtgggtagagctctcttaccttgaccacatggagcttgggcaacagattgcagtcagccagggtcagctcatccccatccaggaacttgcgccgggaccccttgtcttccccacaagtgttggcgtcaatctcctctggtagaggggtgttcaggtagtcatccaatttctttagagccttggttaggcctctttcaagagctggcatgaaagagtaaaagggcctttattcaaacttcttgccagtggatacagtcatagggtcttcagagtggagtagctcatctagaatcctgtccccttcatcacactgccagctccccacacactgcagaatacctggaaaccattaacacaatgcagtagaagtgtactaaataggctgaaaaggcaaactctaaccaaacaataaacactagctaatcttttgctttgaaaaaaatacataaatatagaaacacagtctgggtgtggtggctcacacctgtaaccccagcactttgggaggccgaggcgggcagatcatgacgttaagagatcgaaaccaccctagccaatatggtgaaactccgtctctactaaaactacaaaaattagctgggcatggtggcacgcgcctgtagtcccagctactcgggaggctgaggcaagagaatcgcttgaacccaggaggcagaggttgcagtaagtgaaataatactagccaatttatttatttatttgtttgtttatttatttttgagacagagtctcactctgtcactaagctggagtgcagtggcgtgatctgggctcactgcaacctccgactccctggttcaaacgattttcctgcctcagcctctcgagtagctgggattacaggcacaagccaccacacccagctaatttttgtatttttagtagagacggagtttcaccatattggccaatatggtctcgatctcctgacctcatgatcggcccgccttggcctcccaaagtgctgggattacaggtgagagccaccatgcctggccaatactagccatttttttaaaaagttttggttatctataatttgctaatattccacatcaacctacatattacatttttaggaagaaaaggctattaaatgggtaaatataaactatatagaagttccaagacaaagatatgcatcagatattgtggaagtattaactatagctaacccaacccaagaagagttggggacaaggccttcagggggacttgacagggggaatagaacagccctttttgatgtcacccccagagaagtgatgggtaccagggaagaacacttgggttactctagggaagcttgttctaaaaatcactgctgtctcaaatggaagggctccaccacaaatgtgcaacccccagctgcacagaaagctgtcatgattatgactcaaggaatgaacacccaaaggaacataacatgggagaaggcttttacagtcttggtcaaataattatctgtcacataatttatttagacacaaaagcagacaaaatacccaaaagaacaactgtgggaagccatcatcactgaaaatcgttttgcccagaatctcgtagtcctttctaatcagagaacactaccatagaaactttctacttgagctcaaaggacaaacatggaggagatggctgaccagggcatcagtcactgcacctgtgtcatcagccccatccccagactctggtttagagcctgacactgagataatggaagtcgatcctgctgttcattccagtagatacaaggcggacactgccttctggaggcaaagccaagagggctgtactcttgttcagattttcccaagtgtgccttgttagccactcctctcataacccactttttgtcttttcatagaaggccttttgtttgagacaatggaaagacaccagcccaagataaatcaattgaacacttactggaatgtttgaaaactgcctggaggttgggcatagtttctcaatactttcttctccctggtgtggcatttgaactacttcatcatctgctttgtgtttccagtttgggagaacagagtaagcagggctgggaaaatgcagtatattccttaataattgtctagactgtgatgggattgcaaggctattcaaaggcaatggcagagggtgggtactaaacaatgcttattatgcttttctccctgaagcacttgtgatttatttgtttgcttgctcaatccctctacccctttcattcctggagattacagcaaaatcttgattataatgaagaaaggaagaatcaaatactgggcctgtcaaaatttgaccaactaatatcatctgagggaaagagtcatacgataggagatgagacattgcaggttctaatctcaaatggccctggagacctgagtgggctgttgcacaagtctgtgcccatgtcaccaggtctgggaaatatcatgaaatttggtgaaaagcctagagcagtgattgaagttccttgggaagatagttctttatatccctccggtaattcctcgagatggaaggcatcaagtctggtgacaggaatcattgttgattcatgttgcaactgtgacattccatggagctttccaagtcagcacattctggaaggcaccctctgtgtatcagtctcctcacttgggtttgtgtatttttgaccaggaatgtgagggctgcagttggtaacagccgtggtagaggaagaggagacaaggcaacagggaaaggactgcaaggcctgggactaaactgtgtttaaatctcaaggccgcccagggtgaattcactgggaagctgctgagccttaagcttcaaggtgtcttgctttcctgggtcccttccaagcgcttggatctgatttcaagaattctgtattggtacttattgtattgccttaaggcttcataaatcccacaaatgtcgttgatcctggcacttacatgtgaccttggacaagttcctctacttcactgagtttctgctttctcatctcaataacgggactaaggatccttcaccctgttaagaccactgctggggttaactcagataatgcagggaaagcacctaatacagtgcctggccaatacgaggacatcaattaatggtagttgttgctattgccttaccaaacgtggggtcctcctgttctctgttccttgccccatactcttggtcaatatattcctgaatatcccaaggtgcagtggagaatgggtgattttaagaagctccaaatttgtggccaactccctggagaggaaaatcaatagcctggagatttgcttcccttacttatttagtatacagccaaagccctgttccttatactcccttgggatgctccttggtgataagctgtgttgaaaggcacacccatagcaaaatagacacaacatgcctgtgtgctgaaacactaccatattatcggatagcaaatggcagtacccactatacgctctgccaattcttttcctcccacctgccaactcattcctctgaccctggctcaatctgccatccatagaatttaatgatctcttttgactgatggtacacaggtcatgaaactatttgaactttctgctctggtaggaacaagggggatgtgaaagaaactagagcaacaaaaagatgttaattctttgtgtttaattcctcgtaaatatttgatatcctcactccacataattactctgagtagttagatgggggtatccctccaactacagcaagtgagcctagggttggggcacccaagacgcaggatcactaacatcccagggacttgatagatacccagtgttttaactgctttcttcccctctccgcctctgctccccatacagatttattctgtaccacacacaaatgcactgggtaaaatatgtgatgaggaaacaaggggaatagttcataaatattctgagccatatgcaaacaatcttagatttatttttctcttttttaaggaggaaaaaaaatccacccattccatgatcacttccagattcattgaggttgatattacataagacccaatattgttttctcgtcgtagagaaataatgacttggaaacagcaatttgagctaagaaaataatatattcttaccagggcatggaggctgaatggggactggggagccaagactctaacccagcctccaacaagttcttgcaagaacagctcagccctggtttgctggcaaactcagtgcagcacaggtcctgatgagcataaggcaaagcagactcctggggctcaaaattcacatggagaggagcagatatcaaaggtggtctttgaaagaatgagaacagctctgtgggcccaggtggctgcacgctcaacttctcatatatggtttttctcttgtatgtgtgttgcagcaaaataaaaaccaggaacccacctgtgaccgttgtctgtagattggatgggtgtctgttcaactctccatggagaaggaggttgtggttattgggcactggcctgggccgagtaccctctgccctatcttgttccttttattgccctagtcccataccttagcaccagcaaggaaatacactcactgaattcccgcagtgagctagggatgtttatgcaactaccatttaaacacacaatgaggctattgagatggaaaatattattcatcgtcattcaacagatgaagaaactgagtcttagacttacccagggcacatacgcttatgcaagcacacacatagctggtccttaaaccattcaaactactcctgggacgtacaatggaaatgtgccttgctttgttttcaactgctatggtcttccttacaagctcctaacctctgggtggtggaaaaacaacaacaactttaatttcgtccattttggattataacctagtctgatgtaatcatctaaatagtccccctagagaattctgtctctttgcattgatatgctcagtttcccagagaacctgcccctccttgctctccttcctgagtcagtggcactgggaattggggactaggcccctgtgacctcacagcactggggagatggggtttctggaatctatgggtggaaggctttggaaagcgaatacaggttctgcatttcttctgtttgcttccttccagagtaaccatggggatgctgggtgggggttacaggtgggctgcttgcctccctccacaatctggaaggatacccaagcaaagcaccacacggagctcttaacatgctctagttccctgaccctcccccccaccacctctcctttcttcttcatccccaactcccctgtgctaggaagggtgggcttttcttttagttttcccaggtcaaatggcccaccaatcattgagcagaaagcctcgcggccttgctgcatagccagtacaactgtttctactctgtgagtcgaggcctccaggcagggtttttgatgggtaaaaattgagaaataaaagagtttagaacatcttagacaataggttgggtaaaagtctactgtcttgttgaaaatgctattttgaagatcaaaagctgaatattgaattcttttttctgtcttagagttccttttacagaaatcctaatctctctgaggtcaatgaatgcctagggcagattagaatcacgtactcagagtgacagagagaaaaaaatgttcaatcgattagctctattataatttaggtgcaaagcccaggatttaagcgcagggctattagattctaaaacataaactccttctactctgcaaggccacttctgggtgcaaggactgtcccatcactccttgggtattcacgtggcctgacaggtgctgcaaaatgttctcattcccctgacaaaagaggatggggttcccctcatgactcccccatgccttaccttccaactaatttggtaacatatttgtgttctgctaccagtgcttgatttcagatataattcttagtactttcagcgaccgtgatgaggtcaagaaggagttttctctgagtagaggggcaaccatgacccatcacatcacttttcaactctgcctgtactaggggccagtgctgtcacacgggctgtgtgacaatgaaacatctggtcaaaaagtgagaaatccatttggatttttcctaggaggaaagaaatatctagatattgagaaatacctggagcactgaatgaagtttttacttttcatcttctcatttgagatcatgttgatataaccaaagggtgcaaaaaaagtacagtggtggtttgagaaagaccatggcagacggagatgtctctggccatcacatatttttgaagagaaaatacaaagatggccacacttgttgacatttgatagtttaaaacgtgaatggtaacgtgatggaaacaaaaaataataataagaagaatatcaccacttactcatctgttggaagaagaagcctttctttccacaggcagctaggacaagaggaagagacactgagagagatcagatggactaggccaaagatccaggagcaagcgggatgtaggagccccagcagggcccaggaggattgggagggtgaggaaaagggcaggtgcaggccaagcaggcagaaatgtagatgctgctataacgagctcaattttgaggagaggcaaagatattctaaggggattttgaggatgttcagctctgtgatgggcagtgtaaccaatcccctcccccaccagaaaactttacataaagatctgcattcatctttcaggttttagaaatgagtcatgtagcttttttctcagttgccaaagtccttaaagaaagagaacagtagcccagttacagttaggttatatgagtatgaatgaccacacaaaggcaaaattataaagcaggtggaaactggggttttctcatccgcagtgacctttctaggactcatggcaggtaagggggggctgattttcaggtccctttgtcttttaaataatgtctacaccagattcttagaccacatgaagtcagaaatggcagcaaggttttagaagatgggaaggggactttctatcaggtctgatgggacgctctctgctgtgcctgggccctctggctatgtttgcatgtcactggtttcatcaaggaagaaacagagaatctgggtcgagtatgtcggggagccatggcttctgataacaaacacagtagcagagcagcacattcactctgccataagagatttgggtttgaatcctcagttatgcttgttcacaggttcacatcatctagtgtctggtgcagagtgagacttgattaaagttaactgctattattattattacagctatagaacttgggtttatgagaggatgaaggggaagaagacaccgagagaaagatgagagaagagatagctcaaggcagaaattcagtgtctgaagtgaagtttatctgaacatcctagcatgttccaggtccaaggagaatcctggagagcttgcaggatgaagcttgctcttgactttcctaacatgttagggatctaaagttgcctggaagcatctctttgggtttggctttgctctctccaggccacatgggtgtgtcacattttcttagtttgacagtttagagagttcatgtccacctttggcactgaaccaagaacactggacttggcctcatagccagagaggaggatgttgtcaaattggccctgggtgtgaacaacccaggggctcacatgggggaggcaattcccaggcctccgtttctaggcactgctaaaaacaggaaaggcagaaagacaaacagcggtttatgagaaagcaaaatgcaatggcaacttcaacagattccccactgttccctcgtgtggcgtcagctgggctacagagagtgtgcagcacgtggtgccatgggtattatttgtttgttctagaaagaatttcagcctcagaggggaggatgaattaaatgacaagctcctatagttctttccagtaagaagccagtaaatgattctttatttgaaagatagcgtttaagtcttacaattatggtgggttgggatataggacactgttggttgcccaccctcctctgtggtggggagaatggggtgttttctgatgtatttccaaggaattcagaaactttcttaaggaagacacagattctccacatagctgcttccccaagctctataggggattcttataaagaagcatctttttatttaatacagctccacaaatcacccttatatttggcgtatgttcagaagtattagtacaacaacaaaatgcatattttttttaaaggcaagagactttggccagtatttggctatgtttaaaacaccagcatggtaaacatttaggacaactttagcatgcctttagtataatattttcttaaagtatgaagggaggtagggactccagatccaaataattttctaaacctcttaaaagccacagtagatttgaagagaaagattatcacttaggtcttcgaattaagtttccttttgtgtactcatctgtagcatgtaagctgcctgaatgtttatttatcaacaggagaagggaggaagagagagagagagaaagagagagagatagagagagagagagagagagagactgactgaatgtgggaggaagctgcagagctagcgagctcaggagtgatcaggggagaagttctggttagggaacccggcccagactttagccatggggcagtggcgacaccttctggcttatccctgagcaaacaaacaaacaaacaaaaaactccccaaaaacctattgtgtattttccacagagaacatgtacgtgtgttttctattagactttccagaaactcataaatgattgtagaacccatcgtgctaatagaaagtacggcataaatgctgacggaagctattaatgctgattgtagtttatgtggccaaatgaatcaggctgaaatctgtgagtttttttatggttactttataacaggttatttttaagtatcaggccatagattaggtttaatgcggatgctcacacacttagaatgagctggttaagagagattctaactttatcagtcatccgttccagcgtttagacctagagatttttctcaattctccctcccccaaaacacttaggctgaagtacattcaccacattttgtcttgtttcatcctcaaatagccacatcttttacataagagccattcacaaacttaaaaactgcctctgtgccactgcaatgctagactgaaataattactggatttggtgattctgtgaatatcctacaaattctcttccagttgcccattcttttatttgttaaacaggcatctattcggtgcccactgtgggccaactttgtgcccctttccccacatggattgctgggtgaggaccctgatggggaaggtgggaagtgttgagtatatttaaggaaatacacatggtagtcattcattgagtattcatcggatcgtgaactgatttgatcaccatttcctaaatgacacactcttgtttaattcagcactacatacatattaaatagtggattatattaaatgttaatatacgcaagtcaagagcacagatcatgggaccagctgcctgggctggggtcctgaccctgacacatactagcttgggcaggttgcttaaccggtgcttgtttccttctctgcaaagtggagatcataacatggcataccttagagggttgctgggagcaataattgagtcatcacctgcagagggcttagtacagtgcccggcatgctgtaagcagttgttatgtacaatgtgtatgtgcaacgcatgatgatgctgatgtatgagaaacaaagcatacaaaaaaagcaacaaaaaattcttagagctgcaagaaaaaagtggctcttgcctctggctctgctcagtaaacatcgtgcttgactcatcctctgccctgaaatgctgacatgaacagggatattcagctgttcctttcattctgactctacagccagaaccacagtcccccagccgaaagccttcatcataacagatgtgaaatggggcaaccttaaaggttgggggtgactgatacttacacagaattccccagatatgctacaagtacacctggacctccctcccccttgctcagagcagttccctggataccctaatgtgccccagcaaaaattacagtttgtggggagaagctacccattggatgtttgagttgcacagcttttactacatgagtcttgcatctcctaaagtttgaagtgtgtagcaaattaaatgtgcaattttatacttctgtttcctgaaatctagtagggggtaaatgactcagatttttccagcaccaaaggagaatttaaaatagtgtgtcctttttggcaatggctaggacaggtattttcaccagagagagaaaaaatatcaccttaacttgaaagtgaatatataagaattgaatatacaagaattcagtctccttttatttgttactagtagaagacagagcccatatatatatatattttcagggtagcaatgtgccctatcaaaaatactcatcttcctagattcccagaatttcagctacagaaggccaaataaccaagttctggctaaagagatatcggtagaaattaatcaatgggcttctgggaaagataagatagatgcggctggcattgtctggaatgcggatgtgatgtttgggggtggagcaaccatcctgtgaaacaagaatgaaagtcacacacgaaagatggagaattaggagctctaagcagcagctcaattctcgacttctttcagcaactacatttgcctggaactctctactctctggacttcttgtcatgtgagaaaagcaaattcctcttaagaagtaaacatttatcaagagtgcttagaacagggcatggttcatagtaaaatgctatataggttttgctaataaaatacatgtttgctttagccactgtagtcaggcttctattacaaacagccaaacacaacatttgccaatatacataggtattgccaacatgccaacatgtcattattccgctttttttttttttttttgagatagagtctcgctctgtcacccaggctggaatgcaatggtgcgatctcagctcactgcaaactccatctccctggctcaagcaattcttctgcctcagcctcccaagtagctgggactacaggcgcgtgccaccacgcctggctaatttttgtatttttagtagagactgggtttcaccatattggccaggctggtcttgaactcctgacctcgtgatccgcctgccctggcctcccaaagtgctgagattacaggcatgagccgtcgcgctcagcctcattatttcacttttattctagcaccttgcacagcgtatggtactgaataagtatttgttgaaagaataagccgttcagtggggtttgaggaaagatgaaggaccctaaaatcatgtgactctatttatatacttatgtaataagctttaactctgtagaggaacaacagttccctttctttgtataatagtagcccttggtcttttgaggatagatgaagggattcaattagtttggcctgagataccctcccacagagtcccagccactttgttatcagagccaagagagaagcataggttagcatcaacctctctgccaaacgactcaggtaggactgaggcagtttcagacctgggcaaaatgttgagtaaaactcatcttagggtccccacaatggaaacagaacatggataactatcattgcaaacatcagtgggcatgagaccatcagagttagagctgagtgcaggaggtctgagaaatcacgtggctcaaccctcccctccccagaatgttctggaagggaagaggttctagacactagcacagagaaacatatatacacacacacacatacacacacacacacacatatatacatacatatacatatatatatatatattttattttttttattttttttgaaatggagtctcgctctgtcacccaggctggagtgcagtggtgtgatctcggctcactgcaagctccacctcctgggttcatggcattctcctgcctcagcctcccgagtagctgggactacaggcacccgccaccacacccggctaaattttttttttttttgtatttttagtagagatggggtttcaccatattggccaggctggtcttgaactcctgaccttgtgatccgcccccctcggcttcccaaagtgctgggattataggcatgagccaccgcgcccggccagagaaacgtattttatttaccttgatccagatcattaaatgctttgtccaccaggggtcttagaaaaataatttgacctctggctgctagctgaaaaaagtctagaatttagccttctgtgttttctcttttgactcttggtgaagtatcacttttaacaccaaatagaatttcccttgaatgtggttataaaaataatggtgaaaagaaaaatcccacttcagcgaagcccgccagcacactggccatcctagtgaggagagctgctcaggttcttgcattcttttattgattggttctaagtgagattattcaccatgaagcttgatatcatataacagaggctacaaaagcattgtatgttctcacgtcaaagacaatgctagtcacagaacatcataggatttaaatggggactgggaagttttaaataaatacagtcagagcataggggagtctgcaacatggggacagatttaaaaggtgaggttccacagcggggacaggaagtggctggaggacgtgcccgtggctctgatgaggccccgtcatcatctcccaagcaaaggcatagacaaggtagaggtgtgttgaagtgtttgtatacttttttttctctcatttaacaaatattgatggaccatctgccctgggtcagatgctgagctggggtctggggtgacaatgatgaaggaggcacacccagcatgcttcctcacagagacagctgctcagaaccctgtttctcacagcacagccctggaccaacagtgtccgaatcgcctgggagctctcaggccttgccccagatccactacctcaatatctgcttcgtaacaagaccctgtgggaaaccaggatatgccacccccaaaataggaaggattgttgagatgaagacaattcagaagaaacagaggcagtaaagctctctgccctccctctatttgtctaaaagcaggacgtagatttacaaagacaaaacgtatcttgcctccccccttctaccagggagaaccactgaaaacaacttaagacgcttatgctcctggagatggccctgcaggaatctacattgaacaagctttgctaactggcctttatctgccattcatttgctatcccccgaagttgctgcccctagagactcaaagtgttttttcccttgtcacatctctaaaagtttactgtcctttgatgaggatgctgtgaaactagaattcaaagccatctctttgagaactcctcattatagaaaatatacatgttaataaacttctgcttgtttttctcttgttaatctgtcttttgttacaggggtcccttccaactaagaacctatgggggttattcttcctctaaaacccccacgggattcaaatgtattcgcaaggtagaaaatggtctggctaacaagaggaatgaaaagaagtgctgctttatgcttaagccttaagtctgtgcctgtcttaactcatgaggctactccggctcagcctggaaacaagcttgagatggggtggagtgccttcctgcaagacggcgctggagcaggatttgaaagaaagcctggggttttaaagccaaagttccatgtagcaactttttcccaacaaattaccctctctaaactgctgataaagtcagaataccagactagatttaatccctggttttagttcttatgtctttgcaacactagttggtagcaaaagatgtttaaaagctgagaaatgctgaagcttttgctagaaggttcagtgcaccacctggatttcacatcttgtcattttcagccccagctctaccaaaaatgagggaatctgttctacaggttaacttatccagagatattctcccctaaaggtcagcagaaacttggaaaaagtttcctcaaagctacgtcctaaccacagacaaggggttatgaatgtagtaattgtataaaccaactgtgatactttcaacctacacacacacaatgaaatgtagacacacacacccatggacacactattgtacttctgtggtctgcatatcctgtgcttagtgggatattgtgtcccatcatgaatatattgtgtcccatcatgaatataattttgcatgtaagcactttcttttagattaattgaaatgagcctgtctaaggaggtatgtgatggcctttgccagtacataagaacatcagaacacacacgaagtgcataagtgtgtgtgtgtgtgtgtgtgtgtgtgtagagagagagagattgagaaacgtatttggttcctatgtgtagactgcacaaagacaagaggtgttggttgcataggatgaggtaacggtaggaagaggtgaaagaacatttaactcatgtgcaaatcagttatttaacgttcctttattccccaggtcttgatctgcatccaggccaggccaggagaactcattctggtcagacagcgggaaattccaccacatggaatggtgttggtggtctccgctctactccagtccaggagcccacacagcaaaattccactaatgaatgcgcccacccacgcagggcccagctctccccacccccttctccccatgcctgccccattcaacaggccacgccaccaccaaccgccttccttacaactgcccaaggattcgtttcaggagcaagatttgttaaattataaattggaagcatccacctcaataatgaaccaaatcaaagaccctctggaggaatccctcaggcagctcatgggagggaccagaggaagcatttgcccactcctctccctcctgccctcagccccaaggaccctccatgagggaggagacgaggacatgcaagtgcagagcccaccagacctccgaggtgggtcccaccgagcctaggttatttgtttttccttacaagaatgctagtcaaagcaaaactttaacccaacaaaccaacaaacaaaatacccctagttggctatttgcacacaggggttgccaaggaaggcagcctgaagggtccctttgtgaccagaggcgtttttgaaaggagacagcaatggctgctttatgaggaagtggtgagacggtcacatgttatccgcattgctgtggaggtcggcctgaccacccaggagccttcaccaagatggcctgataacagcccaccgtggggctcccaggcctctgcagcggtcttcctgggacccaactgtcctccaaaagaactgcttccaacagagtagacatggagccccacggccacctaagtgactctgtttctgagcatgctacagggtaattaggtttcacattcctgctgctttttacacacggccttagctttctcatcaggcctgtggcagagcacaaggcagaatgagaaggggggtgccgcatccatcccctggatggccaggccctccagacagggccactgtgacacgggggctgggggctgggagggaggaaggggagaaggcatgaagcgccttatgattgaagtggcttggaataataaatatacacactcttttttaaacgtggctcaccacatcctgggaatctggaaaaaatgccccacttcactgtccctcaccctcctccccacctaccccccagcagcagtggctttcatgacgcctgggggaaagcacagggcctttgataataaggggcttgttagttctaggctaacagccctcccaggccgctctgaatcctttcaagcacttttttattttaggtcaaggaagttcgtaaatgtaaagactcgagattgtagaaggagaagaggaaagggagaaagaagcatttgggggtagttgtcattgggaggggcagccagggacctcctatggtagatccgtcaggcctggtggacatgcccttcccttggtgtgggggacagataatggaaggtggctttgagccttgaagaagacctagccttgtttgaaccgtctaagctttggcttagataaaactgaatctttgtataggaagaccctttcgaatccacaggccttgaataaatcacatcagctggctctggcgacgattcctctgcctgccagaagagggcagcacatgcttcctcattacagggaaagctgggctgcccagtccaaagggtggacactaggtatggaggcggggggagcactgtgaaattaatagcagcagcagcaacagcagcagcaatagctatcacatattggtgcctactgtgtgccaggaactgtcctaagtgatttatatgcattaattcatctaattaacatgacaaatcttcaagagagggtgctattacaatctccatattaccgttgaggaggctgaggcatactgaaattaacagaacttgctattgtagccacggactgcctaagattgaggtcagcaaattacagtccaaggactaaatccagttcactgcctactttcatgctgccctcaagctaagtattgttttgtgttttacatttttgcatggttggaaaaaagtcaaaagaagaataatatttcatgaagtgagaatgatgtgaaattcaaatttcagtgtccacgaatgatgttttattggaacacagccctatttatttgtttacatattatctgtggctgctttatgattcctgcagcagaattgagcagagtctggtagaggctatgtagcttgcaaagcctaaactatttactatctgaccctatatagagaaagtttgccaagccctgacttatgaggaagagctacctgtttccaggcaagagggacagagaacagagttgctatttactggaaatggagctagtatcgctatcccagggcaatttagaagcaatgttgaacttgattcactttttttccaacagggcagctcaaggtcaagcaaaaggagggtctgacatgtcactgaatagcctcaaggaagtaataaaaggttagatctggaaaggactgtgaaagtccactattatgtctcaagtctaaggtgcacatttttttcactctttaacatctgtgaaatcaggcaatgtcttacaatcaaaatatgagaggttaagtgaaaacactttgtttaagtgatagcattttgttgttgtttcttagaggtttgtttgtttgtttgtttttgagatggaatcttgctctgtcacccaggctaaagtgcagtggcatgatcttggctcactgcgacctctgcctcccgggtttaagtggttctcctgcctcagcctcccaactagctggaattacaggtgtgcgccaccatgctcggctaatttttttgtagttttagtagagactgggttttgccatttggccaggctgatctcaaactcctgacctcaagtgatctgcccacctcggcctcccaaagtgctgggattataggtgtgtgccactgtgcccagccagtatttaaaataatagtgtcgtacaatcaatgacaccttagattaggcagttcctgcctccaaagatccagcctctttttggtcctttctgttgatgggatactcacttcttttgctggcagtccattctacagatttaattttaaagtttcttttcttttttctttttagacggagtctcattctgtcgccaggctggagtgcagtggcaccatctcggttcactgcaacctacaactccctggttcaagtaattctcctgcctcaacctctcaagtagatgggatataggcacatgcccccacgaccagctaatttttgtatttttagtagagacggggtttcaccatgttggccaggacggtctcaaactcgtgacctcgtgatcggcctgccttggcctcccaaagtgctgggattacaggcgtgagccaccatgcccggcctaattgtaaactttctaatgttgagctgaagtgtgtaagcctaaattttctatacatcaaatgaggatgatcttgcttaatacgtttactttaagagtcttaagatcttattaaaagggagcgaagggaaggaagcactgtgacccccggggtagggaggaccagagccggctgcaggaatcagtctgtcggtgtggtcacaccaggcagtctgcaagatgggaggacagggatgagttgttggggacacaaaccatgaaaacctggaaggaaaagaaagaccgccagtgatacagatgagttctttttctagcagcatcagccaggagcatgacccactgcaggtggcacctcttagaaggagaagacaggagcaatttgaagattcgggcctgaatggaacaagaagacaaggaaagagcgaggaatgcacctgtggctggcttgcccctgctgccttatatgagggctctaggagatgaggaagggaaatgagagaggcaggatgacagtcattgatattgtgttaataagaaccacaatgtcctccttcaatcacgttcccattcagtgggaatgatcatccaaattctgagataaactcactgaggttcctagaataacccgagagtcttcttccattctatgtggcagggacaatcaatttttccagaataagcccagggagcttccaggttccagaaagaggagcctctgatgtgagccttagggaggtggaaaccttggcctttatttggaaacagaaccaagactgctcagggacctgtgtggctaatggccacttttttgttccagcaacaaattgggaaccaggaggtggtgggaactagggtacactccctcgccctctggtaaccacgtttgagcttggattggagagaaaggagaagcagagggcttagccctaaccaggtgcttttcatctggggacatgtgtcctggatttcctgggacagtaccaatttcttataatttgattattttcaatgaaggcaatttgttaggcatctgattttcagtttggaaaacatggccactgcagttacaactgatgaagggcaatgcaatctgagcacatgcccagcacgtcacagataccaaggaaggtttttagggctttctttcggaagttagaagcaccttattaggacaagtattttaggaagagtatgttaggacatctcagagtcttccataaaaagagaactaggtgcagccttgcgagtgaaaggggtacatctttgcacatctagtgcaggagcccattcatcttgatgaaaatagataagcccagacaggctgttctgtgtcccatgtgctgggtggacagagaggggcagggaggttggcgacacacgcctgaggctgcagggaggtctcctgagtcttccagagaagatggagagaaaggaagaaagtgagtttcaggtgaagagagaacacagggattgtgagatcgggaggagcacagctcacaggtgggggaagatggagaggagtcagagcagcaggaagtcagcagggcctggagtctacagcagcctgaaagagaagtcacaggaggggagagccaaagaaaatggaaaccacagctcctccgtgcctgcggctcacagcaggaatatttgttattcttctgggaggctggtttgtttttatcttctaggaggaccgagctgcagctgaccaggggccctgttttgctttgtctgctcacaagtttagagccaaatttgtggtctaccttctgtgtggcgcacgaaggccccggggctgccctgactgttttagctcacccagggctccatttgatggttgtctccttgtttttctttctcacctcctcttggcctttgttggtttgccgtgctttatgcatccctgggagtagctataaagcctttctggaacaagtggagtataaattttaaaatagaaagaaggccccccaagacagaggaatacagaggtggaaataagagagaaaagtggacttgaagggggaagaaaagagggaattcaaaggaagccttgaaagactaaaaccatccagattgggcaaaacaccacttagtgcaggtcgcctgggaggcctgagagagcttaagccccaagactgcatgtgatacagatgagatactattgcccctggggcttttcagacctctcactaggggaaagggagtcctgtggaagtgggctgcgcaaaaggaggttggatggaaggtggtcagcgtgaatagagcaggagaaatactgaatttttgtcttaggctacaggcataggcatgcctacttcctctccagctaaaaagaaaaggggcaaaagcacatgagaatatgacactggcaccaaaaacaaggatggtaattcttggtaggacattaactgtatctgagggaaacatgatagacctggaagaaattttaaaaaggggtaggagacttttcaaattagttaatcaaaatagagcattcaagatgcacattagatccatttgttaattacctgccatatgcgatggggacagaacatgaaataaatcatgtgtattgctaggattgaagcataaggaaagagagattgtggaaaataaagtgaaatatagcactttctgcctagattatgataagtaactaaaatgaatttcttgaaaaccaagagatttgcagggatttttagagtctgttcaaatggcagattgagggtaagaaatgcaaaatgtaagacagatattcagagggagaagtccacatcctcttaggaatgacagagagtgggggacatgttaaagtaggtgtcaaagaaacccctttagggaagagacaaacccaaggagccaaaggggtgttccagtggcaggcggggaggggtgtttcacagcgacgcttgctagaggtggaggcactggcttgcagaaggtggaggcctgggcccttgctgaactccaccatgtgccaggcaggctgggtagagagcatgattaagggggaggacagacctaactgcttgctaattacagggatgctgcaggatgtgccaaaggggcatggatgacactgtgccctccctcaagccttctacttcagcactctatgaacctccaggtctaaacccagggcataacttctccctgcaagattgaaaaagtgaatgtggggctcagaggaggaacccctccagccaaatctaaatgcagtgctgctttctcccatctcaaagatgctctttcgcaggaccacgagcactcttcccatgtgggttcctgatccagttccctatcatcacccactggtcctcccctttctaagggagcagggtttgtgcttcctccatcagactgagctctctctggttgtgtagaatctgagtaatgggtggattccacatgagaaaagcagacagaaaaggatatccaagaacactttcagggagctgcacatagcaggcaaaagtctcccaggaccttctctgcagcattttataacacagatcactcttttaaaacaacaacaacaacaataaagcttgctttcccatctttatgccctccccactacccccgatttcctccatcctccctggctagtccttctttctcttcctccttgactcctctccctctgtcatcccatctatgtgattgatccttgggcatcgtcttaatcatctaaagatgtataacccctcaaactgcatttttataccagaactctctgctaaggtacaattgtctacccgagataactgctcagaacaacggctgactttttttttttttttttttttttttgagatggagtttcactcttgttgcccatgctggagtgcaatgacgtgatctcggctcactgcaacctccgcctcccgggttcaagtgattctcctgcctcggcctcctgagtagctgggattacaggtgcttgtcaccataccctgctaatttttgtatttttagtagagatggggttttgtcatgttggtcaggctggtctcgaactcccaacctccggtcatctgcctgccttggcctcccaaagtgctgggattacaggggtcagacaccatgcctggccccagcagctgactttgaacgtggtagtgggcattattccaagcacacttatgaggtatacacagttattacccccatttcacagatgaggaaactgaggcattacagagttgaagtaacctgtgccatgttacaaggacaagaggcaaagctggtgtctgaactctgaactctaaagtagttggctttagagtctgcaagttgagccatacacagtcacctgcctctctgcataggaaacacagcatgtttagaaacaccgtccttatccttctccccaaaaccaggcgtgtgggtgagagatcttagagcacaagaaaacgaagcaacttccccaagtagcacctgacttaatgtgggatcttgccaccgagtcatgagaaaatccagtctacatttaagtgaagtgaagagcaggttggaaagagtgagaggagggggcatggaggcagtatctggttactgcagaccaaggggacctggatctagaaattacagaggaggggtgagtacagtgataggcctaaacacggagcacagaatcgtccctcagggaacaaaaaaaaatgcaaggctgctgaggtatgagagttgggccaggccactgacgctccttgatgacactttggagaggaggaccatgcaccaacaaagtttaaaaagtagaaaatagactgaatgggtgggagatttggaagagctaactgagggggaagcaagagctgaagcagcagtttctgatgtcattattcatcttagtcccatttttgtgctaatagcaataatcagaataatcaaatttaacagttacgaggccagacactgcgctaagggttttacatgcgctgagttataaaatagatgaacctgcattacaaaccttggtgatattattaattaccttattgccagataaagaaactgaatgtaaagtccattttacagatgcagagccagaggctcagaaagaataagcctcttgggtaaagttgtgcagctagaagtgctgggattcaaacccaggccgggaattgcacatgtacttgttttacagctccctgtagattgttagttcatggagggcaatgactttgtctcgttgccttggcaactccagaacctagcacagtacctggcacataagcagtgccctttaaatattagctcggacttgtagtcactttatataacttgtggttttttgaatgaatcagtgaatgactgaatgtacaaactaatggatgattctctccattactccagtactgctgggatggctcccacggatggggtctcggttgtggtagctggggacttacaaggctttggggaacaacagggaaattttacttggtggttcctgtagccaccacaggagtggagtggagaggtgacccaccatggagaaccatgtaacagtgttggcttttctcatgctttcattttgagagggcagaaaaggatcatgacctgggccagtgtgtgtatgggggctggggcattagtgaccaggtagaggggagggagggctctgctcaagagaaagtaaatgaaaatacaagagaaaccctctaaagaaagaaagttggagaactaggtgcagagctgaagatccagagggaaaaaaatggcaaagtaatgtagggcggcatgtggaaggaggcctgggcctgaatgctgatgctcttggggagaggccacagccatggagctcacacagagcagaaaggggatggaccatctcccgggtcaggggctgtggggctctgggaccgtaacacaggagccatgctgctctctacaggagggcaagccttacaggagccttcacctctggcttgctaagcctaagaattttggacccagttgaccacaactcgggggtattgggtgggaggaaggacaagtaaagaggaagggaggggtgtgggcaagttatagttccagggaaggaatgtgtggtgtcttgttaaacagaaggtggaatagcacatctggggacaggctctttgggaaagcagcaatgttggagctttgaaatgtgcaaatgagttaggggaagcaggagtcacaagggcaagtctcattacagaagaaaacagggtgaaacagaagaaggggaaacaatgaaaattggagagtactgagtttataagaaatggatatgcggcatttggtggaaactggctttggacttgggaataggagaactgtaaatatggataatatgtaaacaccatttataattttaaaaatctggagggctcaaatgagataatctttctgagggcactttgacaagtatgaaagaagatatttgtggctaagaggaaaggatactgggtgtggagtctgaaaacgagggttcgagagccagctctgccttgggggtagacaagtcatgggtcttctcgtttggttctctgtcctcagccgggaaagcagcaatgactcttctttcccacaatggctctgaggggccatattcatttcctaggactgttacaacaaagtaccacaagctgggtggcttaacacaacagagacttttccccttacagttccaatatcaaggtattagtaggtgtccttccttgcctcttccagcttccggaaagctaagagttccctggcttgtgacagcatcaccccagtctctgactgtcttcacatggccttctctcctctacatgtctgtgtcctctcctctcctcttttttttttttttttttttttgagttggagtgtcgctctgttgcccaggcaacagtgtgatctcggctcattgcaaccttcgcctcctgggttcaagtcattctcctgcctcagcctcccaagaagctgggactacaggcatgtgccatcacatctggctaatttttgtatttttagtggagacgggggtctcagactcctgacctcaggtgatccacccaccttggcctcctacagtgctgggatgtagtcaagagccaccacacctggcccctctcctattcttataagaacaacagtcattggatttagggactacactaaatgcaagatgatctcatcgccaaatccttaactaattacagctgcaaagaccctatttccaaatgaggtcacgttctgagatcccaggtggacatacatttaaaaaaatttttttagagacaggaccttgctctttcacccaggttggagtacagtggcataatcatagctcactgcagcttcgacctcccaggttcaagcaatcctcttgtcatggcttcctgaatagctgggactacaggcatacatcaccttgctcagctaattaaaaacaagttttttttttttttgtaaagacagggtcttactatgttgcccaggctagacatgaattctggggggacactactcaacacactatagggttcaagcagcaatgaagcaagagcaccaagtagattgaaagtactttccacatgcttcttcttatttcccagaagccactctctttctagtttcttgacacacacctctaatggatgtcattgcccacaagataaaaacccaagccctccaagctggcactgtgggcttcagtcactttttccagtctctgtccctgactttttctcaacttccccgcatcttctgctcaatgatctcagccaactgcttccttcttaatctttatgacccagttgaaactcccagaaaaggagtctcatgcatttacccccatggtaaatgcttctggttctgaataccttcgacagaaattattttgttcttttacctgcagttaatcagctctccagaccctcttggatcaaactgacttgaagcctgtccttctgcatctgccaggcattgaagactgaggaagtgtttgtttcttctttggacctccagaaccaagttttgcacttgtcacaatctgggtcctgagtagcttcctgaattatttacttcccgatacaccaactctgttcctgccatgatttcgtctcttttaccatgcatagctgcatatgctggtcgccttgatccaaagagatgctattctccttggagcttctggggcatctagcatctattcccttgttttggtccattgtgcatcagtcacttgttcattcacaaagattcatggagcacttaagttgcttggctttgtgctggactccagtcatccagcctgtgaggctgtcctgtcatcccattctgagggcaagggaatggctgccattgcccataggataaaaatccaagccccccaggttggcactgcagtggctagcctgttcctcctgggcctaacaccgttcttcaagtgttatacctgcttaattggacggttccattcaaatggctttaggtaattcttaaagggcaatgccaaatgaaggactgaaagtgctgtgagcataactgggggggactcagctccctttcagaaggccccgcaagagaaccaagtcctgaattctgtagccaatgtcagaaatgaagggcctgatgtaggatgggccaggctttgaggagtggctttccagggcccactgtcctgcagaaggggagaacacagcccaggtctgccttccacatttgccacagtagtgactgtgctgcctctcccttggcctctggaaaaatccctggagaaaccttgtagggaccagaaggaagcgggaatatgttgctctaatgtgatcacaggcagggttgggaacttgggacaaatgggcagtgaggaccgttccgtgcagtgcactatgctgtgcaataaggcaggctcagatgacaaagagcatccctctctccagcttggcagtaaagccccaagcctttcctcctgcaccagctaggcagcagcatccaccacctcctcccctgtgtcaagggggacaagatggtggtggcggggggtgggggcaaataataagcagtattggttccagatgcttctctggcccaagtatttgacatgcctatgggcaaattgaagatgccttgggcagcagatagaccactgccaagggttcttggtggaagggagtcactcaccagcattgttctgctgcttggtatttttgatgtaggcagaaaacttggaaaagatgtcgatgcccgctgtgttggattcccggtgttttgcagccagtttggggtacctggaatggaggatgcagtgttctgtgaatcagtagacttggagctcctttaagggtgagcctatccctatcatgataagcaatacttccctttccagctgcatctacaaaatgttttgggggtctttatcctcatactatagggagggtgggcattctcagccctagggcatccatagaagaaaccagaggccagtgaggtgctgagatctgcctagggtgacacagtctgctaggcaaagaaccagaatgccattcaggggtctcaggatgtgtccttttcttgggaccaccaataaggatgtgccagtgggatggcgcaatcaaagttccctctgagcttgcctctctatctggtagggttctcaacacttcccttacccgctaaaataaccatctactgccagtcctgtgattataatcctagctacacagagctaattctgggagcaaggagaagccaggtatgttagcattaaaccatttctccaaaggaagaatacccacggtcctcttctgaaatgcccttacatgcttattatttgtgtgcagtaataacatgcagaaactaccaagctccaaaaaaggacatgtgttttcaattgttttattttattttatttggagatacatttgcaatgatccagcccccctctctctctctttcgtagagtctttcattttgaagccacaataatacaagaggcaggctggagttagaacgattggccttgagactgaaggaggtaaacttgctcatgtgggaacccagggcttggactcattagccccatcaaaatgaaaaaaatcaactcaaataaatattatttcataagcattttatgggtatggccaggtagtggtgggaagagatgggagacagtcgccaggctatcattattttcaatgaatgtgcacctctgtgatctctgggtgaatcgtttttgactgtgggctggtgggttgccttacgtttaaaaagcaaaatcctttttgtttgttttgatgtttttgatagttcgaaccaaacaagactttaaaaaatatttgttgttctttaatgcttttttgttactcaactggcccatgagctaggattccttttggggccccttttggggccatgttaggtggctgtgtaatttcagagatactgccattggaagagtccagctctctgctgtgaggcagataaggaaggcattattgtcctccttttacatggaagggaactggatacctgagaagataaatgttgatggctaataaatggtggagggacgatgagaacctggtttcctggccctacagcagtgtccttccccctccactgcttctctggaaacagtgaaaggtaatttgcattgagcacctactgtgcagcaggcaggcactgttctattccctttacacgtattcaccatttactcctcagaacaactctattggtactattattagcctaatttcctacatgaggaaacggtggcatagagaggttaagcaatttgcctgaggtcacatggctgcctggcagagccaggatcccaacccaggcagtttcactgtggaagactaggttttaaattccacattgtgtggcttctcataaactccgctgttgattctcaaagccccagaaccttaaaggctgagctgcccaccttggaggagctgtctccatccatcaggagggggtgctttgcaccgatgctccacacacatgtcttcctgggtatactgagaatcaccacattcatctgctgtggctgggggcacacagcagggcttcctgcaagatactaggtaatctaccaagacacaggaattcagtgtcatctctttctattttggccttctcacatagaatccagcatgctattagaatcgatagacttaaattgctattaacaaatgccaagtgttctttgtttctccttgataatgtaaagacagaaaggcctagaaaatgcacctcagtggacagcttgtttgggtttcttgctttgttttgctgtatctcatcaattggtcagactttcagtcatctgatcatttcttcacaatcaggttgggccaaacagggatgtgtggtaccaaatccaagatgatgacagaggatcgtgtattcagggggctgtggtggtgtcatcctgtttcccaagcactaggactcgttgtgattttactgtgtagtgcagtgttccatttgagctttgttcttgtgggaagtgcgtctctaagatgttaatctcgcaactttcagtaactacactgggggaggatactatataggataagtgcattcattttacctccatatttatggcgtgttttaaatatgcaaataagcgggctacaaagtacattctgtttctctaaaaggctaaggaagagtgtttcactcacagaaacagctttgaaataacattggatgtgatctgatgataatcaaagagatgataattttttctaactcaggagtcagcaaactgtgacccatgacccctatttgtctgaggttctcaagctaacaatggttttcacatttttaaatgcttgaaaaaaatcaaaaggaggatactgttttgtgatacgtgaaaataatatgaaattcaaatttcagtgttcataagtaaaatattattgaaacagcaatgcccattcatttacatactagtttatggcttctttcacagtgtcactgtggaattgtgacagacactgaagggcccacaaagccaaaaatacatgactatctgaccttttacagataaagctgctaactcctgatctaactgatgaaaatttctctccacccggtttttaggatatcttatttcaaatgcatgcacttaactttcattctgggaagtaaaacagttggcttctcaccaaaaaaaaaaaaaaaaaaaaaaaaatttttcaaaagtagaaaatagtagcaaaaaaagagaaaaccattgcagatggtaagtgccctatctggtttagagtcccagctgacttctcactgactagccacagccaaccaagacactgaacaaaaggatacccaccatgcaattaaaccaatgtgcatgaaacacctactgaggactaggccctgagattggttttggggatagataccctggagaaaaagaaagacggtcctgatggaatggccttgctgatggcagcttaagtgttttccctcctttttctcacgagctgaaaagtggaaagacttcctctctctctcccttctccattgttcccacttccttacttcatcaacccctcacacgtgaaggacgttaatgcatctgacttttctaatccttgactgtgtgcttgtttgactcatgtctgctgtgtaagcaaaagatctctggaggtggaagaggcctggcttattcattaaaagatatcccctaggatctggggatttaagacctaaggtcaccaattgtctgtacaattgcacctgggagacagacccaaaacaggcactggccactctttctaactccttgagcttccatttaatgagctcttacttcatatcaggctctaggctcattagtattattttttacaatagccctataagatcaacagtatggttcttgttttaaagatgtgagaattaaagattctagagaattcaggtcatttgcctgtagcggagaatatgcatactcactaaatagccatgtaattctgtttcccagcttctctctcacctaagttgggatcacgtgtggattctgaccaatggcataggaaggaaagtaatgtcaccatgacattttttttgcaggcctggccctgcaaaacactttgggagatctttcttctctctctccctgaaggagccttggagggcatgtattccaaaaactacaggatggaagagggccaccctaccctctcagaatttgctcaagtgagaaataaacctgtgttctgttaagcaactggaattttatggccgctttgttactgcaacatagcacaacctagtggtatggatttgaacccgagtcactctgactccaaacctcctgcccccagctaccatgccatcctgtgggaggtctggaggctgtttctctacctcccagagggtcagaactttcttgttttttactgtggtgagttatcgctatacattttgtaaaataatgaattcaagttgtcttccaattctgtcagtgttctgaaccctgttgatacttaaatcattcttgctagatgactgactaaatgacatgctgtgtaaatagactgtatcagtttaccctcctgaatttttattacagcatctatgtgctaggattatttgagacaataaccagctctggaagagtactttgagaaactcatggaattgtggaacatgcaacaaaagacatcttggagactatgtagtttcaccccctcattttagagatgagaaggcaaggagggtctgagcgggagagaggcttgtccaaggtcatatgacaaacactcatagagaggtggccagaggcagggctcctgactctcagtgctgaatcctagaaactttggccacttcaggagatgaaaggcaagggccagaatgtctcaacagtaatcccagcattaatcacaacacttccttgtcgagtgttcactagatcaatctaaggagagggatggatgttagtctcatttagaaacaacttgagacttcctggattcctcattttgacaccaaatgctccctgggatcaaatgtgatttgaaaaaaatggttggagtgtttgtatgtggttttctcctttaaaaaataaagctaagggaaaaagcctcccataatgtgttggcttttggcagcttttacaaatagtggtatgatgagaaacacatggccgaccagcgcttggtgaatggttatgagggttttgctgccccctagagaaccagaaggccaggctgtcctgctccagaggcctgacaacctcccagccactccatctcccagcctgagtcgctggggaagctggtgaggctggtggtttgttctgggcagaccagcaggtctctatggggctgaggcactggcttggtgacatttactgggaggtaattgtggcacctgcctcagtctgatgggtgcaaaggcatctaaggtataatcctgggatgctctggaatacttgatggcctcacccttggcgcccccaccttggtaggcttctggagatatgcattttaacagcatcaagcgttctgctacctgagagtagtggattgttaggtcactaacatggcaggaatgcacttcataaaacctcctatacacaactgcagtccagagaaggacctggaccagcgggagcagagctcaggacagggaaggtaggtggagaggagggagtggagggagggtccacatccagccctgcccagctctatttggatcatggaaacttagaatctgatgaaatgatgacgaagtcagatgatgactcgcctctggaagaatgttcaaggacgcatggggcatacaattccagtgatctctgtccaccttgtggtcccaccgtggttgcagattggagacccctgagttagagaagcagcccaggaaaggcacagttgcactgggggtggtgtggtagtggtgagggaacctggctaaagggcatgtgaagaatcagagagcaagaagggctctgggagatatcctgtcacagagaagggaactgagtcctagagcagagaagagactggttcaagaggtgaagggactggctcaagaggtcacagcacatcactagcagactaggattgtaccccagcccctcacccctccatccactgcctggcaacagaccaaatgggcccctctgctcctcactgcttccactttccacttcctaatgatcatgacggaagcccccactcctgagtgccagtgttacttctaagagggaaaatgttaactgcgtcatgaactttcctctatgggtctcccaggcaaagtctaaactctagttattgaaaacagcattttttttcatgtgggatttcaaatcagtgctagcaatgaggttgagtcccggggagggggatggagtctgggctccctcagggcaattccagtgaagtggctggctggtgtcctcttcagagatgtgtgtgtgtatgtggggctgtcctattgatttaattaatgcacttatttagagtctatactcagctgcttccaatgggcttgaggtggctttttcactctcagtgtgcaaataagctgactgaatatggatgacaaagaatatttttaaggaagaatatatgattgtttaaggcttatttggagcatgactggcagttttaattttttaacagcaattcactagatgtgcaaccttgggtaagtgacttactctctccctgtcctgactgtgaaatgaggataatgatagtacctaggatgctagaaggatgaaatgaatcatattagctaagtgttgtgaatggtgcctgacacaaaatgaaggctataaaagtgttgatgaataaataaaactttaaaataaatgcaggatggtggtttttagtagtcaaatctcactaactttacttactcagtatgtcctgaacccttcctactcctctcccccgattttcctgccctgtcttggcttagcccttcattcgtcctgcctggacagtcaccaatggctccccagaattaattcctctatctccagcttcatggtcctctaggataccgacttccctcaacctctaaagtaggtcttaaaacggactccccacctcctgtgcttaatccctttcagaatatcccacaggactcactacaggataataccctacaggataaagttcatgcctcactctatatgtaatattatttttctagttttttcaaaaattgtgattgttttaatccttgataatagtattctttaatgaacaagtctagcttgggtaaattttagaagccatctgtcttctttttactgctcttttccatcagtagcaatgtgtcacccaacaagaacttatagctctacggtctatactctccctgaacctgtttgcagaagaggagctgctgcttttagttgatttttttcatctgtttaattgtggactcagaccagatttggtcaggtttaagaccctggatgttgttttaagtcactgggttaccctttcctgacttattttcattctgtcaggctttcggctctggttctgaaatgaaggaaactttgtcctcacttcaacgtcttccaagcaaagtgagctggagagaaggaacatactggggcgagggaggcctggtatcctagggctcctaaaatcactctgtgtaggtaggagtgactggctcttgttcataggccatatctactcttgagtggattttgtggagtggttttgagattggcagccctttgggggtcctaggctctctctttgaagaaagggtcctgttctctggactggtgaggttcctttggaaatgcatctgcccgaagttaacaccaggactttatagatccagcatgaacccttcccattcaacagccccagaaagaaacagatccttacttttcaggggtcaaggtctcctccaggaactcctcgatcttattgacgtctgtcttcacgtccccgttgaaggtcaggaagggcgggtgcgtgccgggggctaggttgtgcaggtcagctggctttctgtagagagagcaagattcaggtgttggcttacagcagggtgcttcctgttctgggaaacctaagattgattgtaacttagatgccctgtgctatccaacatgcctgtcaggtgaaacagatttatggtatgcagtatagggcaggggaggttggagaaagttctgaaagaatgtggtgtgacccaggaagtgtgtccagtggagtcagtgagagaggaacaagtcaagatgaaggagttgaaaaaatgaaagaattgaaaaaatggagagaatccaggtgactatctaagtcagatccaagctttaattacccaggggagaggtggggttttgcttttaaaagctctttcaccaatctgcctaacaaaaatgcgctacacataattccatactttaaaaattaatgaattagatcatacttttctcctaataaatatctccagatacaaaaaattgggagtttgggccatttgttcaagttagatgcttctattgtgtgtaacttatattttaatatctaataactaatgtctaacattggtcagccttttgtcacactcaacagaatactctttttgagttataaacagcccctgatatggtctttgggtagccaggaaaataaacaaactattagattgaaaacaaaactattaaatgaagatgttttcaaaagtcttcttattgctaagattattgctccacaaacaccaggtaggctattaccaaggattctgaaccaagaacctcctactggtgagtaagaagatacctgagagaaagccttacgattcaagctccatgagggaaaggacccagaaccatgcctggcatataggaggccctcagtagatacatatttttaatggctacatgaataaagcatgcatttttgattcagctacagtggctcatgcctgtaatcccaccactttgggagggtgaggtgggaggatcacttgagcccaggagttcgagaccagcctgggcaacatagcaagacccccatctttacaaaaaaaaaaaacaaacaaaaatttgctgggcatggaggcatgtgcttgcagtcccagctacttggaagactgaagcaggaagattgcttgagcccaggagttcgaggcagttgtgagccgttgatggcaccactgccctccagtctgggggacagagtgagactcggtctcaaaacaacaacagcaataaaaactcatacattttaaatttaaaaatgagtgattttagctgcaaaagtagaaatcaaatgttggtctcaaattggtaaaaacttcaatccagttatgaaggctttcggctttcagttaaatgtggggagaaccagtaggcaactccactgctacagtattcatgctccaccatagtctacctttcacagtattttaacttaattcaagcatctactgttctcaaaataagacttattttgagaacatttactagatttactagaaagaagttatttttctttaaattttaaaaattctgttcaacatacataaatcaaaaatctcctaggagtcagaaattgtgcctatttttaaaaattatggggttacttaaatgttatcttaagttaaaaacaatttattttctaagtaaatgcaacttctgctttgtgatgggattcaaatagatcacttgatttatgaaagttatttcttcttatagcaaactttgctgggcccagtaggatcttttaggtaacacatacatatatatgtaataggcagcaaatttgctccctaagaagacagaaagctctttggtgtgcctgttagtttctgggtcagacacttaaagaaatccaagataaccaaagcaacagtgcatttctcccccctgggaaagaggagacccaagagtcctaaattatcctgaaagaaaggcctagatgatggagaagtgggtgaaattctggaacgcagtcccaattgaatgaatgaacaattaattaactgaacaattaattgaacttcctgcacttagcccacagcagtgctaagtggcatttctggcgtgcactggggagcacactgactacctgcaggaaggccaagtgcagtggaaaggaaagtggccttgtgtttgacacggctaggtcctgttaatatccaggagtgtgcttctgtgtctgcgccagctggtcagaatgcaagagcaagaatggagcaaaatgagggggaagaaggtttggcagattggggaaaatgggaaaggggagggttacactaaaaatgtttagggaagaggagggaaaatggtggcgacttccaagacggtgctgggattcaccccaaatgctctctctgagaatgccacatttcttgtgggagtcgggagtggaaaacattaaacgcagaaactgtaaaaaaagtaaacagtgggagtagaggagtctgtaatgaaacaaattcctggcgtaatcagtttgggaggggaagagaagaatttcaattactgtgctactcccatgtccctccccaaacacacacactctccagctgcattctgaggcacttggaactcagacaactgagacggaaagtatttttaaaatctaatttacttagtccctttatttactttgtgcatgtccctcattttagacaatgaaaggacattctttatttgctcctgttttttagagctgacacaaggcagcaacgtgtgtgctctcagtcacctctctgtggcttacagatacaggaatgtgtggtggtggtgatggtggtggtggtgggttttttcctgggattctggagaattgtggccactggagtcagacgcccttgggaagtactgcctatggccaccgacgcttagctagagttgcagccctctgtctttgttgaccctgcttcagtatttatagttgagactatatcattagcattggatgacgtattgccaggtatgatttatgaattatgtaatgaggatcggtcttcttttccttactggattgccagctccatgaacccagtgataattctaagaataaccaacatgcaacgagttcttgctatgagtcaggtacaggaccaattgcaaatgttttacatggcctgcctcgataaattctcacaataatcctattgattaagaagacactgtctccattgtacagatgaggaaactgaggctctgaaaagttcaagattattcagtcactaaagtgtagtgccaggaaaataaatcagttttcttagaaattaatgtgtgtgttcatgggtagagggggcagtaagaaagtttccttatctgtaaaaatggagtggtgctacatgcctggtctacgtcaaaggggtgttggctggaccaggtgtgatcatgtgaaggaggaaccaaaccatctgaagcacgcgggcaggggtggttccctctcccactctcttctccagcaaacatacaagtcctctctcacacatggtaatccaaacacctccaattctgcactgaaggaagctgctttttcataagtctgctgctctctttagttatcacagacattaattgcatagtggatgcaagttcatttatttgacagatagtatttgaggacctgtgaaaaactagtttctatggaggatacaaacaaacttaaaacacgattccagtctgtccttgagggattgaaggtctcatttgaaagatgaaacaaacttcataactgaggtattatgaagagcatagtatttgaaccaagcagatggcgtttagcccctctaatttctagttggcatcttgggcgagtctcatatatatctgtctcagttatttctcaaataacacggagaagtaagacctccttcacaggattatacattatgtgatttttttttaatgagaaagcatttaccagttgtaaagcattaggggtgcagacctcagaacttgatgaaacactaaatcacgacacaaggcaacatagacaacaggtgctgggtgagtctggagggaggttgggttgacaggtgtgcttgtatgagtgtggtgggatgggtatgagtaggccttacagaggggatgggctgaagctgagcctggggccagggacaagaaggaagagagggcctgttttagacagaggatgcagttctgccaagggatggaggctcaaaggaagaagaacagcagaaggcaggccagcctgacagagtagacaggtcacggtgagaagtgttgggaaagagtgttgggaagaatgaaggaaaagacaaatcggggcttcggatgcatcaagtccatggacaatgggaaacatcaaaggtttcctgtgcatgaaagtggcctgattaaagcattattttaggaataataaccttagaatcacataaaggatgggtcagagagagagaaaaagagaatgtgtgaacctggaaagatgaagaccagtttgaagaacaatgagactctcagggtggcagtggtgagacttgaaccagttgtaggctttgagaatgaaaaagagagtttggaggaagagagagtgcaataggagaatgctctagacttggctactgatcaacaatgaaggcagcaatagaaaggagcaggaagtgtttagtgcctagaaaatagaagaaaaagaccaggagcagtggctcacgtctgtaatcccagcactttgggaggtcgaggtgggtggatcacaaggtcaggagttcaagaccagcctggccaagatggtgaaaccccgtctctactaaaaatacaaaaattagcctgtcatggtggcatgtttctgtaatcccagctactcgggaggctgaggcagagaattgcttaaacccaggaggcagaggttgcagtgagctaagatcgtaccactgcactccagcctgagcaacagagtgagactctgtctcaaaaaaaaaaaaaaaaaaagaaagaaaagaaaatagaagaaaaaaggagttcaagaagagctcaactcagaggaaaaggatacaaattgatgtatgcaatgttagacatacatgataagagaacatccaagtgaaactatctagatgatagcagggctctgggtgtagaacaattcacataaagataacaaggagaatatgccaagctcaccagggatgaaggtagaggcagaagatgaacacttatggggtgagcctcgagctgttccacatttaaacaacaggtagaagacaggaaacagaatacattctgtaggagtgaaaagagtgtggctcctggtgtttgtaagtcattaaactgcactctaaaaacagaacagtagttgcttttcgtccaagcctgtaatctagaactgtcacactgaggacttctaaagctgggaacatagcatgggaaagggtctagatcacaactctctgaagactcagactctcacacctgaagtcctgctagggtcccacggatgatggccttagtactactgaaatgactaatcctatgtttttagatgtctgtgcccatatgtgcaccagaaacttagttgcaatgccattgtccattccttgcttcttctttgctaatcgtaacttgctaatcgggtcagtgaagtgctgggcaccaagtgaaatacttgcctttgcagactctcttgtagctaagactggatcctgagacacagttctggacaatgacgtgtgagcagggggctgctgggagccacggaaggcttttgccctccttcatggaaggttctctgttcatgcagctaaacatactcctcatttatgcaacgtacgttaccttttcagatccacagtggtgacattgaacacgactcctttcagccagaggatcatgaagaggcgctgagagaaaggacagttgccgatgctttctccatcgattccagcctggaaagaagagaaccagtgtcctgagtgggcaggtgcaattagcaaggggaacataagattgtaacacccaaatgcaggtctgaggagaccttactaaaaccatgtcccagcaacttcaaagggcggtagcctgatattattagtttttgccttaatgtccacgcagggcaatgcctggcagcatgtaagggctcaataaatacttgctgaattgaacttgatgattatgcagaatcataactttatgaaatcatagaacccttggggtaaaaatagacctgcaacatcacttagtctgacacaaatgatattggaatgccaacatctacacccccaagtaatcatctagtttctgcttgaatatctccactgaccagtcagttgtattaatatctctcaaagcagttcattctgaggattgctctaacaattagaaatgctttccttcggctacctagccaaaatatgttcctctgtagtttaccctcccccacccctcagtccttggatgtcatgaatataaatatctcagactttgatcccatctccctatatggaggctaatcaggaagctcaaggctttaatcaatacaccacttagttctggctagtacttggccttcactgtcaataatccattcatttgttacacttttactcaacaaatacatattgactatcagttatgtgcaagacactggagaaaattagccaggggattgaaaattgaattcctccaaggagcttatggccttctgtaggtgggcttggggataagacaggaacatatgtaaaaataacagaattattattgggtgttctgtgcttctgtcatttcatttcccttcctcaaaacagtaggcttttttaggtctgaaaagcaagtccatctttactgcacttctgagtgggctgcagatccctgaatttcataaagaattaatttcaagcaaacctatgaacaaacaaaaaaggttggggaattggtctctgtagaattcatttccatagggtggtttattggcccccaacataatacttagaggaagaaataacccatttgctccagactctgatgttggctgccctggaaaccatggcccccgcaggtggcctggcagggcattccactgacaggaagggcctgtgtgggccagggtactgaagactcgtacaaagctgtaaacaatccgaccaatatccaggaatgggggcttactgagttttttttttttttttttcaaaagaaagggagaaaacaaatgcgttctcgaagctcaacacactgttttctcccttgaggtttgttttgctatggcattcagatggggaggcagcgatgccttctttcatacattagaacctcattgtgtgcttttttctaccttgcaaattgctcccagcaggggctcaggtttataatggaaaactggaacttttgacagtgttggctgcatgtaattgctatgaaattacagttattttacctccctcttaactacaccaaaagccccactccctattcagttctcacttttcctcagtgctggaagcagacccacccctgagtcttgagaaagcacggactccgttatataaaatgggaaaggtaggagggtacagtgtgggcgctacaccttcccacggaggtaaagttaccaataaagcatgctcagacaggtggctatcaatttaataatagcttggtgctaacttgagtttatgatgtacgttccctaggaacttctcaagaagcacttgacaggtaccaggttctcggtcctttaagacatcccgacacaggaagaatttccccagggccagttatggtggaagtaacaagaggagaactgaagaaaaaagcaaaaacaaaaacagaagccagatccatatactgttatctgttttcctctggtggtggtggtgggaggataagggaattgaaggaggaactagcaaaatagtggacttctcaactacataaaaaattcatataataataatgttaataataacatatctatattgtcaggcattgttctaaaggatttacatatgttattaacttgtttatttctcctgagaagcctgtgaagtgggatattttcagcttttacaaatgtggaaatggaggcacagagagataaaataactggcctaaggttatcatcgtggtgaaaccaggacgaacgcaggtggtctggctagagatccagtgctctgagctgcatgcctggagccagcctgagggtccagccaggtaacaggtcctccccaggtgctggggagggctggtgttgaattgtatggacatcctctggtcagtgtgcaatcagctatgccaggagcatagggcatggtatccttcatggctccctacattttcattatgtcttattaatcttgtattaaactatgattctgggtttagtaaacaaaaattgtcaaagaccaatagaaatatgcgaggatgctaccatttactttcactgtctgggtgtccctctttcagcttcttctattccccttcaaatcccaacagccttgcggccctaagaaattgtttgttaaactcatgggttaaatatcgtgatctgtgacgaccatctgaaacatcaacagagaagaaccaggtggggctcagttgggccccacatcctgaaaagtgtgagggaaaacccaggtgtactttgttccagagagattttgagcactgggggccagggaccggcacaaaaacagtgtcctaggttgaatcatgttcccccaaattcatgtccccctggaatgtgtgcatgggaccttattgggaaacagggtccttgcaggtggaatcaacttgaagatgaggtcatattggattagaatgggctctaaacatgactgatgtccttacaagaagagggaaatttcggcacagacatgcagaggacaaagtcatgtgaagatgaaggcaatgattgaagtgatgtatctacaagccaacgaacgccaaggattggtggcagacaccaaaagctagaagagacaagtagagcctggctctgcccacaccttgattttgaacttctggcctccagaactgtgagagaatccgtttctgctgctatcagctatactatgtatagcaatttcttggaaactgatgcaatcagggaagtgtcaaaaagacaattatatatatatatatatatatatatatatatatatatatatatatatatatataaacagctaatggcaaacttcccaagctcatgattctgctttgaacatgattgccagctataatcctaaagtacttcctgttccctagatacagtgtatataacaacttattataaaatatcatgccacatataatattccatatggtgataccagtagtagtagcataatgtaattatataggctgtatgattgcacttcatctgttatatgctggatacttcatattatatgctattatatattgcctttcatgtgagctctctccatatatgatgagcttggctccctcaaaacatagttgaagttttatttactttgtcttcagcagcaacaagcacaggcacctgaaacttactttatattcagtgcctatttaaatggatgcatgctgaggggagggtgatgtccctccctttttgtggcttgaggatctcaaaattctctcactgacattctgaaaatcatcctaaaatacatgcatacatactacatacatacatacatactacatacatacatacatggttaccctgagttatgtagcacactagccggagactgtggttctagatccatctctgcctctacttcactatgtgaattaccttagataagttaccccctcttggcctcaaccactgcacctataacttcctgcaattttgtaaattcaagtggaaaatggagatttatttaagaccgcggttctcaaactttttagtcttagaactcttttatgcttttaaggattgttgaggatcccagaaaggttttgtttatgtggatgatagttattgatatttaccgtgttgtaagttaaagctgaaaaacatttaaatatttagaaaaatgctataataaatgtgtctattaacatacacaacatcttaacacaaaataactatattttctaaaaacaagaaatttagtaaaagtggcaatgttttatatttttacaaaatctttaacatctgacttagtagaagtcggcttccacatttaatctcttggtatttagttggggtatatggggcttttgttgttgttgttgttgttgtttttgaaacagagtcttgctctgtcatccaggctggagtgcagtggcgcgatctcagcttattgcaacttctgcctcccaggcagtaaatactgacaaatattaagtctgagtaagcatggtgtgtcagccagttgctctttcaggtaaaaactgctttgtgagggaggcagctggttcagctggcaactcaatcatacaagtgcttttccttccacaaccatcagactttggaatgcagccaaagagcttatgtgcatttcccatttcatcaaccagaatgtttagaagacatgtatgcaaaggttgagatttaatcacattatataatttttaatgcttcatcaaggacattcataattgaggctattttttttttctgcacatgcatgactggctagtcacacttataccactgcttggatttgtgctgaaacactagtaaacttacccacgaaataccaatcccagagagagaagcataccatattgatataactctaaaaatagttgtgacctcttaaaacccctgaaagcctcttagcgaccccagaagtccatgaacaacattggagaaccattgttttaagacattccatgaacacaccagatatgtaatacttggtttccagataatgaaggggaagctgataattggccaaaagtcactcgcgggtacccaagtccagaagtgggaggaatcattcagagaggatccaagaaggaattatagaaagtgaccagatgacattgaagcttgatagatgagtcagttatcaatttattgcctttcagctccaatgcacccttgaatatatgctctgtgagaacagggggaatttctttaaacatttctcctttaaagtgagcacaaagttaggctttctcaccagggagaactagaggggcactgcaggaggaagaggctttcttgctggctgtggtgtgggctgggggtgggcagtgtagctgtgagggcacgcagtggagccaccccagctataggctcagcatgcaacccccctggcacctcatagcctcagcctggcaataaccttcccagcactcttgacacagaaaccaaagtccccattaagcctatgtccagtcggcctatggccagtgtgtccacacagcttggtcaccccctttgcaagccccacgtgtcctgaaggccttcttctccactaacacctagatcctgctgcatgctgtaccgatgctgattgcctgctccctgcctgaactctggggagtgggctattgcttgctcagcgactccagaccagctctggcctgatcaaaccagtgagtttctgtgccaggttccaaaccacttctaagtttgtccttccctggctcctctccctcagccctagggtaccatagagagtttccttatatgtcatggttactcttttatcttagttaaaacttcatgttgaatttctcctgtttaagctaccatgtagtttctcactcctgattggacccagactacatcagatgcttaaatgtctgttatttcaaaatgtaagatttttgtgacctttgacttctttaaaaacctggcaaggttaagtcctggatgaagtattaggaaagaaacctcagttttctcaagaaagataattaagtcaccacttacgtcacatttccactttttgttgctgtcgcccatgaaacttgtccctgaggactcaagtgattaaataattttgttaagtgtacagataaaaattaagcaacagtagggctgtaactgacctcaggaatgctatactccagttctttctttttactggtagagaaatagacccagaaaggttaaatgaattgcccatggtagcacagctggttcccatagcagaatcaggtctctctaactcctgactctcagttctgagcagaccacactggctgctgtcctctagaaaagagtgacaaagtggcaaaggccacatgaaaaggactttctttaaacataatagctcatttaaactgtttagacaaagaagctttctttataataatatttccagctgcccattttttaattagttagtgtaagtcagacaacatttctagttgtgactattttttttttaataccaaacagtctatccttccaataatttggttggcaagacttcaattagcagggatgggacttggtggtacgtggtccacatgaggacagagaggtctacccttgaagaaatcaacatttcctttctcagaagccacaaaaggcctaattcactggggtcacccaggcatttttcattcaagaaacaggtaacaggtatacatttgaggctacagagatcctcaacatttatctaaagtttaatgtatgggcttaattagctctatgtagaccactacctgtgcaatgtgatatgaagaattctaggtatattggtcagagttctccagagacagaaccagcacaacatgtatgtgtgtgtgtgtgtgtatttatatatacatacacatatatgtacatacacacacacacacacacacacacacacacatcctgttatatctactatatatggagaaacgtatacacatcttatttttatataatacattataataacataatattatatatatgtgtgtgtatatatatatacacatatatataatacatatcagttggggtgtgaagagagagagatttattttaaggaactggctcacacagttgtggaggcttggtgtgttcagaatctgcagggtaggccagcaggctgaagccccggggaagagccgcagttcgagtccaaaggcagcctgctggcagaattcccatttcttcagaggagggggtcagtctttttttctatgaggcctacccacactataaagggcaatctgctttactcaaagttcaccaatttaaatgttaatgtcatccaaaaaaaaaaaaaaaaaagcaccttcacagaagcatccagagtaatgtctggtcaatatctgggcactatggcccagccaagttgatatataaagttaaccattacacctggcatatttaaatattttacttgattcaggtaacctattaattcagtagctgtcatctgcaccttagctcaccagatggttttgtaaacaattgaatatagttgtgtacatgtcccctcccaaaagaacttgtaggctccagacttagcgggctccttggtttacgcctctaagtgagcaggatccagtggtgcctttgatgcataactagcctggtctgatggtggctttgggcccaaggctgcctacaactttgtatgttgcacagtgccactgtgttcatggcccattggggtgtctgtcctttagcctgccttgagctttacgtccatctgccactgagtgtatgttcaccctcctgtgcttcacacactctctgagaaagaactgccctttccaactcatcaccactgtcccttctcccagccccttctttctactcctacatggcttcttttctattatttcatgtcccgctatttgaataaatgaatgggtttcttttaaacctcttgccagcctttcttctatttaacaacttctgaaattgttgtctttcaatctgtttccgggttaatcaattcttttttttttcctttgtgtcttcatcctacctgatattcgtcttatagctaaaacttttgattatcctttcttcttaaagctcagccatctgcagcctcccttgccacttggtgcctcttaggtgggaggagccagcttaacaggcaggcagtctgtgcagttgcatggggccccattaaacttggtttaatgctctgctgttgctatcctgaaattcttaataattttggagcatagggtccctcattttcatttggcagtaggcactgcacattatgcactggcctgcctgtggaccccttatttttcttgctgacatcctcctttttctggcatttgccctctcagctcaccactcttctcctccatgcttggtgctctttggagaacttaccttgagaacatgactgtccttcccaagtcagcaataactctggcttctaggcctataaacatgctacttaccctaagcttaaaaaaaaaaagtagaaaggaaagtcagagaaggaaagaaaacaagggaaaatgttgaaaggcttgcttggctcaagtctcccttgttggttccacctcctagcctatctcactgcaatgtcatatgttattctagaatttgcctcatttcaattaaatatcttgccagttactagatacttgaggttttcttataagtcagacaatatgccttgttattactatttttcaaaactaaatgatctgaccttccaataatctagttgctatgctccattagcatgaatgtgactcagtgatttgttttatttatctactctcagaaacctgtaagtactcaagaaatgtaagactgatggccttggtatgtcttccaagtgattccaccaatcttgggaaggaagaatggttctcatatgttaatattatcaaccttcaccatgccttgggagagcccaaagtccacactctctgcctccaagtttggctgtttctgctcactagcccaggtgtaatatttaacagctaaattccattgcagtagaggcagatttcagtcctcagcttcacagaatactgtggtacagtattaagggcattgtatagactcatgcaaacctgggttcaaattcctcccctgacaccaaccagcagaaaaaatgtctgcagcactatttccaatcccgtatgtccttcataacctttccacagccccagctagaggtggagtccacatttcccttcttcttaaaatagggcaggcttttgtgactgcctggatgaatggaatatggcagaagtgacacaatgtgtgacttctgagattaggtaatagggggtgatacagcttctgcctgtgtctctctctctgtctcttttgggatgcttgcccctggaacctagccaccatgttgtgaggaagcccagagcacatgaagaggttctctgtagtgttccagctaatagtctcagcaacgttttcagatgacagattgcctcaacaaccagacaagagaatgaatgagatttcagattattccagcccccagcttttgaattgtcccaaatgacatctagtgaagtaaaattagccattctaaccaagtcctggccaaatgcaggtttttgagcaaaataaatgttgttattgtttaaaaccactaagttttgggctggtttgttactcagcaggcaactcacatacacacttagcttcaggccccttatcttcaaattggtggcagagttgtataattggatgacaatatgtataaaacatatagtatttactttatacatttacagctactgtctttatggccgcagaaggcaaacatttaggaagagcttgttaaacaccctatttatgaaatattatgccttgatgaagagtcaatagacctctctttgatggcacaaaagttcaacagtacctagcgttcagggttttgtgtatgaagcaataaattcaacaaagaaagaaaatacatgaagaactacagctattgttcattggccagaggagagtgttcctaaactaggtcagtcatgcatttactatgaagggagagagggaaaagtgactcatgtttggttaactattggtacaatgatagatacatgcatgtctgttctctataagactattgaatttctgtgaaaagcaacaccctccaaccaaacacctttttcaagtagttcaagagtcaaagatgagaagggctggaacccaaggaatatagatggttgaagctaagggatcaggtccgggacagattcctggaagttttctattgaagtttattggaagcctttgtgttctctcaacatccggaaacattttcacagctctttaaggtactgtcatcctattctttagacctgattaaggctctcaatgcttggttcaggaaagttgaaatctggaattcttccacctcagaaatgtaccaaaacacaggaaaccaaagagcaatacaaatctatagcctcaaataaacagaactcctttccacattggtataatttgaagaagaggtctcctcacttaagcctcccttggagaatccccatcctaatacaggaaatatgttttccacttaatgaggccactgtcaaaagctttgctttcctctcttgacatttttcttatttgttatccaagatgctatggaaattaatggcagctcttgatcgtgaatccattccccctatatttaaggaataagcctgcaattcctataatcctcataccaaacaaggatatcttgatattgagctctgctactcctacaaaggttggtgtttgggatcctgacatagctgagattcctcaattattactcatctgcccttctgttctggttgtctgaatgttgagttttgaatatagcctcttaataggataagctgggctggaaagactttagagacatcccaaaatctgtcatcctagctctctgttggcttcaataatcactcatgaatcccaaactcaaatataacaaattgaaagcttatgacactaaaatgaaatctgagtcctgaggtttattaattagggtcatgtacatctgagaacttatgaaaaaagtttttgcaaaattactagtttatgatatgtcaacaaagtatgtttttagagctcgaaaattccacacaactaagcattttaaaaactggaatgcccaagccccactctcagatattctgatttaattagtctgggggtagggctcagacatcagaattcttttccctcaatgttctcgaggtgattctaatgttcagtcaggactgacaacttctgacctagtggtgcccacagtgggagatgtccaacagaatcaccaaaggagcttgttaaacaaacaaagaaacaaatgagctccctgacctcactgtagacttgcagcatcagagtctctgggctcaggagatgtgtgacgggctggaccaaccaccgacagtagcacttaggacgttgtttctccctcctctttttgtttcctttttccttacctaaactggaaactccttcacatcctggccccactcctacttcccaccccatttctacactgttcttcttcaccttccatccctgcacaggccctgaaagaagtgcaccattttgagttgttcagggcatggagagcccattttggatcaagatgtctgaagaacctcaagtcaatgcagccataaacaatgccaagaacttcacgtgccaactgatatttttatggttgcatctccacacagaactcttaagttctgccaggtgggtcttccctgagggtgacagagtgtgctgtgaccgggtacagaaaccctagtcactgggctcaagttctcatgtggtcaaccacaggccatatgtacccaaccacatttgttctctccagccaccttcctctagtcagccatggtgaaaaatgtggcttcttaaaaaatgcagggtcctcataaggtcctgttttgggctttcttggctgcgtggagtaccagcaagctgtatctccactctcaactatatgcaggcacttggccacttgggcagggtggatccacacagccagatgggcatctttaccaagggccagcttggttccagagactggggatgtagtgatgtggtgatgaaagagacatggtccctctcttgagaagctatcacacaacagaggcagcaaaaggtaaagacatgatggccaggtcatcactgaagtgcagtagtagtagagaatgggtggagtggggacaggaaggagcccacctaagggttcacggaaggatttggggcagcaacaatgcctaatgtgagcctcaaaggtaagagagtttattcatacaaagtggcaggtaaggccatccaggcagaagtgatggcataagcacatgcctggaggctggattgaacaatgcaggtgtattaggctgtttttgtgttctgtaaagaaatacctgagactgggtaatttatattgaaaagagatttagttggctgatggtcctgcaggctgtacaagtgccatgccagcatttgcttagcttctggttagggcctcaggaagcttatgatcatagtggaaagcaaaatgggagcaggcactttccatggcaaaagcaggggcaagagagagagagagagaggaaccaggatcctttaaaccacagctctcctgtgaactatcagagcgagaactcactcattaccatggggagggcacaaagtcaggagggaaccaaccccatgatccaaacacctcccaccaggccctgcctccaatattgggaatcacatttcaacatgagatttggcggggacacacattcaaaccatatcagtgggtgtgcagggaattccaagcagatcttcttcatgctctattaggaaaacccatgcagaatttctctagttccctttcttcctccattctgaggaccccagcctagtcacaggcaaagccataaggcagtcaaatgctcatcttctgggggtctctgtgtcttcccaatctgctatctccaccatcatgcatctctaaacccctcagccactcttggccagcatgcctctccccacttgtatctctcaatgccaactctgaaagcattcacatttaagtatgaattgttggtaactgctaagcacttattcctcctggggtacttttatttatcatggcccagatgtaagcaacgagatgaagcttcaatagtggggttgcaggtgtctgccagaaactgattaaagaactgggaaagaaggaagaagggcaacaatagcttcctgggggtcctgaaaccagacatgtaggtttttatctattatctcctatgtgagatcctgccaacttgttacttctgcagctctgaaaaactagctcacacaatggatgccccagaccaaagggcaggcactcttatcacaaaactgccttaatttccatttaaaattttctatttaaaattacttcaaggctggttggaagggcaagacttcaaaaacaacacattcctttttaattaattggaggcgggtgactataggaatgttttagctttgccgttaatatgagtgctatgaatttgtaatagtgacatcttcctatacttgtgcagtaagatgtttgttagcaagaatgtttggagaagcaagatgttccctggtgaactgaattccctgggtagccctttaagcaatttggggcaatgtaataaaaagcagaagattaagagttctgcgttccagacctagttttggcacaaagagttgtgtgacctagggcaagtaattttccctctctgggtcttaatcttgttatttttaaagtgaataaattagaaaagatgggcttgaaagacactctgttcctaaaatgtggctaggagaaggtgaaaataactaaatcttttatttgcacctaaaaattccaatggctgagtagagactccacaagctactacagtcctctctcccagcaccatgcatggctcacagcacgggctggataaatgtttgccgagaggatgaaagagcttgtggactagcattctattctgaaaacacaggcagctggatctgcaggggaggggccagcactgtagattgcaaggaaaatcaggccacaaaggaagaaccacctgtgaccacctttgctagctgcttctgggctctgccttctcacaacttctctgtagcatctttccatagtattctcagcaccttaccttaaaaagcagttgaagaagcaccctttttggaaggctgtccccaccccatgtccccgcccccaccccctcctgctctatccaactccttcagactagggcagttgagatccaaagacttcagatgacttttccaaggccacatagacgatcggtagggatggagtttgctattgaatggagatggctgaaatctcagtcaaaatcgtgaacgtatgtaatttagacataatcagggaagacaggaaaaacagaactgaatcctttggaaagtcatcttcgagagatgttcctgctaacccttgcttatctttcattttattcccttaaaagagtaaactgctgaagacagaggaagaaaaatcctgccttgttattgaatggtatggattcacattcacatcaaggtttttttttttttttttttttttaatcgtggaggatttactcagggtaaagacagaaagccacactcctacgacaggtcctgagctcccaggggaaggatagaagggaagctgtgtagctgtcttttctcactatgttccttcttctcccgcctagggtgattgggaggattaggggagataacacaagtaaaatgggggcgcagtgcctggcagaaagcactcagtgcatctgccatcttcaaggtcactctgccctctgggcccattcctccttcctccctctcctcacccccagccagcacattaaaggtcacaggtctggagaaagtccttctctgccactgtgcaacagggaaatgtttctcccagccaagtgcccctgtcatgtgggcccacccaactaatttcttctgagcccctatagaacttacagtgaagactgtggttagtcctggatgattatatcttctgctttagaagggagctttgaaaacagcctcacaattacagaaaaaaccaagccagtttttgtgtcaagaagacccaatttcgttttctcagccttgaaaaaaaatcaatttgaacttgctgctggctgagttatatgttcaagctcagaccgagctgtaattggaaaggagtctgtcttttgtaatccccaggccaaaaggggaaatgaaaatctttttcaaatggcagagtaaggcaggaaatgttctctttattgtactcccataaaaaaataaacctacccagtaattataccacacacacacaatagtccaggccctcacccaggaagccacaacctgagatgaaggagtcagtggttattttcaaaaagggaatttttccaagccctaccatattttctctcacaagttcctttgcatttacaagagacagattgcccaccctgcttttctgcctgactggtggaagtcagacaacctgcatactggtcccagttgttctgcaagatgaatgtgcccttgagcaagtcactgtctcgatctggcattctgcacccttacctatgaaatgaagggacaactagacaatgcctacatctgaattctctgattctctttatgctcacttgttcattgggcacaaaggagtcagaggtgatccctgcttatgaaaagctctaatgtaaattctccactttatgtctaggagaaaaaactgaaagtggccattataaaaatacaaaactgccccattggtggactccaaaataaatgaggtacagaaattgttctttttcctctactggatcctttctgtaagtcttagaatttgctatgatgctcttggggcattcaaattcacaagcacaaaaagaactacattttgggtaccacattctaatactactatccacagagtggattcctcaaatcagccatctggtatatagaatatgtgaaaatgcatttccagttctagcagagattgttccatccataggtctagagtagaagtatatgtaatcgttgacaatcaacaaagcatatcacttatatcttatttagtttgaaggtgccgaacagggttgttgtacatgtttttaaaaaaattttattatggtcatctcgtctccacccaaacccccaccaaactatttctaccctcttaagccagggtgagccaaagtcccaacctttcctttacgtacaagacccacctaaggaaggaagcctgctattgttggactatgtttagaacagatgatgctacgtgatgaacttcgagcattaatgacagatagtcttctagatcctatctaatgtttaggatcagccccttcaaattgttttttgatggagcctcaggaatggcaaagaaacattgcaacttgtgcttcatctgccaattattgaaggaggctgctggaaacataatatagaaaattctgaggtctcaactaggattcgtaggacagaatgtaagcattatttggtgatgacatgttttatttataaagtcaaccttagatgcaattctgctgactcttctacacagagaagaggcctgctgaagaattaaaagataagaacaaagctaaaatgagaagcataattttcccctatgtcctcctagttagctcttatggacctttctgtaacatgagtttcttctactaagttgtaaaacagatcctgttttacttttctcttctcagtcctatgatacagttcagggccagacacatttactctagttgttcaaaatgtagcctgcatgaaaagaccagtgtctcagagacataccaaagggcagaacagaaacaaggcttagaaacaaatttaacataagtagagtatgggtatcaaggacttttactgtatagcgcttgcaattatgtgattagctttcagcaagatgtgttttctctctatcttttcaaccagaaaataatttaaaaaacaaagataacttgaattggcctcaaagctgtctccatccctgtaattgggaataataacagctgcccacctacttcacgagttctctgtgaggatcaaaggtgctctgaaaggatgacatacaataatggaacctaccactgccatatcctgtcttctttgttagtggattgaaattccagctagaacacaatgtcctacagctccagggtcctcttgtaagtttatctctcaatcaagtctcattaagagctttttatctctcccctggaactcccagaaaaggccctaagagggatagttttcttgttaggaggaaattctgggttgtctgcagccttgctgctcaaagtaggtccacagaccagcaacatcagcatcctttaggagctcattagaaatgaagattctcaggccagccccatacttactgaatcagaacctgcattttcagtaagacctctaagtgatttatgcctcttagtgtttgagaaggctggtcttcagaacctttgcaagataaaggcctcatacagcaacaatcggaagacctttaaaaccgatgcattgggtcagtgatagccagcttttctttttcatttaaaaagtgcatctttgcacatccagatttcacataattcttggttaggaaaaacaaaaagaaaaacaaaaacaaaactccactcttgttcatagtaatctggccctactgggttctaaaaatgtcagtgaatctctgccaaatttccatacctcgtgcagaggaggagcctgcttgcaaataacaatggcagccaggtgctgaaagtggacactgaagctgaaactggagctgaggttaaattatttattgaaattccatgacttggcttgtctgttagaagccaaccaaacctagagtcactgagcatgttcatctcgaacaggccccatcctgcaccccctgaagttacctgcctctttgcctgtgggaccagtcagatgtcggaccctacctccaggggttaagttatggaaacatgacatggctgggttagtaaactgggctctctaaaggtgctgtcctgagagctcctgatgcccatggctgagcagttcagtggcttagcagtctgcctctgtgcaacctctagttcatagaaagcctgcctgttgcaggaaaaataactcgcttgcagctaactctttcttttcattttttaaaatgaacaccctttgtctcagggtttctatttgtatgacagagagaaatgtgtttttttgtgggtgtttttgtttgtttgtttgtttttgccaaccaacatcccaatatatataaaatgaattaaaccctgtagatatatattccttttacaatataatcactaatatttgatcctcaaaagcaaaatactatgaaaacatgttcatcaatagcagaataggtggccgggcacagtggcccatgcctgtaatcccagcactttgggaggccgaggcgggcggatcatgagatcaagagattgagaccatcctggacaacatggttaaaccccatctctactaaaaaattagctgggggtggtggcacatgcctgtagtctcagctacttgggaggctgaggcaggagaatcacttgaacccaggaggcagaggttgcagtgagccgagatggcgccactgcactccagcctggcaacagagcaagactccatctcaaaaaaaaaaaaagcagaatagttgattacaatgtgatataaccatatgatagaatagtatacagctatttaaaagcatgagtttgattcttatgtattattctagagggagtgtcacagtaggagaaaaaggcaaatgacaaagtaataagaacagtgtgatccctttttgtatttaaaaacaaaatcttgcatgtgttcgtattgtacgtgtgagagagaggagaaatatatatagttttatatataaaaccaccaggctgggaatcagaaatcctgggtttctgtccttatgctcccctgagaagtgggggctgctcatctctgggcctctgacaccttctctgcctatcagtcagagtgacagcaagagtcaaatgagaccatgtgcatataagggctctgaccagtggaagtgattatagcttccaggcacctatggaaagatgaaggttaatataacaattatatttatatatagggcagaatgaaataaatggtaaataggagactcaacaatatgtttttcatgtcttgggaagcagtgtttactactgtgtgtgtgtgtgtatatatatatatatatatatatatagagagagagagagagagagagagagagagagagagagagagaaagagagagagagagggcatgccatagagaggagttgagggcaggacctgatactgataacatcagtttcttcaggtgggtgcattcaaggggtgtgtgaaaggagagtcttcatattttctttatgtggtttcaagcaaagaaatatttgaaacccttgggaacagatgtgtttcaaaattcaaaatattttggaatgtagaaaggtaacatgtgtggatatatatgtaaccccatccccaccccctgcaggctctgggacaccacactgctgtaatcaagtctgttataatcacatctccacagcaccaagtggggcaaagatggactacaaatcatctctaaagttcaaggaagttttgcctcaaagtgaatttccacaaacttatgaaagaacttacagttttcagagctttttgaatttcaggattacagataaagaattgtagacctatatatttctttaaggtttgagttgtcacagtcatcttgtatttttaaaacaaataaagtaagctaaaagggaggtgacaaaaaaagaaagaatatatgaagaggaaaacccctctgatctgcccttgggtccctttacttgtgcctccaaaggctctgatttagaactggagagtgagcaggatgtagctttggtgaggcacactcaggggtcggcctgacctggggactggaaaccccagcaaattcaagcccactagcctgccatgtagcagatacaggagaatggcaaataaagatgaaagaaagacttttaatgaaatagaaagtaacttaggtgccaaggagtaaccagatcctaaagtgatgcccacgtggctcctgtcattcgatatgcaactgaaacaaaagtatttctgtcaaagttaaaatgtatattttaactttggccaacagtgactgtccaacacatgtatagatggcatcctcagtccagtgtgccaggaaccagtggtgccctcagattctcattggggcaggcaagtgcttgtttctgtctaggtctctatcaatatggacatttattttaaatatatatgtatatagttatgttgctaatcttaaaaaaaatcttgaaatgtgctttaaatccaagtatatcagattacaaagaacaagacaatatgttacctgtcaatctctaaggtgcaactgctgtacaacttgagccaagttagctggagccttcatttctcttactatgaaataggggtacagtaccattcatcaccctcacttgaaaggtatacaatataattaaaaagtgcttaaaagtctttggcttaatttatgttgtaaattataaatagcctatttctctatgttatataggtaaaggaccagggcctgaatgtcataaagagaatgtaaatgatcagtgatggaaaaaaaaccaccagactgggaatcagaaatcctgggttcctgtgctgatgctcccctaagaagtgggggctgctcatctctgggcctctgacaccttctctgcctatcacaaagagtgacagcaagggtcaaatgagaccatgtgcatagaagggctctgatcagtggaagtgattatagcttccagtcacctatggagagatgaaggttaatataataattatattacgtatacggcagaatggaataaatggtaaataggagactcaacaatatgtttttcatgtcttgggaagcagcgtttactactgggtgggacatcggaaaagtgtcctttcatttttattattttcttggtagatttgttttttgtctgcttgtttctttctttgttaaatgtgtagtgtgagtagacatcccagcttgcctaggactgggggaattccaggactttcaggatttaaaactgggaaggtccctggaaaactgggatgagttggtcactctatgtacatgcatttctactttcagaaaagaatttgaaggcatggttagacatagaagcttacatttaataaaggttggtgcaaacgtaattgctgtttttgccattacttttaatggcaaactcattcatacaatgcccatgcacagacagactttattcaattcaaagcagttaaaaatgtcaaataaccccttcttagtacttttggttcatcgtactacagttttgtccttcactggatcaaacgtagtgattctcagtattaataatcactccagactctgtctaaatattcaaatgggtaatggacattataatggcatagacctatgaggtttcctaacattaactagaatagacaaaaggcagcttgtcggaaaataacactaacaacaacaaaagggatattgctgatgctttttagggctggatgttacgtgtgtgctgtatgtatgcaatgtgcatattgtcttcccatgtttggttgacttttcattgctaaatgagcaatgtagttcatacagatctgcccacatatcaaaagaataaattatttcctttcagggctttgtcttttgcaagaaagtggtgtttaaactatatagttgatttataataaatatttgtaataaatatttattttaaataaacagattgggtgattatttttatttcacccttgaataacaaggattatagtaactttttcattctttatttttgactttgtggccttttggattttgcatgctttttcctatgactccacttcaggtgtttatagtgaaacataaacctctttttatcaaattccagtgcaagctttaatgacaagcatattgtaattattcttgctacattcaaattgtaatgaatcaaaatggtatgtggctttttttgaaagatgatcttttagttgctatttcaacaaaccccccagatctggagcccagctaccttccctccatcttttgtaaattaaaaataaaaaaatggatatgatacaatatcctaaattatttctttggcccttttgagcccatactcagaaccctccaatgactttgcactaataataggataaaattcaaactccttgagctgcctctcagggaccctttctttttccagggttataaattctcccctttcaagacctcttcccctgcctcccctcccctctaggcaaacagcttgcccacctcctctgactaggctcaggttggctatgtctgcacttttgttcatgtcatttctctcttttggacagcattatctgtctctactttcaaatactaactcagaccccatcttccctggaaatcctcttcagactacttctattagaattatgttgtgtatagttcatttcattcattcacttgacaaatactaaacatcaacaatgtgtggggtgctgttctaggtgcaagggatgcccagtgggtttccactcagcgtctttccctgtagcttgctgcagtggtggggtttttctctggaagcaacagagcaagaagacaaaagacaatagcagggaagctcctgggctttgggtctgactaggctttgccacttactagggttgtaatcttgggaaagtttcctggcttcagtttgctcctcagtaaagtagaaatatggtgtggtacttaaaaagttgtggtgtgaatttattgtccatgtaaagcatttagggatagtttgtggtgcaaaataactgctcaataaacagcattacattatgatcttatacctggtctgacccatctatggtgccttttttcccctcagtgctttccatatccgagaacttagtgttgggcttccttgtcattgtgtgataaaatactcttctctttgactggggatggctaacaatgagtgattcctgagcaggaatcgtaagctttccaataaaaatatatgtggggattcttaaatattttaaatatttcagtgaaggtctatggggattctaggaagtattcaacaatatttattaagaacttctagaacagtggttctccaatgttagcatgcatcagaaccatttgaaagccttgttaaaacacagtaggtccagggtggggcccaagaatttgcatgtctaacacttttacaagtgatgctgaggcttctagtgtagggtccacacttggagaacatctgtactagaagttgggattgaaaataattatgaggctgggcgcagtggctcatgcctgtaatcccagtactttgggaggctgaggcgagtggatcacctgaagtcaggagtccagctgacccacatagtgaaatcccatctctactaaaaatacaaacattagccgggcatggtggcacatgcctttaatcccagctacttgggaggctgaggtaggagaatggcttgaacccaggatgcggaggttgcagtgagccaagattgcaccattgcactccagcctgggcaacaagagcaaaactccattaaaaaaaaaaaaaacagaaaataattatgagagagctgtggatcagccttccaaaggagctcaacagccagagtttgaaaaaaaatgcacaacagggtgggatacacaacagccacggaccaggttagacaacactaagtggagccctggttccattattcactgggatataaccttggacaagtcatttacctcctctgagctttgttttccttattcaaaaatgttagaataagaatcttccctttatatctcacagtgccatgaagacccaggacacatgtattatatgtgctaactgaagaccaatcttcaaagttcaggggaaggggcatttcctcccctttctccagtccaaagtaactccttgaatagacaagagaccctctaagcatgtcacgttctttcctcattcactaaggcattgttcaatatcttaaagactgaactagctgaatagattccctggtaactcaaaaccttaaagcagctttgaattaagagcctgtctctgggaagtgacatttagggaaggtccactaaggctatgtgggctccacccactcttccagccttctgccttgtcctgaatcacattgggctgacaagattagatattcctactgcataagattagcacctgtgaaaaatcattctccttgaatcacattttaatgccctggcctcagtttttacagttactagatgaaataatcacccaaaatttctactgcattttctatttaaaaaacgttgatggcattgttcattatatttttgagtgatccccacacactacttataaaccattacatgagaaatggccttttagacctttgtgagatgcatcatagtatgcaaatattttctcccgttctgtaggttgtctgtttactctctctgttgatagtttcttttgctatgcagaggttcttttagtttaaccaggttccatttatcaattttttatttctgttgcaattgcttttggagacttagtcactttttttttttttttttttgccaaggttgatgtctagaatggcatttcctaggttttcttctaggaattttatagttttaggtctaacagttaagtctttaatccatcttgagttaatttttgtatgtggtgaaaggtaggggttgagtttcaatcttctgcatatggccagcctgttatcccagcactgtttattgaacagggagtcctttctccattgcttgttattgtcaaccttgctgaagatctggccttaggcatggggctttatttctgggttctttatcctgtttcactggtctatgtgtctgtttttatgccagtaccatgctgtttcaggtagcaaataaaggcaggaacataaaaccaaatactgcatgttcttacttataagtgggaactaaacattgaatacacatggccataaagatgggaataatagacactagggactactagagggggtagagtgggagtggggtgagcattggaaaactacctattgtgtactatgctcactacctgggtgacggtgatcatttatataccaaacctcagcgacatggaatttacccatgtaacaaaccagcacatgtacccccaaaacaaaaataaaagttgaaaaaggagagagatggctttagaatctatcaccacaaagaaaagaatacttaatgttaagggaaaatgctagtgataaaatgttgtgaatagagcatgctgcaaaatgtatcggttgtataattccaataattaaaaaaaaaaaacctagaaagaaaccaaaacattatcagaagttatctaattacttttataaatagaaaaaaatatttttcaaagtaattcaatgacagggaatttcatcttctccaagaaattgtcttcttccactctcaaaaagagaattctataactcattgtgtcttttttccctccttgccttcttagaagctcaaagatcattatttgaagcatgcattgacccttattacaggttcatttagtgcttattttcattttctgttttgttttgttttgagacaagatctctctctgtagcccaggctgaagtgcagtggtgtgatctcggctcactgcagcctcaacctccagggctcaagcgatcttcccacctcagcctcctgagtagctgaaactacaatatttaccaccaggtctggctaatttttgtatttcttgtagagatgtggtttttccatgtttcccaggctggtcttgaaacctgagctcaagcaatccacccacctcagcctcccaaagtgttggaattacaggcatgagccaccgcacctggcctcattttctgtcttattgctatttcattttacacgtgcttactagatgagtagtatctacttatataatttctgaaattttgaaacatcctgaactttttacaaactaaataaggagccagaagtaagtgatatgtaagttccaagaaaattaaacaactagcttctaaatatacctcaaaaagtaatgtggtttctcaaggcttgtgctttgcagtgggcaaatctgatttatatatttatcaaagaccataatggatattacattccttttctgtaagcagttgatactcaatgagatacaatgtggactcccttagttaccacctctgtgggggccaggcctaggtgggaggaaaaccttgcactttcatattgctgttcagttttggtgggcatctaccaagggaaccactctggaggaagactctctgtctgatgaaatacaggggacaggccaggtgcggtggctcatgccaataatcccagcattttgggaggccaaggagggtggatcacctgaggatcaagatcagcatggccaacatgatgaaaccccatctctacaaaaatacaaaaaattatccgggcatgatggcaggtgcctgtaatcccagttactcgggaggctgaggcaggagaatctcttgaacctgggaggcagaggttgcagtgagctgagattgcagcattgtactccagcctgggtgatagagggagactccatctcaaaaaaaaaaaagaaaaaaagaaagaaatataggggacagtcaaggatgacactgaggttttgatcttggaatgttggaagatggcaaagacaatatgagaaacgggaaatgtgagggagctcagctttaggggaaggtttctgtgtaagaagaggtagctgtagaacctgtagtttggaaaggtgaacaaaccttggacacctaaccatgcaggggctgtgattcttgtcctgactccatcttatcagtttgggtcacctggggcctgtccttgctgctcctgcttgggactcagtgtcctcatgaatcaagcttgttcatctctaaggcatttccagtcctttcagtggatgagttcatgatattataaatttttttatacagtcacgaattgcttaataatagggatgcattctgagaaagggatctttaggtgattttgtcactgagcaaacatcatacagtgtacttacagaaacctagatagttccagcctactacacacctaggttatatagtgtagtctattgttcctaggctataaacctgtccagcatgttgctatattgaacaccgtaggcaactgtaacacaagggtaagtgtttgtgtatcaaaatatagaaaaagcataataaaaatacagtattataattttatgggaccaccgtcttctacggggtccgtcgttggctgaaacgttattatgtggtatgtgactctgcaactcatgagacattttacacatggagataaagacttgggtcaactctgtttgtctcagattgcatggctgcatagatgagtggttttaataagggacatttaagaagtcaatgattcgcttttagtactgactgacacttttatctcttttctgggaatcagtctaaatggcatgaatttggagtttgtaagagctgaaaagaataatgagaaatctagaaatggaataagccttggtaaaaggtgagaaacgattcaagcataaggtgaattactaaggctggttgcctacttttatgagctgcacagggaaaaggccacaaggtctgggaaatggaagaaaatgaaatgccaataaaacaaaggaggtgggcttccttgtaacgtacattcagtgagagatcataatgctcaacaaatctgttaaatcctcagacctctgcccagggactttttcactgcctgacctcacctgatctaaagttcatgcagcagcacagggagggagggtgagaggaatgctggggaggacttggatagtattcttactaggaagccataaaaatgcatatattctgggacagggtgtgtgctgtcatgcacagagccaccaaagtgtcatcaaatgagtagtgtccctatactacctagtgggagttgggtttgggtaagtgatgtcaatatacagccctcaggacaggaagaggaatgcttggcacaagacacaccattgagaagagttttgtaacaatcggttggaagagcgattgtggcattccttatagctccgctctggctaccctgctcctgcatatcacggccttaggagttacagacgcttgggatctctgagaagacacatagaagattcaggtatggactggctggcatgtaggcaacaggtaggacaaggtaggttgggggaatgcctgtgtaaagagagaatatagacaacccttcattcattcattcatttaaatgtatgcacacatccattcaatcaccaaatatttcctcacctggtaagggctaagaacctgccttcgggcctgaaatataatgcctttctcagataagtcttttatacccttctcccatttaaattagtcctccagttatttccttaatagcactttttatcacctgaaattacttgacttatttctttatatcttctctgtctcatccactagaacacaagactccttaagtcaggaaccatatctcttttgttcactgctgtagtcccagcactaaaatcaatgtccagcacatagtagggcctcagaaaaaccattttttgaaagaaaacatcatcacagagatgaatagaacctaggcccttcaagaaaagagtcaaagagagtgtgggaaagcacttagtggaacatagtaaaggaaagagaaaactagtacaaaaattgaattggttttcccctagagatttaaaaaagtacttgggattaaaagacaaataaaacattagaggagccatcagtgcattggttccttgtgctcaagatgagagggatgtgtagaattaattctcgagtactttccaggcctcctggcctgggagtctgctgtcttcaggtccgcaatgccagtactgtcacctgtgctatccctggactcaccatgttggggtggaagggacatttgacaggtgctccggaacccagcttgacattgacttctacccggctgtgtggctttgagacgagacagttgactttgggagcttcagcttttctctaccagtaaaatgagaatgacacttgtactaagtgccccgcctccacagttttgttttgaggttctaggtaatgtagtacgtgtgcttcataaactttgaaacaacatacagatgtttgcaaatgacaggtcaccaggatgctctcccctggtcactgcagggcaaggctttcatggtcttcttgccttcgctggggctagttacccacaaaatggagttctgatggtggactttaaaggaaaaacataagccattcagcgagcagctttgtttacagccatccattcaaaatcactaatgaagaattcattgaggtttccatgatgttttctttctttttaaagatgagatgactgggtctcaagaaatccttctttccctccaaagacattcatcgagcagctctatgcctggaactgtcttaataccagggaaacaaggtcggtaactgccatccttgacgtcatagctgcctcacggggaagacacagaacatttggcacactcatactcttataaggcaatgggatctgagcagtgaaaaagtgcatgggagatgtgggaacacccaagagagacactgaaattagcttggtcatgctggagggagggcctggaaaggccttctagaagctaagccctggcaaagggggtaaggaacatccacatagagagggaaacctgtgggagagaagaaagagcctggcccctctgggagccctgagctgttgttcagtgtggttgtcacttgggcagtgaggtagggagtggtaagagatgggcccagagagataacagggagcagatcatgaagcaattcattctaccttcagggtttaatctcatatactctaattttcaggcgagaatctaaaagttgctgtgccatttagtacagcagagcaggaagtatgtgtatttgacctccttgttaatttcttcccataggtacctttctgtaaaaagcaggctcatccccaaaacactgtgtttcaataagctcgatgcagtgcaacagtgaagtgactcctttcttagcagctgggttggaaatgcttctgtgtccctccagacctgctctctagcctcaccactctgcttggggcctggaggctgacagtgggaatagcatcaaggggctccctgccctctggctgcattaggatcagaagtcctaatgcacgcgaagttgggtatttattgccttggccccatccctaccaggccactctgggttggctgcatcccttttccaaaggtcatcctccttccagtgactctttttgggtaaagggtcagatctaagtaaagggtccttgtagttgttctcccatgtataggcctcaattatctcttgttggtgcctgatgtggtttggctgtgtacccacccaaatctcatcttgaattgtagctctcataattcccacctgtcatggcagggacccagtgggaggtaattgaatcatgggggtaggtctttcccgtgctagtaaataagtcttaggatatctgatagttttatagaggggagttcccctacacaagctctgtcttgcctgccacaatctaagacatgaccatgctcctcattcaccttccaccatgattgtgaggcctccccagccatgtggaactgtgagtcaattaaacctctttcctttataaattactcagtcttgggtatgtctttattagcagcatgagaacagactaacacagtgcctttaaccctgatcatgccctgagatcctgacacaccatcattgatttccccagcatcactggattctttggtgtaacaggaatgcagggtggtcagaatccttggtaccattgaataaagctacccagatggtgaggagcactaggttaggagtcaggaaacccagcttctactcccagcttggccaatgattagctgtgtgacctcaggcaggtaaaaatcctgccatgcattcattctgatgaaaggacattgtagcctaagaaggtagtgatgtctgcaaatggaaagggtagaattgtctgctccagctttttgtgagggtgccttaagggccactttggggtcaagaaggacacagccaggataagccagagaaggccttctttaaacttttttttctatagtgaggctccacacatgatttagttgacataacaaagaattccttgccaccaggaaacatttgaaaacaactgggctcaatgaagttatgaagtcctgtttggttttcagagctgagatttcctctgtgctcattcactgggtggagaccctggtaaggatacaatctcccctgcattccacaagtacagcagctagtagctaaaccacttgtggggtcacttaattgctttgattataaagaggcagtaaatgtgaccttgcccaacttaaaggagtcttgtgcagggacagaagaccctggggtcatattatttgtacacaattccaggatagcattaacctgagtcattttccatgaactactcacatgtatcagtggcagtgtgtctcacttgaaagtcagtgtgcctcttgtgttgcccatggaactggagacctgatactctttcactggcagccactggaagatgctgagaatagcaacatgagtggcactgtggacttaacccaagcatttgaccccattaacttagttggtatgtgggaagctctgcaaaatgtttgcttcctagagacacttattaacatcacttctcactctacaaaacctttcctgataattgtcctgccagaagttatggcccctccctctgaactcaacattcagcatgcttttctgctgccctttaaagttagattccagttggtgtgcacacctaagctctatctcttctgctaaactgtggtctccattggagaaagaaacatgttgtacacatgtctatattctctacagtgccttatagacagatgaaatccagaaagtgtttattgttttgttagctgacagtcagggttgacctgtgagggaactataagatagatttttgtatcgttgttataatcacaacaccaaagtcttagcctgttcagcctgccataacaaaatcctgtagattgtgtggcttaaataacaacaaaagaattatttttcacagttctggaagctgggaaatccaagatcaagatgccggctaatttgattgctgtgggggccttcttcctggtgtgcagatggctgccttccggctctgtcctcacttggtagacagagggagaaggagagggagagagagagagaatatctctcttcctcttgttataaatcccccaatcctattggattagggctacactcttatgacttcatttaaccttaattatttcctaaaagcactatctccagatacagtcacattgaggattaggatttcaacatatgaattggtgagcacaatttagtcaactgcattctgtccctggccccccaaagttcatggccttctcacatgcaatatgcatttattccaccccaacagccctaaaagtcttaactcattccagtgtcaattctaaagtctaaagtccaaagtcccatctaaatatcatctatatcaggtaagggtgaggcctgaggtgtgactcaacctgaggcaaaattccttcgcagctgtgaacctgtgaaatcagacacattacatgcttccaaaatgtaatgttgggataggcataggataaacattacaaaaaggagaaattggaaagaagagaggggtgatgggtcccaagcaagtccaaaacctagcaaggcaaattttattagatcttaaggtctgagaatagtcctttttagtttgatatcccaccttcttagcctgctggggtggcagttctgcccccatgactctgccaagtcaggttttcaattgattaagtctcagccacgttagggagggcaatctattttttctcagtccactaattcaaatgttaagctcacagatacactcaggataatgtttgatcaactatctgggcctcctatggcccagtcaagttgacatgaattaaccatcacaaggggctttaggaatcatctgatccagccatctctccaaagcatgaatccctgtggctacttgccattaaaaaacctgaggagattcatgccacgcttaactattatccttgttttagcagggttctattaaattgccttcaaaggttaagtttagattaaaattagaaagagtatgaaatcacagcataagcattttgagaacaaaggctgctgctgacttctcaagttcctcccttgcgctttgtggtgctggcccagccaatagtgtgagcacaggagggcagatcctttccaggtcaagacaaatggggtttctgccagactccgacctctggcaggctcagtgcagctgcagccactggcagagggggaatgacctggggagaaagctaaaggccagtctcagtctatgaggcttgggttctgaatacagagggtcagtacctagggtccaaggctctccccttcccaggtagcagcatgactcttctgcccccatggctagaactgctctgtagcctggaagtgctgatgtgcaggattctgtctgcctttctaggctgcatttgacatccatttgaatcttgtttcactcttgtcaaaatgttgggaggaggaagagacacacaacaggattgactctgacattaagtactctccccacccccaccgatgctttccaggtggtgttttaggagaacattgtctcctttcctgattgtcatcactaagacctgagacacccttttccagcttctctgacaattagcctcagcatcctgtggaagctgtagagctctataaatattctcattcctgatattatctctgtaaaaaaggtgatatcattttggctaggaaaagtcagaattgctttgaaattttggtaaaaacattaagaaaaatccccaaattgaaatgtagatcaatggaagtagttttctagattcaccagttttctatggtgataatattactgtttgaccagtatctccagtgctgcccttacaacatcgtactcatgacgttaataagcacgtaagtcaggtaatatagtttaatttgaatggtcaagtgagaaaggcccaccttgctctttatagcaatctctgcagtggttctgttttgtaaatagggaatattaaaatttaccagaagttagctggggcaaggtaggcatcccattaaagataccaaaattccccaatgggcagagttgcagggaaaataatatctgccctttagaataggaggcaatagtgaaaaccccacccctgggctagcaatttgaggaacttcaccatcaggacattgatggctaaactctgggtctaactcctgggtgtttctgtgtatctatgatgggattcatctcacatccatgcactctctccagcgacgtctccatccatatatgcatctttgttcttgagagggaagtgtagaataggagcttggaagtgaatccctatgcacaagaccctgcttttcctctgaaccaggcaaccttggggaagacatggagtttctccctgaaactcttctcctcatctggaaagttgggtcatgtgaacagggttgttaggacaattaaattatataattattcaaatattctttttaggctactgtgtgttttacaaatgaaaggtattgttaagatcaaacaaaacaaggtagactttttgcactcatctgaatgcttcaccctctgattcactgtaggcagcaccaatgccctattactttttaaagtggtttccattcatgtttaagtcactagtttccattccagcaataggtcagtgagttaggggcagctaaaaatataactgcctgaacgaaacaaagaatcctccatcttgacttttactctttgtttcctttttgttttagaaaaccacttgagttggccaacaagcacccaagtgtgatagaaggatggtgggtttcacatctcactcccatcaaccataaatgtgtagcatcacacaagctctctgagcctgcctgcaggtgagttacctcacagcaaaaatttaaataataacattcacactgcagtttcttctgaaaacccctgttacatagtaagggtgttcatcctgccttacaaaatatactgatgccaagtccaagatcagaaatgtgctcttaatctaaatttaggaagattaaacaaagttggtgagcatccagaaaggtcaaaataaaacttgagtttgcaatataatgataaccttggagtatttcagactgtcagctcccttaagtggcacacaggttgttgtttgattggtgtgatgtcagacaaacctggattcaagaccgggttcttctcctaccagctctgtgatcttggaaaagggactggatctctgaaactcaggttcctttcatgtgaaatagacccatatcaagtctctcctcaagctgtccatgtgaggattagatgaagcatctggctactgttattattgtggaggaacattagctcaagccacctgcagcagacagaccctaaagtgacccccagatccccttgccttctggcattcatgccttatatataatcccttcgagtgtgaatgggatctatggcttgtttctagctaacagaacatagtaaaggaaagattttctgcagatgttatcaaggcctaaatcagttgcttttgaattaagcaaaagagatgctatcctgggtggccttactgggtgaaagctgctagaaaagagattcttgctagtcctaaaaaagcaagctactatcatgtgaatttcctgtgaagagggccagttggcactgtaccataggcagcctctaggggctgagggcctcaatcctaaaactgcaagaaactgaattctaccaacacccaccagagcttggaagaagactcagaactacagacaaggatgcagtcctagctgacaccttgactgtagcctgtgagatacagagcagaggacccagctaagccattgtcagattcctgacacgtagaaactgtgagataagaaaggtatttgttttaaactgctaaatttgtggtaagttgttacacagcaaagcaaactaatatacccctatttctggaaatcatttcctagagacaggcttgtattggaggaagatggggtttcctcacgtcccatctacagaactgatgaatgtagggatgagggaaggaaaagaaagcttcctcagatacatctgggagtgggtatgtgtgagcagagggttgctatagtagaaagagaggttaatgagacagaatgtgaggagctcaacactgatacttgacagccttgtcaaacacagctattggttgaaactgtgtgaatccataacaagatttttaaaaaattagactttaattgttatgttgtggatttgtgcataccatctacttcctaaaagactttaggggcactcgaaatcaaaacaacttatgatcatagcaaaaataattaacaagaggaaagatgggcatcagaataaggttgataaagggcagcgatggaagagaaagttgtatcaagagttccagaggctgtgaggcaagccccttccccactctcaggccattctaacctaccatcttcaatggtatcaggtgctcacacctataaagcccacctctaaatctgactctgccttggggaccttgtcctgcattcctgcacatcctgtgggatacactgtgatgccccacacgtaggagatgctcagcagatgtctagtgaaatgaattgttgacccagctcatttctaacaggcagcctttccagagaatgacagcgaatgtgtactctctgtgtttgaagactgtgtgatgttaattgaagtgcctgcaagtcaaaataagaatgacagtttattttaaaaaaatattttaatggggatcctgaaagtgaaaacaaatccttcacggagagattctttattgaagagaattttagaaagaccacagaattcagtcctgccccactgtgaattcaattccctgggtaaactacatagcgtgtgtttatgcctaacagatacatatgcatcatatgcatgggtggcctgtatgtgaatgcagaaatacctgtgtatttacactccagtatatctgctgtaagtctgtatcagtgtttctccaccctattttcattatcacctccctcaaggacgctttgtaaacatgttttccctaatcaccccttatatagacttaataccacagatacactgtatatctatttaagggctgtatgtatatatttatgccttatataaaaagagtgtaattttgtaccccatatgaaccaattttattacttttggggtgataattacccccctgccttgagaatacatggtctatatgtgcatctgtgtgtgtgtgcatatgtgtgcctgtgtgtgcacacacacacagacacacaaacacaagctaactgggcagaggtctgaaaagcattttgagatatttgaggagaggtttcccatcaataaccaagaaagcagttctggtccagtgattcttgtaggaaacagatgctagcaattagaaaactggaaaactccagttggtcctgaagcacactgggcatgacctgttttccaaatcttcagagatgggggagattttataaggccatatgagcagaaaacatctaattgttcataagaggaaaatttctgaaattctaatgtctacattgccattgcaaactatgaagttctcacatctattttaaagtaactgagcaaaatacattttggacaaaagggaaccattagcatgtttaatattttataaatatgatcactatggtaggcaagactttattcaacaatcaatcaagctctgaaactctcatttgcacctcgaaatgcttagctttacaaaaagagttgtaggaaatgtggaagtaaagatcaatgcatctgctttcaaatatcttcaatccaattttgttacaacataaaccagataaatatctgaggacctcaaatctgtgtgagttacatcaaccacaggacatgggagagaaaacccctctcttgctactctgagtaactgtagcactacaaaaacacagcatcattcaatcacatttctaaccctgacaaactttcacataacagaggtactgaccactttcacctttcctttttaaataaaactgtaaactaaggagaaggtaaaaacaagggccactagagtgggaacagatttgctaacaactgtgattggttagtgtacacttactatgtgcccagtactatgtgttgggcccaaatacacgaattctttctatagcaagccctgcggaaatcattcagcctctgttaaaatacatccgttcatgggaagctcaccacctttctcaagataccccattgctctgttggggaagttttattttaagaaagttctttgatgtgttaagctaaagttggcttctccacttaaaatcttaaaatcagccctcagcttttttcttgagattgacataaataagttgaattatttctccatgtggttcactaaaggcagggctcatggtcagcagatatccccaccaagaccacatcttcagtgaaggctgaccagatgggaattcaacaggctgagggtaaggataacagttaactgtcttacatgttgttgctcaggtagtgaatgacatgagtattaaattgggcatttatttacccgttgatgatagactggataaagaaaatgtggtacatatacaccatggaatactatgcagtcataaaaatgaatgagatcatgtcttttgcagggacatggatgaagctggaagccattgtcctcagcaaactaacacgggaacagaaaaccaaacaccgcatgttctcactcataagtgggagttaaacaacgaaaacacatggacacagggaggggaacaacgcacaccagggcatgttgcagggtgaggggtgaggggagggaattcagaggatgggtcaatagttgcagcaaaccaccatggcacatgtatacctatggaacaaacctgcacgttctgcacgtgtatcccgggacttaaagtaaaaaataaaaataaaaataaaaaattgggcatgtattacccaacaccatgtctcatgagtggtgaaagaagcagataaatctgggcaagtaaaggaagtccactgtgtacagtgcccacggacctacagagacagagggtgcccagtgcctacacctttgacctccctccaaccactgctgaagcttccttgacacttcctatccttgacagttggttacaattatgtctgctcttgccctcacccattcactctctcaccagaaaataattaaagggaactaatatatttataaataacagtccttttcctttttaaattttcatataaacttgggaaatgtacagtgaacaagtactattggtatattctcaatattcaagcctattatagtgtccaggaaaagggatgggaagaaagaattaaagaaagaaatgttttttttaaaaaaaacctcaaggtggccaggaacactgttccttcaccccagataccaggcaggcccctttggccactccttaggagagatgataggttaggaacatgtataagctgtgtggccttgaacaagccacttaaccattagtgcctcagtttcctcatctatacaatcctaataatagtatttaatacatagagttgtggggattaaataataaattcacataaagctattagagcacacatagtaagcatttagtcaatgttagctgtcattactattattcttttcccttgaaggaggctttcagaaatttttataacttgatttcactcagtgagaagccttcaatttggtaacagaagaggggatggagagggaggagaaagaactcacagtgtgatctgctttacgcaggcctcccaaggctggcccagcaactcaagataattctgtgttcatacaagccctacctacaatactgggttgacatttctgttttctctattaaaagcatcccaaataatgtactgaagttgtaaaataaatctttggtgctaaatatcctaatgagacatttagaagcactcaaattaggtgttacaattaatatcataggatctataagattcaaaagaaaattccatttattttttttctaaagagataataatctgagactggataaagaaatgtggtacacatacaccatggaatactatgcagccataaaaaggaatgagaccatgtcctttgcggggacatggaagctcaaagccattatcctcagcaagctaacacagaaacagaagaccaaatgccatatgttctcacgtataagtgggagctgaataatgagaacacatggacacaggaagtggaacaacacacacacactggggactgttgagggctggggtggggggagagagagcattaggaaaaatagctaatgcatgctgggcttcatacccaggtaatgggttgataggtgcagcaaaccaccatggcacatgtttacctatgtaacaaacctgcacatcctgcacatgtacctcagaactaaaaaaaaaaaaaaaatagaaatgaaagaaataatgatctgggctcttttttgcaaaccacggaactcactctagctaaattaagcaaaagagaagtggggttagaaagccagttcttgatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaaagtttaagtctttaatccatcttgaattgatttttgtataaggtgtagggaagggatccagtttcagctttctacatatggctagccagttttcccagcaccatttattaaatagggaatcctttccccattgcttgttttaatctacaatgaactcaaacaaatttacaggaaaaaaacaaacaaccccatcaaaaagtgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacattgttggtgggactgtaaactagttcaaccattgtggaagtcagtgtggtgattcctcagggatctagaactagaaataccatttgacccagccatcccattactgggtatatacccaaaagactataaatcatgctgctataaagacacatgcacacatatgtttattgcagcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaactggaaatcatcattctcagtaaactctcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctacacaatgtgcacatgtaccctaaaacttaaagtataataataaaagaaaaaaaaaaaaaaagaaagccagttcttggcttctgccttgaagatgctgggcctaagaagcgtgttcaaatggcactgggtagcaatgaagtaggacgaatatctactacatacatcaataacaaaatcagttaaaaatactcccaaaatacaaacatatgaatagtgggcaaaagtgccctttattgttacttgttggcaaaagaaagaaccaatttcctgccagatcatggcatttgagactatggaaaaaggcctggaacatgaggaaattaggcatgcacacacacacaatgaaagtggctaatgtgaaagttaaccaaagtaagttaaccaaagccagagactataagtaggttccatgagtttatacaatctgaattaagcccaggacccagcaggcccaggaatgtggttccatctgtttcatggttgaaaaattccccagagaggccaagtgccttgatcaagggtgtaggggagtcaagagcagaaactgccctgagtgtttaccattaggaatgtgtgacctcataagacagtattctcctttctcaggtaatctgtccttgggagcggttgtctggggcttcacagaatggctttcctgcttgaatggcttggctaactcacctggtatgcaaaattggtttggaaatgagctaatcattatatttttcacacggtgacatcctggaaagacctgctgtgagttcccactagggaagtggaaacttcctagctaccttctcataggcaggtggctatgtcccagcacacagatgttaggacactgctcagaggagcagcatgtgtcagcagcacatggcttggcaggagccaggagtctaagcagtaaatatcaagggaatgatttgtcagaatagcaccccaagtgcaggggaagtgagaggaggcgtagtggtagaattagggaatgagttctgtctacatccagggcttccacctgaggactcgagtccgcaaccacaaaaacctttctatggacctggcaacaaagtcctaagcttcagcccctgtgaatatttcaacacatgcaggataggaatattaataacctggattcacatcagaatgttctccaagtaattcagaatgcttcattttacagctcaaccctgaggttgccagatctcagtgcttcatggaatggacagtgacaggtgaatatggccactctcactgaaggcagctcctccaacctcataaccatttacagcaaaggccaagcccacagctccaggcatcatgccacattcgttcaattccttcttggaagggtacctaggtcagcgatcagctcacacctgtttttgtagatgaggtgttactagaacacaggtatgtccatttgtttacatgttgtctacagctgcttttatactacaaaggcataactgggtagctgcaacagagactgtatagcctttaaggtctaagacattcaccctgtgactctttacagaggacatttgctgacctcaacctaggctatgagagctccaaggccattcaccaagtatattgtaaactccctgagagcagagtccttttggaacctcccatgggacctcacacagtgaggtacacaagagaatcaaagaatcaacttttagagctgaaagggacctcgggtatcattttatccaacccttttattttagagatgaagaaacccaagctgccagttgaaaataacagaatggcagaaagcagaaccaaaaatcaagtttcctaaactccactgtaatgctctattacttgacaattggtgaatataaaataaatgaaaagataggtatggatttacacaggaatatcatttgctgggtatatggtgtgtgccaaatactatgtggatgtgggtatttcagttttggacctcaaatctcaggagaaaagtgtatgtatacatattatatatacacataaaatttatatgtgtatcctgtatattatgtgtgtgtatacagttgacccttgcaaaacacaagtttgaactgcacagatccacttatacatggataagtataagtgggtcttccacctctgtcactcccgagagaataaggccaacccctcctcttcctcctcctcttcctcctcagcctactcaatgtgaagatgaggaggatgaagacttatgatgacccactcccacttaatgaatagtaaatctattttctcttccttgtggttttttttttttttttttttttttgagacggagtctcgctctgtcgcccaggcaggactgcggactgcagtggcgcaatctcggctcactgcaagctccgcttcccgggttcacgccattctcctgcctcagcctcccgagtagctgggactacaggcgcccgccaccgcgcccggctaatttttttttttgtatttttagtagagacggggtttcaccttgttagccaggatggtctcgatctcctgacctcatgatccacccgcctcggcctcccaaagtgctgggattacaggcgtgagccaccgcgcccggccttccttgtggttttttaaataacattttctgttatctccttactgtattgtaataataccatatataatgcatatagcctacaaaatgtgtgttgactgttatgttatcagtaaggcttcccatcagtagtaggctattagtagttaagattttaggaagtcaaaagttacacatggattttcaacttgtatggaggggtcagtgcccctaacctccacgttgtttggaggttaactgtatatatgtaaaacacacacatactgtgtatgtctgtgtaataataagatgatggtgcacatgctcctttgaaggagacacccaccgtgaggggagtatccatctgatttgtgacttcagggtcaccatttttagttgttaccacctgttcatctgaacccaggtgatggaagtcagcaccaaaccgaaggagcagagccatgcatggatggtctttgtctttcatccctggtgtattggtttgttttcatgctgctatgaagaaatacccaagactgggtaatttataaagaaaagaggtttaattgactcacggttccgcagggctggggagacctcaggaaacttacaatcatggtagaatgcacctcttcacagggcagcaggagagagaatgactgccagcaggggaaatgccagacacttatgaaaccatcagactcgtagactcactcactatcacgagaacagcatgggggaaacaacccccaagattcaattacctcccatcgggtctctcccttgacacatggggattattacaattcaaggtgagatttgggtggggatgcagagccaaaccatatcacagagcctctttttccagctcttcattgaccatcccccatgtcacaaacctcttgtcaactaggtgcatctgataaccactctttgaaatgaagtctgggtattccttcactctacagtgttcaccaacaaggcattccctttgagaggcatttttctcccactctggaatgaaagttgcctcgccctagttagagcaattcttggcatacagatggaaaatgctttctgaggagtgttaggcctagataagcctcttatcatcctttagggtgaccttaactgggagaggaaccagaagagatagtccatggtttttctccagcagtgtccttactctcctggggtaggtgggtaccaagagaaggtcctggggtcttgactgggtggagagcctggtgtccccctatcacctgctctggaatctgccctagcaacaggtctacgggggagagaggggaagaggtggatggctttctcccccttctctgcctgagcttagctgggcctctcccctcatgttgcacacttgaactgaaccccaacttcttccctggctgtgctgcaaaacactgcttagtgccttcctgataccaggtcccttggcttggagctcccatagcctcattcttgccttcaggccacagtccttccaaatgcccagtggctgccactctcccagacccccaggctgcaagttctgccaggtcccagctggcttcccccacaagacccagggcctggcacctggtaggcttcagtaaacagctgccacatggaaaagtgcatttcaagtaccttgacttcattttttattgtttttaattatgaacacacattaaagggttttggagttagtcagaaaccccaactctgccactttccatgggaccttgagcaaaacacctaacctttctgaagccagatttcgcatgtaaaacaatcacaatatatctaaaggagtagggatactggattaaacagagtgtcaccacaatatctggtgcataggagagagatgctctgcaaattatatttattataatgccttccctgatcctgctacccttgaccatggcaagtgtctcagaaagactcagaaagtcctagcagtgaggctggaccacccccaccccccacaccagggagtaaactcaatcagcagcagctttattctcacctctgctttcagtcttctatgtggcattataacagcctaacttgtctgggcctcaaggaggaatgaagctgctagaatcctgcgaggactcgatggaatccatcaaattccatggacgatattgtaaatttctttagatttattgttatatctcacatttatagtgcctagtgaatagtctgtaattttttttgttgttgttgttgttggactctgccatacatatctgtaaatgactctaggtcttagaatggaagaagagccgactggaatagatgtaagatttctctcaagtcagtggcttcatccttgcaaagatgattttcagagcttactctagaatcctgactgaggaacttgggccaatgccacatcttgggcaaactggccaggggacaaaatctgctcttggtggccacacccacaatgcacaacaggtacacttttttttcccagtggcatgcaatactcctggtctctcttacccacttccttctggtcctcttccctctgcctactgacctgataaagtaatcccagataatgtgtcagctggggctactgcatccataggtagcccattacaagtagcatatgtatatttttaaaaggacgtctaagaaacattccttaagccaaaggggttgatcaaagaatgggagttcatgtcactatggcagagaagtgggtaggagacttgagaacaggtgcgtctttaggctgctctaactcacccaatctggtaattgccctgctttcttgtctaagtgttgggatctgaccttgaccttggactattcattgccacctatggagaattaaggaaaggcaaaaccttggtcatctccctcttgctcgccattgggaaaatgccttctgatttagcgcagcaatttctcctcattaagctacaaggggctgggtaaaatgaggcaggagagagcacaaattctgatgtcaggggatgaagtttgaagccaggctctacaatgtcctagctttgtgcatttatccagatgggactcagtctgaccttcagtttcctcatctgtaaattgggaatagtaccaagacctactccatggaattcaaggaatcagcgaaactaaggtgttcagaatagcagttagccactgttgctattattcaatttccaaactgattctctgattttgaaaatgcaaagacaccactcatgggaccaaagaggactgaggtgtgaagactggtttttctgtatcataagccacttcagtgatcctctgtctcacctacccttttccctcttccatccccgctatctctttcccaacattttcctcttcaagaaccttatactttgaggatggggataaatacctttgcaaaaacaacaacaacaccaacaacaaaacaataaacaaggctgcaactgtttttataattccacgggccatggagcagatcctaagtctaaaggtcactatataaaatgactgagatgttatataccttggggtgacctgagagcagtagaagaccactcgcctaccaaatctctcctacatttgaatgtcacagggctttaaatttccactgttagactcacccctgtgggttttggatactcccatggggcctggttaggttaagggcagtgttcccttaaccagactgggcacaagaatcacctgcagcacttgttaaattacaggtatctgggacctccttccctgaagactctgattcacacatttgggctggagtttggaaaatgccccaggtggttctcatgcctgtgcaaggctgggaaaccctgttctggtggagagtggtcaggtctggagtccggatctccaggtttctaagtttgtatagagcaacccatcatgcagcccctgacaaatcacctggtatatgagaggattaactatcttccttcctcaaaggataagagacccaaaaatgcttcaaaaaactgtatgtacacacaaggaaccattttaacagaatatgggaaataacgctgggaaaaggaatgcaagaatagtttcagtatcaggtggaagcagttgaagttgatctagcagatggggaatcgatgtcatacaggagaaggttcttctttaggaagattaagtggacagtattaagcatggtcaacaggaggtgagagaggctgcaggtgggatgccagtttgtagtaggaaacaagaatacataacttagtttctacggtagagactagctccaaacctgcttcctctctgtccttgcagcacagttagatgacacttcccagcttcccttgcacagaggaacagccacaggattgagctctggactatggaaagtgggtggaagtgattcgaccatgcaaacctaccatgatgtcctccaacttcaatcttccctgtgctggctgactgtagagagcccagcaaaggagttggccgtcccgcagggtggcagaactacagggtggagggagtccaagtgggggagaccactcactaaacactgcattgagctactgtgtgaaaaagttggtaggttgttgtttcagcagttgacctataccgaccaaggcagtgcctgacatctgaacagtgaagactgtagtttgcaaaaggggttcatgtttcttatcttatttgacttcataataataatcctgccacacagatcagatccctgttatattcacaaagtacctgaatgaggaaaggccacataactttccctacacagctcccctctcccagagcctgtggggaagccctgcccagaaccttcaattccacaagtaaaacctgagtcatttgtgacaaagggccaaggacatatggctcctttggtttcaggggcaaattctaaagacactgctgtctctagattttatgctataactataaaatgccacagagagcaaatgtgtaaatgaataaaaggcaggtgagacggcccctcgtcttcatccttggtgttgacggggcccatgcacactggcagcattaggaagcagacgtggacattgacaggagaggagccttgggctggatcaagaaacctctatctgttgccatgacaatctcccaaattggatgtttaagagaataactgggacatggtgttacttcgtctctattctaggtaatgggttcccagttggactccattcactgcacatcctcccctccttccccttttgtgttatttctccagtcggacacttgtttcttttccctcttaccatagaataacgttaaacaaaagtggaaaagaaaccatcaccctgaagtccatagaggttgatataggatatggggtaactggcacaaaacttctacacaccaaagcctgtgggtaaccagagacgtgctgcaaaggcctcccacgccaaaacaccctgcctcagatgcagggccaaatgcaccatgtttagataattaagcacttccctcttttaaactacaattgctccacaggcaggtaggggcacagcagtcttccactttataaacaaaagtctggatcccccagcttgccatcagagatgcttcatgatctgatctgctagatctgaatgtttgtgtccccccagaattcctatgctaaaatttcatctctgaggtgttggcattagcaggtggaggctttgggaggtgattaggtcatgagggtggagccctcacaaatgggattagtgttctcatgaggggctgaagagaatagagttatcctcctccacaatgtgagaacccagtgagaaggtgacagctatgaaccacattgtggccctcaccagacaccaaatctattggtgcactgatagactccccagcctccagaactgtgagaaataaatttctgttgtttataagctacctagttcatggcattttgtcatagcagctcaaagagattaggacagagcctatgtgtgtatatatatatatatatatttatatatatatatatacacacatgtataaatatatatacatgtataaatatatatatacatgtataaatatatatatacacatgtataaatacatatatatatatatatatacacatgtataaatacatatatatatatatatatatatatatatatatatttagatggaatcttgccctatcgcccagcctggagtgcaatggcgcaatcttggcccactgcagcctccgcctccttggttcaagcaattctcctgcctcaacttcctgagtagctgggattacaggcatgcgccaccatgtccagctaattttttgtatctttagtagagacggggtttcaccatattggccaggctggtctcgaactcttgacctcatgatctgcccacctcagcctcccaaagtgctgggattacagatgtgagccactgcgcctggcccctaacttacatttttatctgccttcccaatatccattcacaccctcttcagcacagccaagcagagctctgagttttctgggacacatccgggcttgtcttgcttctgagccattgttcacatgatttcctttgcctaggacattgcatttatttcctacctcttattccttgatcaccttggctaactcctcacgtgcctcattcctccctctcaaatgatatttcttttttttcctttttttttttttttgagacagtcttgctctgtcaccaggctggagtacagtggtgcaaactcagccctctgcaacatccacctcccgggttcaagcgattcccctgcctcagtctcctaagtagctggggctataggtgggtgccaccacacccggctaatttttttgtattttgctagagacggcgtttcaccatgttggccaggatggtctcgatcccctgacatgatccccctgcctcggcctcccaaagtgctgagattacagtcatgagccaccatgcccagccccaaaagacattttttaaagcaagtccttatttctgtacttcttctccatgctccctcctctggggaacctcctccgtcacctgtagctctgagcagaagttcagataaaatccctagccctgagcccctgtgatcctcagctctgatccttcagcattctaaggaacatctgcacaggactggcctgccagcacttcagattacaccattccaaatcaaacgattttaatgaacagcaactcccttcctcacaggatacataggctttcttcagagttaaaaggaaacttaaagctcaattagtttgtctgtactcttcaatttacaatatcttagacagtaatggtcaagcccatcaaagatatcaccattctagatgtggacactaacctttccaggggtgaatgtaccaggaaactgctgagtcttcggtgttggtgcccctaatatacactatttgcacaggcttcttccaaggcatgcacctaattttgtattcacttctgtattccacaacacactctgtcttttggcccttgtttggactcacttggcctcctgatgggaccactgggatagcctcctcactgacttctgcctcagggctctccttattccaacatggtcacagtgaatgcagccgtaatagcaatggcaaaaacagcagcagctcacattttatctcactactcttccttaaacccacatagcgtatatcccaaagtgttagattgggaacttatctcatcagagaaggtcagactggatgacttctggaagcttttccaaataataaattctatggttttatgaatgttgatcacattttatagaaaaaaaaaacttacccttaaagcaagtcacgcaaccagtgcgtggcagacctggaatccagatcttctttcttttgtttgtttgttttttcctgttttttttctttttctttttttttttttcccgattttcatttgcacaaatttatggggtacatgagcaattttgttacatgcatagattgtgcagtgatcaagtcaggacttttagggtatccatcatactttgagttcattgattttcccactaaagcacgaagtccagctatcaatctttctaaacataacccaagtcaatctcctattgtgtgtagacacttccagttactccccactacttacaagggagcagataccacttacctcccattcaaggccccctcctgccactgttgttggcttttttgctgtcctatttccaattgctcctttcatataccacttgcttcagacaaccccgtgtactcataagccctgagcatccccatctccacacctttgctggacctgacatggttgctcacttttggccacctctgaatcctgatcattcttcaagactcaactcaggtcccaccctacccaaagctgggcctgaagacaccatttgggccacactggtcccatcatatgcatgactcattgcattcctgtcactcatgtgccactgatgcttgtttgcattgcactcctcagtggcactctcacaagctactggagcctgtcttcttctctgatctcccccagcccccttcagctttcacagagcctggcacagagtaggtgctctgtaagcattttcatatattgattgattgattatattttatccccaactccctacattctttatcttactatctccttcatgcattgccatttaaaattatgtgtcactcctatataataaaaaatatacaaaggaagaaaagaaaaattacaaaagaaaggtcaaaagcatttctttcctcccttttctggtttatttgaggtcaatctggagtgattcatgtgaaccagcatattgccttggctacctccatcctgtgaaatgcttgtttgaagtagcgactggaccatattttgtccttttgatgctccactgagtagttcagccctatttacccatggtttgcaccagtggttctcagtctttgatgggcttcagaatcaccagtgggtagcttcttaagcatacagatgcctgggcctcaccccaccctcctaaatctgaaactctatagacaggacctgggcaggtacaagtgaagaaggcaagtgcagtgactctttcatgccccaaaggctgagaaccaccagcctacccatggtttacctccagtgctgctggcatgggaagagtctttgaatcccccttaaagactcttcccatgccagcagagctaaaagaacttctagaagttaacaactccatttctttttacagggaagaattcgtttcagttcagacagtaggctatttatcttatttgtccttaaagaatttcacatctcagaacttagatacttctttcttgaaagaaaagacacgtttccaaagcaggttgtcatttagcgaactggaagagaaatgtccctgactgtgggagctgacccctcagaacacaagcagtgttagatttaagacaccctgggtagagagagtcctttacagaactacatcttaggaaactcatgcttaaccactttgcatctttactatctctagttcctccagtcttgacaacagatacaactcaggatgtgttctgggtaatagttttttaatagataccagagagtgagagcctacgacattttccccataatcctggtagataatacgtgtgcatgtgtgagtatatttgatgagagcacctatggctatgcatagctggaagattgttgaggaaggggtagtaaaatctgcaaagagaaccagggatcctcttgaaaataaagaggatcctttaccctggcctggctaccaggagccttggggaagcagttatgtaggagctttcttggatgagggagcaactgacaggaggaatcaacttcccctgagtttgaagaacccagtgggtcagggatctgcagttaccctgtagtcagtccaaccacattactccagacatgggctctagtgggctccagcttatggagcagcagtccagtcagaggcagtcagatccagtggtggttgcactgtacttcagttgccattggtctgcagcaatgagactcactgcttgtgttctcaggggtcagctccaacaatcgggaacatttctcttccagttccctgaatgacgacctgctttggaaacttacattttctttcaagaagtatcttggttctgagatgtgagattcagctggtaggactgagcctctgacttcttgtacacatcaagggagggaagcccaagggctttacttttacttattgggctacatggagcctacagagaaagacttactaataggccagatccatactcagcttgaaatgctgacaccaactccatgaaagatgtgctgctgctattagcactgcactggttaaaacaaaaaaaaaatctgtggtccagagaggtcaagcagcccatcctggccaacacactggtgaacccgagcctgacaccaaagtttcactcttccaccacatctcttgccaccactaacatggggccagcagctgacaactcaaagggaaccaagaatgagaagtttttgacctaactgactgtctaaattgacagacgctttgtcttgcatggagggggccaataaatgcccaaagagacaacacaagtcatcagggatgcaggagctctcaacactggcagtggacgtcagcttctgcagacccagtcctcattcccaccaccctgccatggcacttcaaatatgcatcatacaactcttgacgctagctctccagggatgtgttaccaggagaagaagcactcactgccatagcagggcaggcaaatttgtgtattgcgttattgactacagatcaaaacctgaagatagtgggaaagaaaaacacagtagcttaatatgatgaagggaactttaaaaacctagtgagctcatgcttaggcaagcggcccaaggtgaccaggcagtcacagtagctcagggacatagaggcgacaccacaagatctgatcctatctgttctggaagtcagatgaccacaccacgagtcaccacaacttgtattgcaccctgcaccactcagaaacttttgggccactcaataaatgaaagactagtcgtttccatcagacaattagcagaactctgttttacttcccccatgctgaattgatgattctttgactagaccaaccctatacacgattgttctggagtcctgtggatagggcttaatagttcgtcagcatctgttaactgggcagtgattggatgcaagctttctatcaacaacacttctgaccgtgatgccctgaggctgttagaagttctggacatttaatcagcattagcaaggccacctatgtcagcggtggcagaagctgcctgctattggacctgcctctgattatgactcagtggctctccaccagggctgcacgctggagccacctgagagtggatatgaaaatattgtttcagggtcccacccacagacacactgatgtaatcggcttggggagcaaactgccatcagaagttttaaaatctctctcaatggattgaataggtagtgaaggctgagaaccactggtttctgttgaaacctcagttcctggctgaagagacacttgcggcgagcttgtctgtatcattagtcacttctggggtccaggggtgagactgggagtggaggaagcaatgcaaatgggtggaatgccttgatctaacctacacagcacatcctgtgtttgtcttttcaaattgctttctgttttgcttttacttccttgctctatttctttcaataaaccacactcactgccattacctctagcctgttgtcctcctcttaggatcaaagtccaagctacatattatctcatttactctcaaaatatccctgcaagtgaggaaggagccaggcctttgttccccaaggcaaatcagggacgtgcaggtccagaaaggttcagtctgccatgggactcataatattcaagtcagtgtgtttacagcaattttcaatttacaaagtgttttcacctatgttctcccatggaatcctcacagcaaatctacaatgacagtattttcataaccagaatgaccacacatccttatttgctcccaaactatcctgggttatacctgtggttccagcctaattattgatatcattccctttcactctcaaaagtgtctagatttggacaataaattatatggtctccttatttataaccatgctcttgttttaagagggccagtgaggctcctgaaagttaaataatttgttcaggatcatttagctaattagaggcagaggcaagacttgaactcaggtactgcatctccaaatccctgcgccatccacaggtattatgggacattagaatcagagttgacatgatctaacatttcttattgtagaaactaaaaatgtggggaaataatctcttaaaagtcactgtcagaatgttccccgaaagggaaagactcggagtacatagcagaaatgggttagtctccttggaagcattctatgaacacattagaatggattaataacataaataaatgtcaccatgatggcacttgaaagcctaacttggcaaaataaggtatcaggcctgacatataggtatttggaaaagagcaagaaattcaaagtctaaactgctagatttgaggactggatctgaatgctatctgccatctacctttgggcattttacctactttctgtgagcacatgtattgttcaacagaacaggaggaattatcattcttagttccctgggctgttacaagaagagcaaactgcagctcatcaagtgctctgacagcgagtctcataaggtacctgtgaatccagtttatttgttttctttatctttcacataagtgaatcaagccttataaagttgctgatgatcaaatgagataaggtatttgaacatacttattatgtcctaatatgctgcaatctttccttcttcttatcattatcattatcagcagtagtagtaacagataatgactatcaattgacgtgggagacaattacaattacatgtcattgtgaaactcattaggtgactgtgatttagagtggtacacccagtggaaacaagaggttgggaggtccttccaagggggtgttgaaaatgaccaagtcatgactataactgggtgggacccatccttcttggaagtcttcatagaaaccaacccaccctgccctgcagaaagagcttcagttacctgacaccatcaacaagaaggcctttctttttatggggaatcatgtacctcagagaaactccaaactttggaaaagtgtgattctgtcaacaaggatattgcttccctcaaatgacacagttcaagtaaggcctgggcagcatctttatttcacaatatttctagcctttacttgtcccatttacttgtaaatgagaactgctaacctgaagctcaaaaagatggggttgagggaggagtcaaaacaactttcatacctgatgttttgatctccccatcaatctggtttttgagctagccatgaaggcctgcctggctctcattgatttcctttagggaaaaaacaaatgacaacacagtcattttagaattatttggggaacgctgcaaattgtgcagtaaggtttttatataaatggagagactctccaacactgccaacaagaaaattccaaaggtgcaggtagaatcggtctccacacctaggagtggggcaaagggctcctttggttctaaagaacctatttgtgtttcaaatatctttcagaaacttgacaccttgaaactaccactctcaaggaatctgagtaagtcctagaatcgctttcttcaaggagagcagcaagactcatcgctttgttaaagctctccctattcacccctagggcccaggcctggatgctggggttcagaacacccccttgctgccctaaggtccaacactacccagcatcagacgagaaatgacctcctttattacctgggtctgccaaaggacctggaaatccagcctggggtgggggtggggggagtcccagaaaccaaaggagcacacaggggccacagtgggaagagaacaggctgaagaaagcaagtgtcactaaatgtcaggtgtaagcttgaaaaataaacacaaagaatgtaaaacccagcagaagaaatttaacaaacctttgtggtaggctgggacaacggagacagatcacgtaccaagtgtaaagtaagtcacattttaagagtcagaaagtaccaaagaccacagattgttatcaaggtttatgtagatctcatactttttgcaaacatctatttaattagcttgtagagaaggatcttttgggcaaaataacattttcccaattccagggaatatttatgccttttaaattctgccaggaggcccctgacaggcaccagtgactcttcccttctcagcgatctgcatatttctagggaaactttgcactgagagagttttccccctttgtgaaaggtcttggcgcccaggcagtccccgacttcccctcccccaagtcctggcgactgtttctgctcagccctggaggctactctcccgcagcctcaggtttccctacttctgcagcgtcggcaccaagggctgatcaaatgtttctttctccttacaccggcggaccgggaaacgccgccgcagcctcgcctccatccttcctcctacaggttgcaaataaagtacagcagctctgacattaggcagtttctgtccaaggagcaaggtgacttcatttaatttgcactgtgctccttcatccctgtctgcatcaggttgaacgggaggctctccctactaccaaacgcctaacatttccttgatactgccttgaaaaatcatgattatgacaaaaataataacgtcggagaatggagtgcttgttttctgctttgcaagtcaccaagcaagaaaacacttttgtctccttggcttttattttaggatctctgagcgaaagagagaaagagaattttaagaaatgtcattttcgctttgccaaagatcattgtgtcaataacgtttctctcccattcctccccctcctcccgttttaaaggaaaggttcacgggtccagccaggtttctgccgcatcccgacacctggagacgtctttcaggaccagcctgaatcgcgtccgggctgggctctggactcggactcgcagcggtgacagcggaggcggggacgggggtggacaaactgcggatcaactctccgagaagacggccacctgccggaacctgccttcctccattccgcccaggagcctcgcagcggggcgctggcctgcggaaaggccacgggggagcacagggctccgcgccgccctcctgggagggtccggagtccagcgcaccccgagccctggtgggtgagcccggcgggaggcgcggcaggtgcggcgggagactggaccccgacctaccttcacaaagagctcgatctcggggtccctgtcgtccccgttagctgtcgccgagtctgtcatgccgttggcgcccggggctaccgtcccgggccggggaggcgccacctctgcagcacctgggccagcactctgcgctcctgccgctgcccagcggggctcctcttcagggcggtgtttaatttttcacaaaaccatctattctccagcccgagcagcggggtctgagagatcagtgtcccagatgctcacatgaaaaggagcgaagccgggaggaggcggggggccacggggaaagccgggttaagggaatgacaacaggtcgtgggagcaacaagtgccgggctgcccggaggtgtcacaggatccgcgactgtcagcgatcccgccgccgccaacgcgcccaaaatagccggcggctgcagggcggggtcagccgggcggggacgcggcggggacaccccggcagctcgggcctgggccgggccacggccccccgccccaagaccccgcagggcaggaggcggagacagagctggtcctggcaaagccaccaaggccaagaggatgtcctgggggcggataatgaggcgaaggcagaaagagtcgaggagaaggggaaggggaagaggaaggggaaaggggaaggggaagaggaaggggaaaggggaaggggaagaggaaggggaaaggggaaggggaagaggaaggggaaaggggaaggggaagaggaaggggaaaggggaaggggaaggaagagaggagatggctctcaagtcttctgtttctttaataaagcgtcagctcctccgagttactccactaccagccttacccacttggaaagcccttcctgtcttagtgatgctcagaacccccaccaaaaggggcatttgccatccttgggctaagcaaaaggagagtagggtgctggggacgggcagggcagggcaggggtggctcctggggcagaggggtgagtcaacccggtcaggtgcggcttccatgcctttcagccttctgggtttgtttatttttcttctcccttctttcattttctttctatttcttcctttattttctgatcttacttcattcccgttctcttctggttgttttagtgaagtaggatgcaaacacagaaaagatgcacatatcttaggtgtatgcctcaatgaattttcacaatccaacccacccatgtaacgagcgccagatgaagaataaaatgttagccacagccctagaagctcctcctgctctctcctctccacatcttttctcccgtctccactgtcccagggtaaccattattctggcttgtagcagcataggatctttttgcctggaatgttggtgtctggcttctttcgctcattactatgtttgtgagattcatccattgtgctatgtgtagttgtgtatcatccattttcaccgacacacttacttattcattcttctgtcaatggacatttgtgcaggtgactatcatgactactctgtcacgaacattctctctatcaaacatcttttggttggattcacagacacttttctcttggatgtatacttaggagtggacttgctgagttgtagtgtataagaatgctctccttgtgtaaacactgccataggttttctaaagtggttgcaccaacagacattcccacccttcagttctttaaaaaataattattgaatgttttgcaccagaatctggtggaattctctttgtcttctttgccttctctttaattaatcctgtttgtgctatgtccttccttactaaaaacatgtatttgtttaatagctttattaaaaaatttatcgcttaataaaaaaataagtaataatacttattatgtgctaggcaaaaatgttgagcactttacatgtgtgaacttgtataatatttacaaatagtataatgatcccaattttacaagtggggaaactgagacatgaagtatttaagtaacttatccctagtcattcagctaggaaatggtgaagtcaggatttaaacccagacagacttgagcctgtcctctcaactgctctacaaactgcttttcttagtgcacactatggaagtgcacactttgaggaaacaaaggcatggttttaacggtcttaacagagatcaaaatccctttcagaataatagttacatgaaatgaaaactaaggctgccacatgaattgggaagatgaaggagctatacaagctgtcacgtaaagatactatttaccatggttggggtgaggagaggaaaaggcttcatggagcaaaaggcactttagctgaaccttcctgaaaggtcaggcatctgataggcaaagaaaagggaaagatgtcctcactaccctttatggcaggctgtgtccccacagactctcagtgcaaattcctccttcctgaagaaagcagtcaccaagcccaacgtgcaactctcttggtacattataacttaatcaaggtgatgtttaattgctttcctcctgcttggcttcaggcttacatcaccaaagcctttagagaaacagtcaccttcacagctgtacattctgcaccaatgactacatactttagggaaggaccaaggttacagagggagactggtgccttcgctgcatgatgcacagactcagaacatccctgcactgaagtgtaggcaatattcttaatggcaatgtggcagtagcaaataaaattatatgcataaaatgtcttcgagggttttggttttttgttttttgttttaatgaaaaatgtgttacacgtattttcgatcatttccttggctatgatctaaacaatgtgtggtatgacttctctttccttaatcccaaacctatcagagttaactttcattttatcttctccaaatatctactgctattgtaaatttggacagatctctttcaataacattttataggaaatatctcccatttggacatccctgcagataacttatagttttgatattataaagcttcatgctgcaaaaaaaataattcttctttggtcataaactatttctgtgcatattttccattttcaatttcatattatgccttagctcaagataaaaggactttactttgtaccctttaatgttaaagaataattggttagagtcaattctagctttgtctggagaaaaacactatatgtctaattccagcccatagtttcacaaatgtggtgcaagttttgaataaatttttaccaggaaagtactttaaaaacacatttagtgctcactttggcagcacatattctaaaatggaaaccatacagagaagattggcatggctccaatgaaagggtgacatgcaaatctgtgtgacattcatatttttgtatgactgttgaaagtgaaaactataacatatctgatagcatttttaatatatttagattcaataatatgaccactgcagcataaagggtaaagggcaaggaatttatacagttgtaaggtttatatactttacttgatatagtaaactctaagtagcctgagaaaaactaggtatgtgtattgtaatccctaaagaaacagctatttgagttataaaacaaaagtatagtaaaaaaaaaaaagccaacagataagctaaaatggaatgacaagaaatattcaaataatctaaaaggcagaaaagaggaagagaatagaaaactgataataaaatggtacacctaaatataaccatattaatacttaagctaaatataaatggtctaagcacataaattaaaagctgaagattgttggattgcataaaaaagcaacaagaagacccaactatatgctgttacagaattcacttcaaacacaatgttattgataaattaaaagtaagaggatggaaaagcccctgccatgcaaacactaatcaaaagaaagctgggccgggcgcggtggctcacgcctgtaatcccagcactttgggaggccgaggcggatggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaagaaagctaacctctaaattaatataattattaataatatataaacatatattaatgtaagtctattagacaaaatagacttcagaaaaaggaaattatcaggaatagagacattacataataataataataataacagagccagctcaccaagaagatagaacaaccttaaatgcatatatacttaataacagagcttcaatattgatgaaacaatagctgatggaactgaaaggagaaagagaaatacagaattatagttagagacttcagttctcctcttttggtaatttatagcacaagtagacaaaaaatccataagaatatagaatatagaagacctaaacaacactatcaataaccttgaccttatgaacatttgtggaatatcccacccaaacaacaacataatatacactattgtcagatatatatggaacatttaccaaaagagatcacattctgggtcacagaacaaacttcattacgttaaaataatgaaattatacaaagtatgttctctgaccataatggaatcaattaaattaatatccagaaagatatccaaaacacttccagttatttggaaattaagcaacacactttaagaaattcattgatcaacaaggaagcctcaaggattattaaaaaatattttgaactgaattcaaatgaacatacaacatatcaaaatttgtgagatgcagctaaagcaacgcttagtagaaatttatacataaaacacttattttggaaaataataaagttctgaaatttataatctaggcttccattttatggaactagaaaaaagaacagccagctaaaaccaaagcaagcaaaaataataaaataataaatataaaaacagaaattaatgaaatcgaagaaaaaataaaacaatagagaaaatcaataatactagaggctggtttttatcaaagatcaataaagttgataaatttctcactagatttaccaaaaaactagagagagaagatatattatcaatgttagatacaaaagatgggatatcaactatgaacttcacagatacaaaaagataagggagtactacaaacaactctctgaacataaattagaccatttagataaaatggataaaagacacagactaacaaaattcactcaatgagaagtagataacctgaatagtcctatatttattaaacatattaaattcatagttgaaagccctccaagaaaagaaaactacagccccatataccttcattaatgaattctactaaacattttagaaagaataacaccaattccatgcaatctcttccagtaatgagaagaggaggaagtgaaggacttgtatccaggatttgtaaagaatttttacaactcaaaaaaaaaaaaaaaaaaaaacccagctaaaaaaataggcaaaatatctgagcagacactttaacctagaagacttaccaatggcaaacacatgaaaatatgctcaacgttcttcagtagagcaatgcaaataaagagataccacaatatacctattagaatggttacaatgtgcattcatgataatcccatgtgtgagcaagaatacagagcaactggaactctcatacattgatggtaggaatgcaaaattgtacagtcattctggacagcagtttggcattttcatataaagtcaaatgtacacttactatatggcccacttaccatcttctgggtattatccaagagaaatgaaaacttatgtttacataaaaccttggtacataaatttttttttacaaaagtattattcataattgccccaaactggaaacatccccaaatgttcctcaatgggtaaatgaattaaaaaaagtgataacatttatgcaacggtatatcacttagcgataaaaagaatgagctattaattggtgcacaacacaggtaaatctcaaatgccccatattaagtgaaaaagaaaagcagtctcaaaaggttacttactgtatggtttcatttacatgacattctggaaaataaaaaaattatagggatggagagaagatcagtggctgccagggactgggatagatgagggcttgattacaaaggggcagctttcagctgatagaactactttgcatcctgtttgtgtcattggttacacacatttctgtatgtgttaaaatatacagaactacacaccaaaaaggtgaattttctgtatgcaaatttaaaaaatgatcaaaatgcttaaataatttccaaaaaggtaaagccatcaggttctattgccatacccactttccacacagtctttgcttcaaatctgtaacatcagacctcatcttaccattaatttcagaaatgtaaaagagatttctattttatgagatgcagtgcttctaattaggctgatcaacaaaataaaacaaactttcattgaaataacaaaacaaaataaacatatttagacagtgtgtttgtgtgtgtgtgttatgaaatgacatgtactgtaaaataatgatgatgcttatggggagatttttcagaaaatgcttgccctacccactaccggagtgcaatcacattattagtcacaagttccagcttttatgtacctagcagtactcagttgagcccactcactatacccagagtagcagctatttccatgggaattaaacaacttacattctctgcaggagatctcccagacaatctcaaggacttgaggtttaagctggaagattttgatgacagcttcagaaagacattatgcccttgtgggaggaccaactgggtgtagacgaagggaggtgaatcctagagggatcacacctgcatgaggtcacagattgggctatgagggggattgaggtgagttgttagttctatttctttataacctaaggtgtccttgggcatggccaacatgatcaatgatcttggctctcactgcagtctgtctattggtgcttagcaaaggcagaggcctgggagtgagctggactgaagtcaagagtccttgtcaaaaaccatcactcatcccactgattcactcattactcattccttcaaccagtgttttcggggtgtctactatgtgccagacaccgctcatactcattttagaagcccctgagaacatacagtgtgcataccaccttctgatgatgagcagtcttagttcctgtattattccttccgggattgagttatggcttttcaactggagtggaagcttcttatggacaggaatccaattttgtgtttcttttgcaagacccacaggatataatggtcccttgctacatacttacaaacaggctaatatgtcctgtatagtgcacatgctcaataaataattgttgatggaatcaatgaatgaatgaataaccagcacttctatttgaagtctcctccatctgggattttgaccttccaccagtgaaatggacattacagtgtggagtttttataaagattctaatttgaactgaaacatatgaaagagttacatcataataataatagttaacatttgcttagagctcaccatgtgttgggaactctgaagtccttattagctcacttcatttctataataaccctatgaggtagtgttattaatcccatttcacaaataaagaagcaaaaacttaaaaagggtaagtaacttatccaaggtcatgtggatagttataaacaacagagctggaactccctccattgctaaagcccaggatgtggttggaggaggttgggatgctactagaaatttagaaattgcttactgaattggtgggataagtaaatgactagtcttggataagaaatggctagggttggggattctggagttctcctttactctgcttaaactaagacacacccagagatgaaatgaaaaaggaaacatagggtccaagagatggcacacaaaaattaaaaaatactcagccctaggaaatggaagttatgggagccaacgggcagaagaaaagtgatctgaggtcatcttctgttgcatcaccgtgcatttttggcaggatttactgctctggtgattgtcctcacttaatggtcaagctcctactttagctttggcaagatcaccttaaaaatacaactattatacaaatactttttaaaaaccttggacggagtccaagataaatacatataacaaaattcaaaaaaaaaaaaaatccacccacaactgtcacctagtattactctgacctacacatctgattttcttttggtgaacagtccatcttgctaattgaccagtaatgatctttaataactcaaaaaagggaatagcattaaagagagcaagggttggggggaaagcaaggttagggacatcgggaataggaagccagcagttacatttgtgagagtagaatgtagaatattttgagggaattgggcaaacacccacgatcacacaaattaaagttctgaaaatacaaataaacagttgtcataatcttagacaactagattccatttgccttgagttacccagtttccttggggatctaccttcctccattcacagtaccttaggttgaagtaaagccttaaggatggtcaggtgactcatgttggccagtcagaacactgcaatctctagtcacagtgattggttcaaaatgggcacatgatcaactgggatccaatgagattcaattctaggactttttctcagaaatttagaagaccatttttacttctgctggacttataaagagactagggtatgttcctagagctctttgaactatcccaccaccactaagacagaacctgactgagagtaaagccaacagagagaaaacaagagccaagatacatagagaggaagcccaagttctgacttggatgtctcagtgcctgaaacttgataccactagattttcctgtcctaatggttagtaaaattcttttttggctcagacaatcttgaattgagttttctaatgtttgcaactggacatttatttatactcacattagttagaatctgtatagagggctgtaggcaagaggtggtctatatgatagaaaaaagacctcatggctattagaaggtggacatgaggcatcaacacagtgatacactttaagagtgacgccaatcttgaggtgaataaaaagtattaaagttctaaatcctcataaaaacacaacagtctcctaagctaagatacaaaagtaaaaatatgttcaggaattgacagaattccagagaaaggctatgtgtgtagatttaaggtgatcatacatggtacagaataaaagttaaaaaataataaataatgtctccattaattgatttttttttcaaaagagaatgtcttatagtataataaaaagagcactagactgagatccagaaattctgaattcaggaatttctagtcctctaatctggtggttcaacctctcggagcctcagttcctttacctgtaagacaaagataactatactttccctgaaatttgtgtagtttgattaatattatttataaatatgtataatgcacccaacacagtgactgacccataaacaaagaacaaaagagttatttttccccaaatgtgtataagggaggcactgagcaaagaatttcagaggcaacatctcacttaatccctcactgcaaacttcagtatgcgggagctactattgttacctcattttgcagatgaagaagctgatatatacaaattagtgagtgagctagaaagcgctagagctggggatttgaatcccaggttgttagagtcccaagtatctgcttataatgacctcaataaataagcactagctagtatgactttattactaatgtgtttaagtgaatagtaaaccaaagaaataaaaatagtaaaggcccagcctggaaatgaaggctgaagatcagctgctgaatcattcaaaaaaggaaatgctcccaggtaaagaatggaatgctggatggcctttaacatggtttggctctgtgtccccacccaaatctcatgtcgaattgtaatcaccacgtgtcaggggagagacctggtgggaggtgactggatcatgaggacgaatttcccccttgctgttctcatgatagtgagttcccatgagatctgatggtttaaaagtc

SEQ ID NO: 335 - DNA, 24187 bp, Homo sapiens
agggagctgaaagcagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggaggtatggactgagattgggggaagcctatggtggaggctctgagggacttgggtggatggcctaggatgactggagaccatcttgggaaaggaagagaggaagggggtgtgagtgttgtgataatgaaagcaagaagaaaaatatcagtactgtggccatcaatgcagaggcatggcagaattggggggtggggtggttacccaggttgactggggaggggcaaagaggaaaagtcatttaatgactctttgtcatggatccaatccccagttggaaagaggaaggcagccaacacctctacccctaaatcttgctgttttgactgatgaagaggttgaacccatcctgtgctggaacccaccctcttttgctcccttcattgtctctccagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgtgagtggtaaggaggcagaagcatcactgggttcagtctctgcccaaagtgtgagaatccacccaccaagagctggcctcttagctggtatatctactatgcttggcccacggaattcagtggctgtattaattgccctctggagaaagatgtgcctaaccaatgcttggtagcttgaaacccaaggagagctgggcttcaataacaaatacaatggagtaaatagaagccgggacaggccagacgtggtggctcacgcctgtaatcccagcactttgggaggctgaggcggacagatcacgaggtcaggagatcgagaccatcctggctaacacagtgaaaccccgtctctactaaaaatataaaaaactagctgggcatggtggtgggcacctgtagtcccagctactcacgaggttgaggcaggagaatggcgtgaacccgggaggcagagcttgcagtgagccgagatggcgccactgcactccagcctgggcaacagagtgagactctgtctcaaaaaaaaaaaaaagaagctgggacactatggttggggtgatgctcattctttcctccttgccaccaccacctctgcaggaaagatgggctctgtgtgccccggaaatggatctaccacctgactgaagggagcacagatctcagaactgaaggttggttcttcccagccctcaccctcccttgagtttggttctgcatctctgttctcatacttctcccacctgccttgacaggccgccctgacatgaagactgagctcttttccagctcatgcccaggtggaatcatgctgaatgagacaggccagggttaccagcgctttctcctctacagtgagtagggatacaaggcaggaagggttggagggaaacaagggagggcaggagaactcctcactctgggtcctatgacaccctcccaggaagagctaggtgcttccaggggttttgactggcctgaccccaccttgcccttccagatcgctcaccacatcctcccgaaaagtgtgtggaggaattcaagtccctgacttcctgcctggactccaaagccttcttattgactcctaggaatcaaggtaaggggttaaaatctcataaaacaggattaggactcaccaagtcttctggtgttacagggtgaaagaggctcgtgtgatgtcaccagagggatgtggctaagagctgtgatgtcacctgagggaggcaggatgggttctgggctactcaaaagagaggtttctgagtttgcactggataaagggggcagagggtcatacgtggagggaaaagagccttagagactcccctttgacacagggaatgaaagaacacgttctcccccaccccattactatcaactttgcttttctccctggacttcccttctgtccttctttttccctccccccatcacagaggcctgtgagctgtccaataactgacctgtaacttcatctaagtccccagatgggtacaatgggagctgagttgttggagggagaagctggagacttccagctccagctcccactcaagataataaagataatttttcaatcctcatctcattctggggtttgtctccagacgtcattcccactcctcccatttcaacattccccctggatcctctaccacctaaactcccagctggacggtgtcagtaagaacagagtggcagtaactctcactttgtagtggtatatttaggatttgatgtgacacagttatttattgctgagtgagcaaacccctagcccccaagtggggactacaggcttcagtgcttcccccacactgcctgagctaccagcccttctgcactggccctcctgccaatactgcctgcactgtccccactccctctggctcccatgatcaccagatccgccctgcaggctccctgtcacctgtggggccctatccagaccccctaatccacttgcctagcagccccactcttccctcgatggctcagatcctgagatccaaggaacaccctgggtttcccaaccactctcttactgcagaggtctgtctatcctgccctggtctcctccaccccaggagagttttcaaaggtagagaggaccctttggtctttattcaccaccatcatacttttttttttttttgcttttaaaaagtggaggtggaaaaaaaaaaaaaactgaaggtgggagaaaagtaaaagcaaaaataacagctggtgaatccaagagcagtgccctcactgtccataaacacaaacaccctaaatagttctgttctctcctgtgtatgaaggggggccctgcaccctcgtactcgggtttcttccccatccctgaggtccctatgcttacaatttgggtcatgcctcacacttttctcctaaagcccacactctcttcaccctttgcccccaccccacggtcacagcccctttcccgggtctcccctctgctcctcaccttccctctccaacccctcactctcccagtcagtggccgcctcatccccattgggctcccggaggctgacagccagcaccaaggcctgcaggagaccaaagaggcaggcgaagtgcaaagggtgggcagtaagtaggctcagaacagcatggagcccatgcagggcagccaggaaggacagtaggccatgtagccagaggcccagcggtccacgcaggcccagtgtgtccaaggctgcccgcagtggtcgtgagcacagggccagcagggcagaggccagcagctccagaagatgcagggtcaggttggtggagatctgcagacactcttctgggccccccaagtaccgggagggagctcctggttccccccgcagccagcccaacagcttctcacgcctaccaggtttctccaatggggctcctggcccagggacgctcagtcccccttcaggggacacccctggtctcctggtgccacctgaatccacatgatcccatctgagtttgggactggcccctccagcctccagtctcccagactcttgagtgctagagataggctggtcccacttgagggaatccattcttttgctccctagctgctcaacttggggctcctccttgcttggttcggaagcagccccagaaaccctcaatgcccccgagtccttagtcttgggatgccccacatcttccatggtttctggggcactatcccagtcacttcctgaattctccgaggagctgtccacccgtctgggttctgggtaaggcgggtcaggcctcattggtttccggcggccccaagggcgaggtagccagccaccaagccgtcgcaggaacatggctggggtgtgtaatgggcccccaaattctgaggctgcttcctggcactactcagactctcaggatctcctcagaagccagagtctttctggctcagaacaggtatttgcctggtgatgcagtcctactctgaattcagaagtggctcctcccttctctgaatagtcatgcagcctcaagtgtggcaagtagtttgcttcctcttcagttctggggtaaaggggggcatacccaaattcattcaccatccacacccccacaatctgagattccaagaatctcagatctgacaaggcctgggtcaccaccagagagtcctctctgcgtttccggatttccttcccagcaggcagcaccccaagtttcactcaccaaggccacaccccaaggtgtcccagaaactggggaggcagtgctccatccaataaagcgggcaggaaggtggccccaggtcctaggtgctcctggatcgtgtagtctttaactgctgccccaagggacctcaaggaataggaattctctttgttaggaggtggaatgaaagtgtccagcaaactccagccagcagcgttcgtcccttgatttagagggctatgatttctacaaagtggcccgactggcccgcgaacacgcagcagagacgcggcctccacaaggtcagaactaagatgtcctcagagatccccagttacgaagcaaagcgcgggcctacttcgggacctacgcgtccgggcgctgtgcgcggggaccgctcccgggcccagcgtcggggccgcggccttggggagccgccgggagccgcgaagcccggaagcagctgcaccaggactggaaggacccgcgggggcggtgccgcagctcatggggcggaccctgcgaatagaccgcccccgtataccccgcgctgtctgtgcgcgccggaccgccaaaccgagattagcaaggaccaggaccttaatataaacccagctccccattttcccgggtttctcatgcttccctaaactcggtcgccccctacagccccctgcccctgggttcttttccacatcccccaccactcctccatttcgcatccaagacttcatgaaaggctttcccagaaaagaaaaaatgaggagtcttgcgacttgaacagccctcccctgcccgtctgcaaatttgaattcctggatttcacaacagtgagctcttcttgtgcctaccacccggcatgagcaagacaagggggtgggtggtgggagagtggggaagtgtgggaaagaaaagtgtagacaaatgggtggaacaaagaagtttaaagtttagatttgggggctagagttctggtcccagttcaactaagtgtacaagcttgataatcgtgggccttcctatcacactggcctcttccagcaaaaccctacccattctcatctctagaggccttgacttcccttatcaccctgcattataatatttgataacatgggccgggagtggtggctcatgcctgcaaccccagcactttgggaagccgaggccggcggatcacctgaggtcgggagttcaagaccagcttggccaacatggagaaaccccgtctctactaaaaatacaaaattagctgggcgtggtggggcatgcctgtaatcccagctactggggaggctgaggcaggagaatcccttgaactcggggggcagaggttgtggtgagccgagatcatgccattgcactccagcctgggcaatgagagcgaaactgcatctcaaaaaaaaaagaaaaaaattgataacatggcactttccctctccagctgtgaactctttgagggttgggaatgtctttacctgtattcttggcacatagtatatggacttatgtttgtgaaatcagtgaattggctgtagtcagggaactcctcctgggggaagtgagacttgcacgaagctgggcaattcttggtccaggggggttgaaagaataggtgggggactcccaggagggtctgggacctgaaagtgaacccagattggcagggaggtgaccttatcatgccacctggagaggctgccccttctgactcaggtgggacttgcatgtggctcccaggcttctgtttggcttcctcaaaatagcttccagaaaagtgaataaaccacaaatggttgatttatttctgactctcagcccgtctctcacgaagacagagcctattgaccaaaaacttcaggatctgcatctgagcagatcccaggaaggggaagtcaaagggcccaggtcagaggcccaagttcagacttcagcagcagactagggtcagactttaccaaagtcagaactcgaggttcatgtaagtccttagatcccgctcccaagccctgtctttctcctccctccttctctcctccctccagctcagtgtggccacccgagggggtctctccctcccagccacagctcgggtatcccaagctgggaaatgtgtcactcggggctggggtgctgatctgtagcctagtccttcctggtccctcttgaggacagtggggatgggattggcacggccctcaccccggggtcccagccccattcctggctcccagccccccctcagcagcagtttgaagcccgggctggagatgggcaccccaagtggaaggttgggaggctgaggaccctgcgacagtgacagcaggtgagcagtggatgtgcggtggttggaatcttggaagtgggtgtcacagttctcgcagtactggagggagggagtaggagacctgcagagaaagaagaaaaagcattaagggcaggggaaggaaaaggggaagagttgaggcctcagagggggctggcagggtagaataggatcttttcagcttttctgctaaggaacaaattgccagctaggcatagtggctcacgcctgtaatcccaacactttgggaggcagaggcgggcagatggctttgagctcaggagtttgagaccagcctgggcaaaatggcaacgcctgctttttttttttttttttttgagatggagtcttgctctgctgcccaggttggagtgcagtgccatgatcctggctcactgcaacttccaccttagcgattctcctgcctcagcctcccaagtagccgggattacaggcacatgccaccatgtcccggcaaagcctgctttctacaaaaaatatgcttgagcccaggaagcggaggttgcagtgagctgaaatcacaccattgcacaccagcctgggcgacagagtgagatgagtgagactttgtctcaaaaaaaaaaaaaaaaaaaaaagggacaaattgccttccttcctacttaacagtgagggatccaggctggtccaaaggtggtggtgagttatctgaattaattgttcactcagttacagatcaaactccttactccacttttcccctccttctcactactgcacttgacttgtcttaaaaacaaatttctttaaaccattgtgggatccagagcagaatagttgaaagaaaaaaatggtaaccagacctagcaaactcttgggcaaggggagggacattagtcataatgactatagctaacattcatgtattgcatactatgcggcatgcactattctagcattttacatatattaacccattgaatcctaacaacaattcttactacccccatttctaagatgagaaaactggaacatgtagacattaggttgtttgcccaagtaagtggaatcaggctttaaatccagggagctcatgtttataaccacttgactatactaccctgtcaacctacacatgaggataaggaaagaactcttcagcactgtgctggggcgtctggtgtggtgtggctgggagaggcagaacacaatgagacatgggtctgagctaaagtttccccttaccggttttccgggctccttgtctctccatggctctccctgaccatgcgggctacctcagggaagccagcttcttcagcgagctgagccgcatccctgccactcagctcacagacccccacccaggcagccccacggcccaggagatagctcacagctgccccctggcccgctcgagcagcacacatcagtggggtccaccagaaggcatcccgggcgttgatattccccccagctcctcctgcctcatgcggttccagcagtctcctaagttctggcaggtccccctcctgggctgccctcagtatccggtgagtcatcttatcctcagcctcaagggatctcccttgtccatgtcttcctgatgctccttctgccactgcttctgctgctggtgccttcattattcttcttttctttctctttctttctctggcaggttcagtctgagatctctgggagtcaggagcgctgctctcatccccaatcagggcctcatagaaagctcgggctgcagccccatccagggtggactctggcttctcgggctgtggctgctgctgcccatccttccagaggtcgctggggtcagtggctggggtgaaggtgatgagcaagggccgggacatggcttttgggagaactgagaaaatgataccaggcaagggaaggatgagacaagtaagccaagctcgtggtgaccctgtagcaaccacagcctcagagacctgctgggatgagaaaaagtagtcaaaaacactttcctgccactaaagtaaccccacaacttaggactctgcagggcctaagggagagagactttgcgtaaaaacatggaaccctacaataccgactttgctccttagtaaagattaataaaactccatgagactgttgtccagaggtcctgcgtccggcccccacccccatcctcaccaacaataaacaccagcctctttctgaaaccactttcccaccccgtaagacataccagtaggaaaaaaaaatcagcctggccctttaagtcttccgcgatcccatttcggagtttcctcttcccaaacaaaaatagatgggtcactccctagaagatctcggggagagtctcctatacgtgttgctgtgtagcttccgtaccgcaaaatggcgccattctaatcagaagagttgacacaatcaaatagccacacggcacgaagacgcatgcgtggcgacaacaacaacaaaaaccacaacccacattacttgagggctcgggcgtgcgcaaagctccgggttcagtttcccgcgctggaactttttcaatagtaaacgagcaaagctccgcgcgcccaggtggcgcgagcactaggatctgtcggttggggtcctacttttacataacgcccccacaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcaggttagcgcactgggacgttccagttctcacaccgcccaccccaccccacccaagtccctacgcacggagccaagccgcacctctcccctcatgaggcaggagcccggaggaaacagtatgcccgtcaagggtctctggcgggactgattcgcactaggggcccaacaggcaataaggacccagcggattggccgaggataggccagtcccctgggcagcagcgccgcgccgggactagaggggaacgtgaggagagctgcggaaagagatccagcctggctccctcctttccccgccctaagtcagcctcttcacccagtgagcacaaaactgtattgcccagactcccgggccccgaacgccatacctggcttccgcttccggtggcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccggtgagtctgaagtcgtcgctgctccgagtcccttgtcgctgggagcggcacatggggtctccggactttgatgtgggggcgggggaggaagcgaccaggtccggcacgaaggagggagaggtggcctgaggagcggaggggggatgtgtggattccggtgaaagggacctgacaatcgcccccaacccgtgagaaaaggaggagcccagttcttgcttgagaatgataaacttggaaacccttgggaaaggcgtgggggtcatgcagagacttgtattggtagggagcctgagtcgaggtccctgccggagttgacacagaggagagagggccctggccttcgggagctccagggatgtgggtcgggctggtgggtcaaagtatctgttggcttctttcaagtggtgggaccccaaagaatgtttaacttcaaagaaaaggggctgagatgtaaattagaggagctggagaggagtgcttcagagtttgggttgctttaagaaagggtggttccgaattctcccgtggttggagggccgaatgtgggaggagggaggataccagaggcagggaaggagaacttgagctttactgacactgttctttttctagctgacgtgaagatgagcagctcagaggaggtgtcctggatttcctggttctgtgggctccgtggcaatgaattcttctgtgaagtgagttctcttcaacctccctacttgccagcttcacatatcttcccaccagacgttccttcacatattccacttctgcactgttctcttacatgctatttgaaaacttcctatcagcaaagagtcccccctataaaccccgacgaacctgtgctaaagtggcaaaactggggcccaagtcctgagtctgccaccgtccagcaatataacgttgggctagtcaatttgtgtctttttcttttttttgagactgggtctcactctgtcaccgaggctggagggtagtggtgcgatctcggcttactgccacctctgcctcccaggttcaagcgattctcctgctccagcctcccaagtagctgggattacaagtgcctgccaccatgcctggctaatttttgtatttttagtagagacagggtttcactatgttggccaggctggtctcgaactccagacctcaggtgatctgcctgcctcggcctcccaaagtgctgggattacaggcgtgagccattgcgcccggcctgtatcttttgttactaaagtggcactgctagtacttgtctcaggtggcctttaggaaaactgaaatgctacacattgaaatgttttgttcagaaaccatgctgttcagcttccaccttccttagccagctgagaggacaaaactggttcctagagacgggatacaggagtggagtagggacaaagatcttgaaaagaatgtctaagaaaaagattgctgtatctacttatccttagaaaagaaaagccaaagcttttatgggagagagtgtaggtgaactagggagagacacaagtacttctgctgagttgggagtgagaaacaagcacaacagatgcagttgtgttgatgataaggcatcacttagagcattttgcccaggtcaaagatgaggattttgatatgggttccctcttggcttccatgtcctgacaggtggatgaagactacatccaggacaaatttaatcttactggactcaatgagcaggtccctcactatcgacaagctctagacatgatcttggacctggagcctggtgaggcaccctcagggttgttttgtgtgtgtgcgtgcactatttttctcttcaaatctctattcacttgcctgaattttgaaatttcctttggttctctgatttctttaaccccaaattcatgctttattttgatcctccacctgactcttgtctagttttgtgacgtatatcacttgttctcatgttttctaaatccgcaattcagacctattccaaaatgcgtttcctcatgggtctggtttgttgtctgtttctcctgctttgcaccttccagtctagaatttcatcttctgcattgacattgttgcagttatgtattgaggagggagttgggagggagagcaaggagcagaggctgaaaaggtgtgaagggaaggcagagctgtcttcgtttgatgcaagggtcagaagcccaggtttctgggtcccatgcccagatgttggatggggtaaggcccaaaagtaggtgctaggcaaactgaatagcccgcagcccctggatatgggcagggcacctaggaaagctgaaaaacaagtagttgcatttggccgggctgtgtttcagatgaagaactggaagacaaccccaaccagagtgacctgattgagcaggcagccgagatgctttatggattgatccacgcccgctacatccttaccaaccgtggcatcgcccagatggtgaggcctctctgctcctacctgcctccttctgagcagtaagagacacaggttcctgcagcaagaagtcatgtttaagccctgtttaaggaagctagctgagaagaggggaagaaccccagaacttgggcctgggaattgaattctgattgggggtcatcctgaagggattgttttcagggagggagacagaccttgaatcagagagttgtgatagactgcctcttcctcaaggaacaaacaacaaatggctctgatggtttgtagcctgcctaattggaagaaaggcaacacagaagtttgagagcccatctagtccagagaaggggcctctggacagaggtgggaggagtgggggacagagtggtatgggttgggctgcgaagggagttgcctcttctttacatctacctgccaaccccttccattgtattcacctcagttggaaaagtaccagcaaggagactttggttactgtcctcgtgtgtactgtgagaaccagccaatgcttcccattggtgagtgttgaagaagggaaaggaaagcaccgtgtggcagtcttatgggaaggagttggggctcaacacattggagcctgagtcctgaggggaggttaggtaggaatagggggatacctggcctgctgagtctggctgtctcccaggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggtagggagcagggagagtcattaagggtcaaaggaaaggcccaagatcccccagagaggggaggacagggcatggccctttcttgaggtctgcttctcccagaatcagggcatctccctgctgagtgactgtgggaaagttatttgattatctgtgcttgagttaccttattgtagaatgttcttgagctgagaagttgggaaccacgaggctttagctctgagcaggtccatagaggagctcaggtggggaggtgggaatgcaggtgactggcagggcctggatggggctcatgctgctgcctctctgacctctgccctggcctaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatgagctagtctgctggtgcttgctgttggggaagggaaggtgatggtgtgttggactccaggggccctcatggcccagcccaccctccccagattgaaaaccaggacagatttgtgctcagtggattgggtggtgtttttagtatggagcagaacagaattcctaggactgcgtgtgatgaaatgcaaggtcaaaaggaaaagacaaagcatatttcaaagatgagaaatatttgtttggatatctatgactgtctgtttatactgtaaggggcttaatcagcagctccatcttttagttttagttctaaaggaaaagtagcctaaagtcagtataactaaagggtggaacgaggtgggacaaggtccggaattgctgctcagtgatgtgtgtgtgcctgccgctggtggagctgagactgctcatctcagaaggatggggatgcttgatttcctggccaggttgtcccagcacagtggggattggccctgttgtatgacgaagacagcacatggtggcagagatagatactaacccatggactttccaagggagggaataggtctttggagggtatgcaagacaaaggtagacactggataaagaacccggtagtgcccaggtattaccccatctgggccattactcccacactcaggaaccagacgttgtgggtgaggacatgctgtccctcctgccaagtaataacttccttcccagccaggatcctgccccaagtaggaatatagctctgcatttacagcagctcctgctcagaccttgtcaaaaccaccctgcagcttaggattaaggagcatggtcacaggaaggtggggtttcagggcatcccctcaggaactgcccatctccccagaattccaaaatgaaggtccatatgcttgtaggtgtgctggtcatggtgggcttcacagtaggaaagggtaagtggggcccaggggcagggagggaggaaggggtaactgagtccaggaagggggtggagcgtggccatggataatcgggcttcctactggcccagggtatttgagagtgacccagtgcctccatccctccttctgcctccccagttcctgttcccgacatccggacgtgccacttctgcctcgtagaagacccttctgtaggatgcatttcaggctcagagaagtgtaccatcagcagctcatccctgtgcatggtgatcaccatctattatggtaaataaggtcccaggaaggggctgctggtggggcagccaatggcttggtcttctctcctctcacagatcagggctgctccgggcatggggtacaagaagagaggaggggctgagtgcaatggctcatgcctgtaaccctagcactttgggaggctgaggcaggtggatcacttaagctctagagttcaagaccagcctaggcaacatagtgagaccctgtctctacaaaaaaatagccaggcatggtggtatgcacctgtagtcccagctactcgggaggctgaggtgggagatctcttaaactcaggaggcataggttgcagtgagccaagattgcgccaccatgctccagcctgagtaacagagctagaccctgtctcaaaaaaaaccagaagaatcttggaaggaggggtctaaggttctagggggccagcagagctcacttttctagcctcttgaaggactctgggttagaagtaaattaggtctgggtgaaggatgggaaaagtcagtagcaggggttcttggactatgggaagctattggaaggggttatcagctttcccctctccctcagatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaactgtgtcacattgtttgtggggtcaggctcaggtgtgggcaggtaaacacagattaaagagggttaatgcctggcgcagtggctcacgcctgtaatcccagcactttgggaggctgaggcaggcggatcacctgagattgggagtttgagaccagcctgactaatatggagaaaccccatcgctactaaaaatacaaaattagccgggcttggtagcgcatacctgtaattacagctactcgggaggctgaggccggagaatcacttgaacctggaaggtggaggtggcgatgagccgagattgcaccattgcactccagcctgggcaacaagagtgaaactgtgtctcaaaaaaaaaaaaaaaaaaaagggttagtgaggtttgggatccaaataggattgcagagccctctccattgcacttggcgtttgtcgcttcctctcggcctcctgtaaagggcacacatccctccccaccctctgcttagctggagatcaaagcatggggactgtgattcttcccagccttaaacataccctacaaaacctggaaagttagaccctgatgatgccaggtcttttcacctaagaaaagaaactttaggccaggtgcggtggctcatgcttgtaatccctgaactttgggaggccgaggtgggtggatcacctgaggtcgggtttgagaccagcctgaccaacatggtgaaatcttgtctctactaaatatgaaaaattagctgggcatggtggctcatgcttgtaatcccagctacttgggaggctgaggcaggagaattgcttgaaccggggaggtgtaggttgcagtgagctgagatcacgccattgcactccagacagggcaacaagagcgaaactctgtcttaaaaaaaaaaaaaaaagcctgggcgcggtggcttgcctgtaatcccagcactttgggaggccgaagcaggcggatcatgaggtcaggagttcgacaccagcctgaccaacatggtgaaagcccatctctactaaaaaaaaaaaaaaaaaaattagttgggcatggtggcacgtgtctgtgatcccagctactcaggaggctgaggcaggagaatcgcttgaacctgggaggcagagtttgcagtgagccgagatcgtgccactgtactccagcctgggtgacagaccgagactgtctccaaaaaaaaaaaaaaagaaactttctctttaaaccagaaagactcaggaactcagagccacatgccagagttacctgctgctggggccctggactcctgccattccttagttcttttcaaggattctggcatccaggatgccctctcgaggggcccaatttgaggggcaaagtgctgagagcactgatgttgggctgcagtggttggatcttcatgctaatattttaattttgaaatagtgcaaacgtatagaaagcaaggatggatacaacagccttttccatacactggataaacatgctggacataacgctgctctgagtcaggcttggtattgagcagcaggactcccagatgagtatagccaggtgtctgcccttccaagtcttgcagcccagtgcttgggttatgaaacctttttctgaaaagcagtgcagctttgtggctgggaggtccaatcccagcccctctaccacttggatatgtcagtctcttcagccccaccttggtcacctgtcaagtagggatagtgcctcagatgattgagaaaacacatgtaaatgtgcatacacaagtagaagttaaggccttttccccctcaaaaaaatatatttgccctagagtcaaatgcatacacaatgttcagcttttttttctaaggttcttactatgttgcccaagctggccttgaactcctgggctcaagagattcttctgcctcagcctccaagtagctgggactacagatgcacaccaccatgctcacctggctgatttacttattttcaaacctttttggtaaaacattcagaagcttgcacatatcacaagatggatttttgtaaaccacacatctgtgtaaccagccaccaaatcagcgtgaagacctttacctgcagccaagcctgcctctgttcccctctcccaggtgctcttcccagctctggggtagccgctgtcctgactggtagtagcttagatgagttctgtctgtgcttgatggaaatggcatcgtacgcatctgcttttacctatatagtgttttgcacacgtgttaacaaatctgtgtggcctgtactctgacggaaaataccaaaccaatgataattaagtcatgaggcagttggcgtacaaagagaggtacaaacccttaatgtgccccccaacccccaccttgctaagtccacccttctccatgacctctgacgtcagtataagacagagaaaggcccaggtttatagcaggtcaacctggaagacaccctcagaggctgaagaacttggcccagaattgaagagaccaggactccaataaggtctaacatctctttgagagtggccttctcggctcggggtgactcacgcctgtaatcccagccctttgggaggccaacgcaggcagatcacttgaagtcaggagttcgagaccagcctggccaactggtgaaaccccgtctctactaataaaatataaaaattagccaggtgtggtggcatgtgcttgtaatcccagctactcgggaggctgaggcagaagaatcacttgaacctgggaggcagaagttgcaatgagccaagatcacaccactgcactccagcctaggtgacagtgagactgtctcaaaaaaagagtggccttctcacccacctccttctacctgggcctggtcctttcgcagcccccttcccaccaacatagccctctaaacgcccctagcccccacacagctctggtctgacagcactgccgaggatgcccactaactttctggcattcaccataggagggctttcatttcctctttctctttttgtgtctagagcaaatcacataccaaggcaggacaagaggacagctcagcagagctgggggtcccttacctgacccatggtagggcagttaggcaggtgcacctccctcagccttcacctccaccagaagaaagagacataccaaacagtttacacacaaatttatttgggagaaacatccagggactaggggacaagagaggaaacctggtgggcagtagggctgggggtacagagtagcagtaagtgtgctgaagggcgtcaaccaagaggaagagccaaggctggggtccagtggctggagggaggcaaggagggctggtatgagggactagaagtcctggccaagcccagatagaagtcaggaaggtggctggaaactggtggaattttacaccaaagtttgctgcagtcacactaaggagtatagagccctctgttttgagggtcattgcagaaatccaggaagcagtattgagagaatatccagaagccagacaccggagaagttcgggtatttgaacaatcactcatctgctccttacttcggcagtcactcaccatgacgtcagaaccgctgcctggggagggacagtgggcaccagtgatacggaagtccccaggaagagccccaaatcctctcatccccacactcataagtcaaaaaaaaaagaaaaagaaaagattcctgtagttaggcatgggtggacatgcccagtgttcaccagccatggaactccactgaagttcccatgcaaggctggaggaaaagagccatatgaaatgtaatggttggagggggagttgggagttactgagccaagtgaggagaactagcaccataggaccatgtgagaaaaagctgggaaatgttttggagattgggtggcaggaaggaggtgtattgttatttatttttcagaccaaaagagaataagatgatgtctgctgctgttatacataatagagaaaaatctttgtgcctgcatcccaagaagtcatgttcagggatgtttgctgctgccctgcttgagagaaatgaccaaaatgcccatcaatagtgggatggggaaatcagctgtgatatgcgcatgctatggagtagtatacagcaggtcaataaaacaaggaagctgtttacaaactgatatcggaacattcagttcccctaacttaaatgtggaataatgtttacagtgggatgctactatcttgggttggggcgggggaagaggtgaaaaaatagtaaacagcatatttgtgcagggtggaatgtgcataaaagattgcaggagggatcatccagaaagtaaaaaaagtggtcacatgtgcaggggagccaggtgggttagggtagtagcgggagactttggtttgatggtattgtatactctgatatttgacccacatctgtgcatcggctatgttaaaagggtagtaagaggacttgaacacaggcagctgcatgcagtggttgttgagagcaccatctctggagccatcacaaattctggctcagcatctgtgagactcaggcaaggttatgacctttctgcacctgtttcctcatctgtaaaatgcacatagtaataatacctgcctcagcggattgcaagtgtttagaacagtgcctagcacatattatgtgttacgtttttgctaacttaagaaaggtggggggtcggtggaagagcaggcatcgggaaggagtcaattttcagcgagggagatgtccagtggtcaacgggatatgaggagagcggtttgacataacattcagattcagaaggaagtggtatgtggctgctggttgaagccagcaaagcagataaaatcctctgcttttgagtatatgaagtgggaagacagctaaggaccaaaccttggtgaacatgaaccactaagggtcagagagaaaacgctccatgaaggagactgaagaagccgtggaggatgcaggagaagagcaacaccagcagtaactgcagacagatgcggaagcagacagcttgaggacaggcaagggcacctggagatctggagggtccccgtcaaagctgcgcaccttgatagggtagaagctattcagctacagattgaggagagaaggttagtggaagtggagacagagtgtggctctgaagaaaagggaagagaggctgggcacggtggctcacgcctgtaatcccagcactctgggaagctaaggtgggtggatcacctgaggtcaggagttcgagaccagcctggccaacatggtgaatccccatctctactaaaaatacaaaaaattagctgggcgtggtggcgtgcacctttaatcccagctgcttgggagactgaggcacaagaattgcttgaactggagaggtggaggttgcagtgagccaagattgcgccactgcactccagcctgggtgacagagcagcaaaaaaaaaaagacaggattggagcaatgtcttatgggattatgggaacaagacttggggtgcagcttaggaggctgagagagtttccgtttgggagagtgctgggcccatgacaggagaaggccacttactgttctttttgtggagagtgatgcagctgctgccagctggggtgaggcagatgtcagatcccagaaggcaccctaactccttggtctccaagaggcatcggtagcagcgcaggtatttggggaatggaagtggttgagggggttcccaattgacaggaacaaacttacctagaacacagagaagtgctgaccccactcacaccccattctacctcacaccctaccactgcctgattccaggccactcagccccactcctccctcccttcctgtctcagaaaaccatcaaagccccaattctctgcttccttccccaactgcatacacatacatcccccttttcctctggtcctaaggccagaccacatgttaacaaatccccagacccagcagagcacttggtgttaggcagaggaaagtgctaaaccaacactttgaatcctgtgtctctgtggctggtgctttgcagccaagtggggagcccagcaggctggactcagtcttgttctatcctgtggattctggttttctcatccagcacactccctaaccctccctattctatgttgccctcagatccagagaggattccttcagtatctctattcaggtcactgctgtgaagtgagacagccctggggtggtcactagaaatctccttcagaggctgggtgcggtggctcacgcctgtaatcccagcactttgggaggccaaggcgggcaggtacctgaggtcaggagttcgagaccagcctggccaacatggtgaaaccccgtctctactaaatatacaaaaattagctgggcttggtggcttatgcctgtaatcccagttattcgggaggctgaggcatgagaatcgcttgaacccgggaggtggaggttgcagtgagccgagatctcgccactgcactccggcctgggatacagagcgagactccatctcaaaaataataataataataa

SEQ ID NO: 336 - DNA, 143753 bp, Homo sapiens
tagaaacacagatggagacagctggagcgtgtgtggaggtgggcagggggactgcagcttttcttacaagtgtcacagtcctatttaagctcgtatgttattttggtaaacacttgaaataactgttagaaaggaaacctacaaatctgagcacagcaatcccgttaaaaccttttggtctttcccatcgccgggacgccaggtccacgctcctgcaaccatcactgcaaggtcgtctcttgctaaatccgcgccccaagtgtcctcagcctgcagctggctccgcagtgagttgtgattttctctaaatacacgtaccctgaacgagtgaacaatctgagagacgtgggtacctttgctgagtactaaagccaaggttgatttgaaagttaggctgctacaacctggccaacacggtgaaaccccgtctttactaaaaatacaaaaaattagctgggcgtggtggcgggcacctgtagtcccagctactcgggaggctgaggcaggagaattgcttgaacccgggaggcggaggttgcagtgagccgagaccgcgccattgcactgtagcctgggtgaaagagcaagactccgtctcaaaaacaaaaaaataataacgaaaagaaaaaaaaaaaaagaaagttaggctcattgattcccatcagcctttgacagtggaagggaggtcattaagggctgactggagaagagtgatttcctgaatgggttgaaataaataatttattgctgactcttgtcaacatcagccagtcctgctcaccaggcccatcccctcctctgagggcaaattccagtggggacttaggatggcggcaccggggagaccaggacaccggggacatcagttctgcaggcacagcacagctggaagcacagggctggcctccccggctgacctctgatcccggggtcatctgaggcccgtgtccaccccatcatcctgctgccacacacaggggtcaagcgtgttcctcacaagtgtggcctggtttaggatcatggtgataaagggctccgtgtcaccgagtgggaaggacagagggtaaaccagtgttcagctcagtgcccccattagcctccaacggagacgtcacggcggcacgggatccatgtggatccatgtcatgtggaaaatcctatctggagcaatacagtgagtgggaatgtaactgggcacccctgctccagctgccagcaagatcctgcatacctagcaattgacgagacctgcgcctgccctggagatgatttcaggagactttgcaggtgcaactgtatctatcagtagcatgtaatcagatgaaaagtcccaaatccacctgtaattttcacgaaaataataggcaggaatgagaagccacaggatgcctcactagtgggctcatggatcctctgcctggctcccgcagccggcaggcaaatgccctcatgctgatactcattgttagttaaattttcattgctttcagagcaattgcttagttttcattgcttagagaggcccaatttaagaaagtttcatatccccacatctaagtgaacagaacaaagaaattgaagaaattttaaatctctttttgaaagatacctctacatataaatttagacagactttctattaagcaaaagttggcaaccaaaatttgcattaaaaaaactttaaacttcacaatttatgtttagtatttacaagtgaagaaactctgcaacctatgacctcacagcactccagtcacctaacaaggcagagaagcagagaatagactctcagttctcctgcacttgtcccagtgtcgtagctacaaccgagagcctgaatagactgtgggtttccactcacacatggccagacaccgtccaagactccgcagaaacaggcaagcccaggctcgtctactgcaatgaacccagcgttggtttggcatgaagaccccatcctttcaatgtagattattaaaggtcattttcttctgctgcaatgaacccagcgttggtttggtgtgaagaccccacccattcaatgtaatttattaaaggtcattttcttctactgcaatgaacccagcattggtttggtgtgaagaccccaccctttcaatataattcattaaaggtcattttcttctactgcaatgaacccagcgttggtttggtgtgaagaccccaccctttcaatgtaatttattaaaggtcattttcttctactgcaatgaacccagcatcggtttggtgtgaagaccccaccctttcaatgtaagttattaaaagtcattttcttcaggggtcccttcctccaactttaaatctggaaaactagaaaaggtaagacacagacaccaacactttgacaatagcaaatagctctggacagcctgaggtcggacgtaaggagggagaggaattaaaaaaaataaaaaggtgaagcagagatgcagagaggtagaggctcctcctgcagacatggggccgaggtatatacagtaggtaacagaggggctcctgcagacgtggggctgaggtgtatacagtaggtaatagagaggctcctgcagatattgggccaaggtgtatatagtaggtaatagaggggctcctgcacacacggggccgaggtgtatacagtaggtaatagaggggctcctgcagatgtggggctgaggtgtatatagtaggtaatagaggggctcctgcagacaccgggctgaggtgtatacagtaggtaataggctcctgcagacacggggctgaggtgtatacagtaggtaatagaggggctcctgcagacacggggctgaggtgtatacagtaggtaatagaggggctcctgcagacacgggactgaggtgtatacagtaggtaatagaggggctccagcagacacggggctgaggtgtatacagtaggtaatagagaggctcctgcagacacggggctgaggtgtatacagtaggtaatagaggggctcctgcagacacggggctgaggtgtatacagtaggtaatagagaggctcctgcagacacgggctgagctgtgtacagtaggtaatagagaggctcctgcagacacggggctgaggtgtgtacagtaggtaatagaggggctcctgcagacgtggggccgaggtgtatacagtaggtaataggctcctgcagacacggggctgaggtgtgtacagtaggtaatagaggggcccctgcagacatggggctgaggtgtatacagtaggtaataggctcctgcagacactgggccaaggtgtatacagtaggtaatagaggggctcctgcagacacggggccaagatgtatgcagtaggtaataggctcctgcagacacagggccgaggtgtatacagtaggaagcaggaactgcaggacaccctggggctgatgacagtcattgggccacatttcagggccagattttctgggatttttggggaggatgagctacatgcctggctttatggatttagtccatggaatttgcaacatgattttccacaagtcattggccctgccgtttagacggaaggtattgataagtaatacattatttataagctccgctcaaaggtattttcacatctttctagtcctggtggagacattgattttccctgaatatatgaacagtgcttagatttaaccccgctccaagctttgtgccctggtgaagctggccgctgccacagctccagggtgtcacactgcacatggtcttccccaccttcaatggtcacttggggctggagatgtggcctaacactagcccagtctgactcgcctccaggctctggcttctggcacctggacaaggagaccctcactttcatggtcccaaggcactgtcagaaaccactttgtggtgtcaggaagaaccagtctcaagataatgcagaacagggagattaaaacaagaccacgtggttggtgacatcactgagctgctgggtcaaaccatcgctgaagccttctcttctggatgtcagctacagaagccaatagaccccctttgttacattattatttaagtgagtttgaattgtcagcaatctgactgatacagctcagtgaaagttgaaagttatagtgtaatttcctaacaccttgaaaatcctgcctaggctaaaggaagcactgaatggtgtcttctaagggaagtcctgctgtatggcttgtaaagattggctattcgcaggttcctgcgaggaggaatttcactgacaccactgttgcggcacttatttttctgtgcataaagactactaatttaggactttatatccaccacagaaaagtcaattttatgagactggttcctttttaaagcctacctctctgcagtaagagactatttaataatgacaacaacaatatgcttgtgagagcaaacgagggttgcagctccaattcaagaggccaaccatggctaatcttgaagattttcactcattagctttttaaggagctgttaactgcaaacgtgggactcagagcttcggggactttccgtgttgagtgttccgccagcagtgcttgcatgtctcagcagcacagagctatttctggggaaagcagaaataataaactcactgaaaatacccatgattgatccaagcttcctctttcaaagaaaaaccggaagttcctccttccgtattcttgtggaaagctttgcaggtgcagggccatgcggccggggagactggggagcagccctcctgccgctgacgggtcaggccggctccgtgagtgattaattcccaggtcacatttctgtccacagctgggagacgatgattaaaacttgagtgtgtttattcctttgcattggaacttgaaaacatcaatttttatttcttggataagtaatcagaaaagtaaaacaagatgaaagaaaggagagtttgtgctacggacacagtcaaagacgtagaaaggcacagtcctggaaggagtgtgggagcagcttgagagcagatggacggaaagagccacagtggaggcagcccagagacacctggagattaggggcacgtggcccaggccacatttcaaaccacaggcaagagaatggctgatttgatccctggaatagagaccattttggaaagttaatttggaagcctgtaagatgcaaattccaagcagattaaagtttgtagtgatggggttttctgtagacagactttttctagatgtccaaagagctgatcgggcacggggctcctgatccgcctgccgggctccacgggaagagcctcaaggttccattcggtgctgaggccgagccacacttgcctctggaggggctcatcgccggctgcatctgcaggctgctcttgcaacgccctcactgcaaaatgcaaagaagatccactccatgtcctgtccagctgcctccgtgtctagaaaggggcctgtccacttcatgtctgagtgacaggggcctgcccctgacaacacagcggcccgcatgccactgaggaaaagcttcagcgagaacagagacacgtacagggtgctgcccagaggggaactcggctcctgcaggaagggctggtgggacggctgccggggcgttttggaacataagccactctgcgtgcgtcccacacaagcaatttctgctgcagcaaagcacagcccttctctaagcagggcaacgccggccaccctcctccctgccactcaggccccggctctcagcccagccacacacgctgcaaacccgtggatgacatttccccttgcttcaaacctccatcccactttctggttttattttattttatgcattttattctatgtgatctatttgcaatctgttctggaactaggccagattttaatcaattaacaaatcggctgctttagagtctggcaaccccaacttaccagagtcatttccaggtggataaagcccccaggtacagggatttggggagagattttgcaacgttctgtagaagtaatgttttttacactaacttgttaattacagaagatcagcacagaatctgaaacagatcaataggaatcagagaacgcccacgctgcagctgctgcccccagcccacgccactgccgtggggcagagccgctgtccgagcgttcagtctaaccgatctcgcttcctccagagctctccacccacctccagaatctgcaccgagagcagcctgtgtttaaggactctgatggacagacggcggagtggacgtcccaccctcacgagggaggccgccggacacatcaccgggccactgcgcccagctggccctgcagaggcgctgcaggaactcaggcacgcttgatttgagagcagcaagcacagagacgcccgtttgtcacatccaaataagcaggtgtcagtcttcctgcccgactcccaaatcagggccagagcctgctctcttcagcttgaagtgagtcagcccggggctagcgagcaagctggggttcaagtcaggtaacactggcctggcccgccgaggaggaagggctcacgcttcaggagcagaggggcccgaccagtcactccccaggaacagggctgcaggcgaggagggggcagagtggggagaagaagcacaggcgagccccgagccaggtccacgaggggaggcacagctcccccaggtttctacacggccacccggtgtcgaaagggctggggaaccaacgtctacagggatggctcccatgggcaagcccccagcctcaagagtgggctgcgaggtgacatggacagggctgcgagctggtacgggctgcgtccaccactctgctggggtggaggaaggtcgatcaggatctggaattctcacaggtgaggcacaggcattgggcgcatatctgcctgctcctggagaacgtggttggaggccgagggcgtcctgactgtagtggggccgcgctgtgtcttccctgcacgctcaccgtgtctcagaccgtggcgctccctgcaatgagtcctgcccgagactcaggcggggcgctttcatggggcctgatatggggctctgtgattccaagggcagcacggctgggtggaaaatcgcagtgagaaggtcatcaaggtgttttccacgctagaagcaccctcaactcaagttaaacacacaaatccaccaccctgtctccaacagcctggagagcaactgggctccactgactttagtgccactggagggcttgtgtagatgaacccacatgggcagagctgcccagcgcccgccaggggtccttgctgacaggactcctgggtgttgtgggggtgaaaggcacgagtaagtgtgtctgaagcagcagggaaggcgtcacagaagaggtgacagccccggggacacttcaggcccagggaacctggggaggcaagggaggaggcatttgggccaagggaacgttccagaacccggtgaggatgagggcagaccctgttgttttcatccgtcgtctgggtcaggtgttgtaaagacgctcttagaaccagctctgttggttacgacgcggagaaaacacggttacttctgttctctcctgagcttcaagtacagtaaagagattttgtaaaactaaaagcagctcacacaaggggaacgaggtggagacgcctgcaaagtggaggcacctggggccagcatctctgtggaccccagaaacgactctgacacagcagtggggacagggcaccctgatttagatcccgaaccccaaagcccccaggactgcgggccgaggatgatgccggggggagggctggaggtggagaggggcctgcgcaggctaaggacccttccctgcccctgcctcctggggccacctccccttcctgtctcgtctctacagagactgaagcgacccctgggcctgggcagccatgagctctggagggagtccctctgccccaacgccaggccagcctccttccccgcgtgctcccaagcaggacagcctctcctccagggaatccgacctgctgaaaaggaagccccagaatacaagcagacacacagatctgtcgaaacacccgggcaaactctccagcgtgaaataaacacaaagcaaaatcatgtggaagtgaacggaagccatacggggagaagagcgtagcgtcgcagacggtcaccctggaggggcatcaccgtcatgagctgtggacagaacccacactctccacagggagcacagacagacccacgatccccacaacggaaccatcacagaaaagaaggaaattggcaaaagggccgaggtgtgaaggtgccgggaattggagcctgaagacaaagatcaaagctgggatggaaggagaggctggaggaccagtcgaggccaccttgcagggatcgcattccggagtggggagcagatacgacagaaagggagaaaccacaaccagcagcacaaggacagccttgagggatgaaggacacaggtcctcgctcaggaagaactggtggccacatggcacgggggaccacacccgggcagcaactccgtagaaggggagggtcctgcaccttccagagaccaagaggggcccagagaacagtgtccggcatttcaagggcacctcggggagcccagacgagggcatgatcccagcctcccggacatgtcgcccccaccagactgaccatcgagtgcagggaagccccaggcaggggccacaacagagggacccccagagcaaggggcctgtcagcatcactcttgtgggacaggatccggacacctctccagaacaaagtgagttagtagtgggagagacatcaccaggaagccaaaattaacaagcgcccaagataagacaactgaagaggagactgagacacttggggttccattggtatatacacagaaaataaagttgatggaaaaagctaattattaatttcaggaaaacagaaaactgcaagaaaagccatcatcgtttgtgacgggctcagtggtgctgctgtgtgtgttcatcgcagtcctggctgatcaatatttgctctccacattgtcagtggaaaggtggcggggacgggaggcgtgggaagggagctgatctattgtgggaggtgacagacaatgccccagattaacctgcccagaggtagcaatagcagctagttacacagagactggaggtgaatgctgagaagatcagtttagaaatttgggaatgaatggtctggaaagatgaaaagtgcagtacagggttaaggactgctgtttgcagaacaagccttaataaaaataaaaataaacacatccaagtacaaactgaccctgaaaaggaccagcctccaacagagaaagacgggtttcctgatggcagcagcccccgaggcgagagtcccagcaagggctattgttcgttgttcgggaaacttcgcccgaaattggtacccccattattatttttgcatgtgtctcctagggaagagaagaggctggttgggttgtagaaacccagtctatgaatttcaagtcttcatcacccctgaggtcttttcaggaagagcaccatgttggtgatgctgcgtctctgagagcctcctcctgctattggcgccgtgttagggagccggaaggaggctgagaggttctgaaaatgaaaccagaatgctgtccaggctgacgcgggcacctggtgagcagagggaccgtccatgaatctgcaccccacatgagacgcacgtgcaaactggaactaatgcctgctcacagcctaattacactcgcggcgtcagcgttctgggcaggccgttcacactgaaactcggtcggcactggcgctggggcggatcctggccatcgaccactccattctacagcggctccttcagtgagtcgcaaaaacacttgctgattctgggcctcaatttccccttgtgcaaggcgaggccagtgccttagcctcacagaaaataaaaagtgtcccagaagcagagggaagtgtggtttaaaacccatcaaaaccacagcgagggcctgagatcctgactcccgacggcaccacagcctcacagttctggctgtgagtcacagaccttattccaggcaagctgggaactccagccgggtctgggttattatttcttgccagtgatttttcagagaggtttgtatccgcggggaaccatcagtcacgtagttgctgtgtgcgtgtgtgtgtacctgcgtgcgtgtctgtgcctgtgtgtgtgccctgtgcatgtgtgtgcttgtgtgtgtgtctgcacctgtgctcagtgcctgcggtgcaatgaatgatggcggtggggctgcgtgtgtgtctgtgtgtgtgtccgtgcatgtgtgtgtgtgcgtctgcacctgtgctcggtgggatgaacgatggaggtggggctgcgcgtgtgcgtgtgtgtctgtgtgtgtgcgtgtgtgtctgtatgtgtgtgtgcgtgtgcgtctgcacctgtgctcggtgggatgaatgatggtggtggggctgcatctgtgcgtgtctgtatgtgtgtgtgtgtgtgcgtctgcacctgtgctcggtgcctgcggtgcaatgaatgatggcagtggggctgtgtgtgtgcgtgtgtgtctgtatgtgtgtgggtgggtctgcacctgtgctcggtgggatgaacgatggtggtggggctgcgtgtgtgtgtgtgtgtgtgtctgtatgtgtgtgcgtgtctgtatgtgtgtgcgtgtgtctgtgtgtgtgcgtgtgtgtatgtgtgtgtgcgtgtgcatccgcacctgtgctcggtgggatgaatgatggtggtggggctgcgtgtcctcctaccattggctccgatggttggagccaatctggccaggccggtccatgcattctttcttttaaggattcccttaggtaaagcctctgcttgtgagttttcatgcaagacaacgttgagttaaagccattttaggaaaaaaaagaaaaaacttgttttgaatgatgtccatgcccttcaaaactgaacacaaaattaagaaataactgagtacccagaatggcagcctgtctcagagtggtaataaggtcaactgcaaaccacacggcctggtgccctacatgcactgggcggccgagccctgctccagggcctgtagggcctgggaggtgtcggatgtggcttgctggctgcagggcctggtctgtggctgagagaccgtggcggtctgtggacaggtgagtgctgggcccacaggatgtagactgtgaggctggcgaggtgagccaagacctcttatctcccatcgggccttctgttcccctctcaggaagcccgttggtggccagctgaatgtttaaacccaagtgctgaccaagaaaaagtcaaggggaaacctaggggctccctgagatgagtctcgaagctggaaagccacccagacacgcagggaggttcaggagtcttcatacccaaccaaaagctcttcctcaggtctgtgctaaaatgtggttttcccctcagaaaaataagccatgctcttatacaaatgtggaaagtatgacaaaataaaagaaagaaactagaagtcattcacagcatcactaccagaggtaactcatgttaccatttttgtggatttccttccacgtgtgggcatgactttgtgtgtgtgtgtgtgggtgagtgtgtgtatgtacacagggagacaggataaagttgtgttgaaaactactaaagtcaggctgcttgggtcggaatctggccaccaaatagcagagagttgagcaagtgagtgaacctctccacgtgtgtcacgtagaggtgagggctaccccgtggctggttgtgaaatcctacatgacaagcctacccagggcttacacggatgcttaacaaagtgtcagctcttagtattatagtgattttgcacgaataatcacacctgctatatgtacagttgtatgtcagccccttcacttaaagtcacagtgtgcaccccatggcactgcacattctttgaaaatacgactttcaagggctggtgcttctgtgacgtggctcggctaccgtccgggggctcttccctcttgttggatgcctatggcacttgtgatgatcgtaacactgcagtgaaagcctcacttgtgagcctctgtcattgtctctgatcatcccttagaaggagccctaggatggcagcaggatgcagtggttagcattgggattcacgctgccccgtggcctggccgagacgcacccacgaggatccctcgcccgtggccgccctcctcacccagcactccaggcaagaacgggacttcactgctgctgtcatctgcagctctgggattattgttgaagtggagcatttagggctcttctaaataaagtttcaagttctatttttgtccatttttattaataagattgtcagtttttcctgactgatatatgaatactagtaaactttgatttaatatattttataatattttttgcaggtttttattgcagttttgaaatttgtttatgctgttctctgacttcttgcctttgctttgtttttttctttctttttccatgtttagaaagcttttctccatccccaggaaagaaaaagcattcattttaatttcctctagttgttttataattcaattcaaaatttttaacttttaattcatctgtaatacatttgggtacaggtcttaaattatataagttaatttaaacaactcttctctgatttattttgttggtggtggtggtgatggtggtggtgacggtgatgatggtggtgatggtggtgacgatggtggtgatggtgttgacagtggtggtgacggtgatgatggtggtgatggtggtggtgataatggtggtggtgatggtggtgatggcagtggtgatggtggttgtgatggtgatgatggtggtgatgatggcggtggtggtgatggtgctgctgatggtggtggtggtgatggtggtggtggtgatgacggtggtgatggtggtggtggtggtgatgatggtgctgatgatggtgctgatgatggtgatggtgacggtgatgatggtggtggtgatgatggtggtggtgatggtggtgatgatggcagtggtggtggtggtgatggtggtgatggtggtggtgatggtggtggtgacggtgatgatggtggtgatggtgatgatggtggtgatggtggtggtgataatggtggtggtgatggtggtgatggtggtggtgatggtgatgatggtggtgatggtggtggtggtgatagtgatgagaatggtgatgattgtggtgatagtgatgatgatgtggtggtggtggtgatggtgatggtggtggtgatagttatactgatgataatggtggtgatgatggtgatagtggtggtgaactgtggcctcacatcccctggcctatgttggtcagccctgctggcagctgccctcgatctcgctgggctgtgtgcatccccagctagaggaggatgataggggcacagagccctctccagtgggtcccctttggaaggagcctgcacagcactcccagtgaccccaagggaaaaacctgccccccaggcaatgccctacagttcagtccgaggttccaggagcttcctttctgctggatggaccttcaagcatattgacccttagccccgggtcatcccatggccctggggatgcagcgaggggcccagcaggcagggtgagtatctcctggagccatgtctcctggagagctccttagtggctggcagagaaggattgagaagacattttccccagcaggcctgggcagaacactggcacacccaccctcatccctgggccagcatcctcgcccccactgtgcccccaactccagcccagcttccccaccttggtggtccaaatgtaccatgtgcccctcccccaaagtcactttctcagtgagcttctccctgctgccttgcccccagccacggactcctggccagtttcttccacagcccgtgacccgatgactcacgtgtggctcactgtctgtctccctccctggtgggaccgtggttcctggacagctcctggatacagtcagctgggctttgttccctgggccacccagctgccccctcctgtcctccagtgagaatgaagcccatgcagaggaaggcccaccgggcccctgccccctttctgttgcactagggtcccagccacggcatccacacttgtccagtcccattaggaacaccccaagtgttaggaacaccccaagtgttaggaacatgcctagtgtctgtgctgctcactcaggcctcacagctggtgcttcctcattgagtcagcgagctttccttcccagaaagtgagctttccttcccagacggtgtctcagcatggccactctgccgtgcatggcaccagcgcacaccccatccctggacggtcacactcctggctatgccctcagcagacaaggcacagtgaccagcgcctgtcttaacctgggagagacacctgagcggccaggacaagttttactcctccttgcaaaccctggcgaaacatccacagagagtggaggctccgcggtgctgtcccctgtgctccgcgacagggatggagctactcaatcaaatccaaatcccgccgttccttagggcctcggggaatgggatgagaatgaagagacagcggccgagacagtggctcctgatcactccccgggaacagcctctcaactgcgccatcactgatggccccgtcggtccccgcatcacacgtcacagcctctcaactgcgccatcactgacggccccgtcggtccccacatcacacgtcacaatgttttcatactctaaagcacaagcgcatgtttcaatggggtcgtggattttgtaataatattttagcttggaactggtaagaaactaaggcaaattaaattcaatgctagtttacccttgtattttaaaagatgttgaaaataaacagcaaacaccaccaatgctctgctggcattcactaacaagccacgccatcccacctgctctgaaacgctctgtcttctgggtccctccgtgacccccccacacatcctagacatcccttttcctgtggtcttttttggctctctgtgcccttcccccaatacttattggaatatttacttatttttgcctcttccctaaactgtacattccttgagagaagaagcgttttgattattattttttttatttttttaaccttatctccttttttttttattattatactttaagttttagggtacatgtgcacaatgtgcaggttagttacatatgtatacatgtgccatgctggtgtgctgcacccattaactcgtcatttacattaggtatatctcctaatgctatccctcccccctcccccccaccccacaacagtccccagagtgtgatgttccccttcctgtgtccatgtgttcttattgttcaattcccatctatgagtgagaacacgcggtgtttggttttttgtccttgcaatagtttaccgagaatgatgatttccagtttcatccacatccctacaaaggacatgaactcatcattttttatggctgcatagtattccatggtgtatatgtgccacattttcttaatccagtctatcattgttggacatttaggttggttccaagtctttggtattgtgaatagtgccgccataaacatacgtgtgcaatgccacccccatcaagctaccaatgactttcttcacagaattggaaaaaactattttaaagttcatatggaaccaaaaaagagcccacatcaccaagtcaaccctaagccaaaagaacaaagctggaggcatcacgctacctgacttcaaactatactacaaggctacagtaaccaaaacagcatggtactggtaccaaaacagagatatagatcaatggaacagaatagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaagccctagaagaaaacctaggcattaccattcaggacataggcatgggcaaggacttcatgtctaaaacaccaaaagcaatggcaacaaaagccaaaatcgacaaatgggatctaattaaactaaagagcttctgcacagctaaagaaactgccatcagagtgaacaggcagcctacagaatgggagaaaattttcgcaacctactcatctgacaaagggctaatatccagaatctacaatgaactcagacaaatttacaagaaaataaacagcatgaggaggcccaaagagctgttataaactcctcggaaacatcagaaaagccatctgaaatttaaaataaatgggaatccaccactaaaaaatccgaaatctaaatgaacaaaccaatagcccacagcctgctccgagtgacgcggcctccacacggaccctccgcacctgcagagccgctccgggtgcccggccaggcctccgagggacgaagtccctttggggaaagacatttacctagaacacgccaacatctacaaggggtgaaatggtcttaataaagggttacatcttctgaaatgctgcattttaaaatcccgtctctctctgtctttagggtccgtttccttcctaaggcaggtgcagagcccggccttgctgcgccttcggggcgcgggcatctcccggcccagctccgccctcctcccgcgctggaagccgccgcccgccctggcccgcggtgagtccaggggaggccgcgctctgtggccacggctgtaatttgaaggggcggcctcaggcccaccccagtgaggcaccagcacccgcatcagctccgactttgcgcgctcgagaccccggccaggggctgcctctgggtccgcctgcgccgcgagaggacttggggcctcggggacccggcgggaccctccggctctcggctgcggagctgcgcgcccatggcgcgtcccacggccacccgggcctgggcctgtcggggactcgggaggcgccgcccaggtctcagggggactctgccgaggcacggcctgggcccggggcgccacgcgcggacacgagtgggcggggagggaagagcaaccccagccctgccgccccgtccagggagcctcccccacccgaggccggcggctcagcgctcatgggcggcctgggggcgcctccgggaaggactcctgctcccgcaggaatttgtcccacgcagaagaacgaggcccccggggagcgcccacgaacgcagggagacggcgcggggccctcgagccgatgcggggcgctcctgcctcagcccggagcggtgcagcctcgggccctgctctccgcccgggaaggctccgcgggttcgaatctgctgtgaaatgtcaccggcgcgctcgccatccgcgggcagaaggagccgctcccgggggcctttccactccgggaggggacgatgcgctccgaaccgctcacggggagcttggcctggtgggttccaggtgggaggaggcgctgcccgctcggagcgcccggggcctgggcagctgcgtggtcccagcgccggggtccgcgccgggtggggccttggccacgtggaaacccggggctggccgtgcccagggcagtagcggtgactccggcggacgtcagtgaggacctggaagtgaggttcccccaggagaacccccgtcagggacccggggtccagtcccgaatgggaataaactgtgcggcccacgtagagcagctcggagccgtcgccctggctctgagcaagccgagccttcgaaggccctggaccgaggcttccctggaggtccccgggccctgccgtgcgtccgaagctcctgtccagacgcggcggcgctggggctgggctctgcctagagcccaagatgttttcaatgttcgtctttgatttaagacgagaaagtttggctcagctccgcttccactcgccggcatctgtgccccagcgaaacttgccaacgtctggactgtaaataagggactttgacctaaaagtttttacaagctttaaagtttcagtaaagttgggtagagatatttcttggtaagtttgatgccaaaaaaaaggaaaaaaagaaaaaagcatgtgttttgcctgaaggaagtttggccggctgctcctcacggcctgggcccccaggaggagaacccagctctgccacgctggtgtctgctgtcccgactgtaaaccaaaaataaacttctaagcccccaaccgactgaatggaccccctctctgtcaaggggatttcaaagaaacctgaaaaacgaggtcaggccacgtgcggctgcctcaagggtcatccctgcagtgtccaaagcacaggctggtgagggagtggggggctggagatgccccattctaccctcctccctctggaattcaggcacaactgaccagtatgaactttaaaacagagatcttaaggctgacaaacaggctgttggtagcaatataagataccaaattcccacctgactctagtatagcatcacatgaccgggggcaggccctggaagtatccaaatattttactccaaaatatatttatttggcatattttctaacggccctccaaagctgtctcttgtgggagacatgtacattctgtagagaatcctcttccctttccaggcctttttctgacgctgaagagattggctgagagtctagcaccttctaaaggtctaaagaggaaacagttgccatctattgtctccaagggtggccacctatgagacttcatctacataagaaccttggtctccaaaccccttcaccaagacactcctttctggtgattccacgtctttagataataacttaactctttcaaccaattgccaatcagaaaactctcaaatacacctgtgacctggaggcctccactgagtcatcccaccattccagaccaaccccacgcacacctcacatgtactgattggcgtctgcctgtaacttttgtccccctaaatgtctgaagccaacctgggcgcatgttctcaggacctcttgagactgtgcctcgggccttgaccactcatatttggctcagaagaaacctctctaaatattttacagagtttggcttttttccctcaacatgaccctgccacccaccaacttgagctgatgaataaaaatggtttcaggtgtctccctgccctccttgcccccacaaagagaaacacattgtctgaaacagccggaatgttaagctcactttctttgttcctgttttcagctggaggttgtgccaggggttctctggaggcccaagtcaccccggagacacagggacaccccacagccacgaccgtcccacatgggagtctgagtggaaagtgggggactggggcacctcgaatgggttagtggcacttagaaaagagtgatgtcttctcaaattaagggacagacgcctttcgtgggatgaagggagtgctgtctaccatgctaccgtggaccacggaaagtccggaagggtcgtggcacgagccggcacactggaacgctgccgtgtgtgccatgcaggcagcacggggctctttcctgaggagggctctgcgtgtggccacagtggtgggcaaagctggggcagggactccaggtgcagctgcctcaagggtcctccctgcagcgtctgaggcacaggctggggttgcgttctgagcctgcgtgacgtcagccacactcactttggctctgggattcctccttcccattcaaaaaggaggatccaaacaaaaacccacacatctgtatccttgtgactgcagagtatcagggcacctccggagaaactgggggccccgaagagccccccagatgcccatgtagatgccccccagatgcccaccacaccctcctcccgtaacaagtagccacagtgaaactttccaaatccccaaataaagccgcagtgcggagcgagtcctgcccggaatggtgggctcctctgctgtattcttaaaattgaggtaaaacataaataacataaaatgtgccattttaaccatttgtaagggcacggtccagagggctaagcacattcacgatgttctgtgcagtcctcaccaccgaccgtctccagcactttctcatcctcccaacctgaagctctgtccccgtgaaatgctcactcccctgccccggcccccggcacccccacctgctttctgtctctatggacctgtggactccagggacctcctgtgagtgagactcacacgtgattgtctttactgggcatgatgtccccaagattcatccatggtatagcctgagtcagattttccttccttgtccaaagctgaatattccactgtaggacggatcacgttgtgtgggttcattccgccctggatagacacgtaggtggtgtgtgccttttggcttttgtgaacaaagttgctgtgaacatgggggtgtaggtgcttcttcgatatcctgatttcaattattttgggcctatgctcagccttcactgtattttaacatgattttatctttctttaagcgactttttacatacgtccataaaattttaacttgtttagttgagcggtaactgtaattacagtggacccttgaggaatgcaggtttaaactacatgggtacatttattaagccagtagtttgcacatggcaggtcctcctggctgcagggactgagtgtggggactggtcccatattcgaggttctgggacgcgtcccccagggacatcaagggacggacaactgtgccatttttcatatttgccaccagcaccatctctaactgggttttctgctaatcaacgcccctgattgtcaggaggagaggagaccgggcagtgaggccccagtgcagaccccgggcaggctgggctcactttagcctccccaggctccctcccagcctcctggcctcgggttccaggcctcttaccatgaggacgatgacaggcccggagctcccgttctgatttaaaactgcggacccagccgagaccctgcagggcctccagccccacctgctccttccaagcccggtctcagcccggtcagcgccgccccctccgccctgaggaggaacctggcccttcggaagtcttccactgtgttctctggggaaaccacggcgcctctcttgccaaagcctggttccttctctccctctttaccaggctgggttttgccggcattgtctgtcggatgctatggagatgggaaaatgaatttcatctttcatcttgcacacacctgtctgaaggcccaatgttgccctggtgtggggacagcgaggggcaaactcgagaagcccctgtggacgcacaggtggcctcgtgacacccccaggggaggcgccccagaccccccccccccgcccgacgccagaacccacggggcggggcctcgcctggaatggggcatcctctctagaggacttgggatacctcgaactatgcaatgcggtgtaaatactgtttacacggtattttattgggttttttttattgttgtattgtgatttttcttcccctctggggttggtggaaccctcagttgcaaacaggaatgcagaggtggatggtggttccacgatttggaaatcatgaaagactacagagtcctgccagcttcttggtagaactttgttttttataagctcgatagaagatcttattagcttgatgattctttgagaccaggtgctattcttatctaatttatttattcatttatttcctcaacaaatatttcttaaatgacttttatattctcccccaagcatcttaagcagatgcttaataataggaaataacactccctttatacaataacattacgcaacgccatcatttgttctcataaaggcaattagtgcatgaatttccacccccaccctcaaaaaattgcaacactgtgtgcggtggagaaatcctgggctgtctcaggtttcctcactccacactctccccaagacaaagtgggtagttaccgcgctagaaggtggccaagagcatgtgagtctacaggcaagtaccttactctcctggggtgaaaataattcggagaaagtagaatatatgaaaagaaagtgtggagttaaagaaccaaagctcacagaccatctccccagtaaccagagttacttaaatgctttgaatgccacttctctcatctagaaaataggggtgaggcctctaacttcccaggactgccgcccacgtcaaaccctaccccgagcatgtgaagcctctgaggcctgcgattttggctgacagaggcacaggcggaggccagggcagcgtggggagcaggaagcccccgtggcagaacaagaagctccccgtgggggaacaggaacccaagccccatgggggaacaggaagcaggtgaacttgctgcctcccctcccagctggtgcgtccccagcagacagaggccccaaaacaccgagtgactcaacctacaatcaggcttgtttccaaaaccttgatttccaggtttcaaaattgtaagctaagccccgtccatggccatgtgccgcccaaagacccccctcagcccctcagcctgtattcttgcccccataactgcaagcactgcccgggatggccagttccataaagagccagcttcctgattgcattatccgaggacgaacctccccaggactgaggagttcgtcccccgcggctgatcacacaaatggatcaagggcctcctgcttggaggccggaggggagagcaggtgagacagagtcatcgattcccaggcaacgtggagcacacatctgcgcctggaagggggctgtcccattctcgtggaagtcaagggatttttacttcatcctcccacaggcatccttcctgcgctgtttcagagcctagaagctggggtgccccacaggacttggccatgtctgcacctcaaccgacagtcacttaatatgtttctcgaattaattttaaatgtaattttgcttttccacttaggctcattgtaagtaaaacgagtgacatcatggactaatgtgcctgttatattactctctgtaacacattcgaattaatgtataataatacgtaagaaataactagtaaaataaagaacgtgtgtgcacattcttcctaaagagcctctcttgcacggacaggactaggcataaggtatttggggaaactgtctcgcgagaagtgaggggcggaggcaggtgtccggaggcctgcaggtgccacggggctgaggccggcctcctgcgcggagtccctccctctgacctccccggggtgcgagccccacctgcaaggcggtggagagacgtctccatctagtggccgcctgcttccattacactgggaagcaagttcctgaccctgagggtcccgggttccttttggtgatgaaaaccctccggaactgaatagcggtaatggctgcacaaccttgtaaatatactaaaaacccctgaattgggcattttaaaggcatgaattatatggtacgagttatatctccatttttaagagaacttttgtgaaaggtttcaatatatgagcagaaaaaccttgttcacgtcttcttatggtgaaatgaaagcatctgaagcacagtgagtgtgtcttttttactttgtccagaaacatgaagtttaaaacatccagggaccacaagtcttcgagatagaaatgtttcatttgtgcttttctgtaagccacagctatagttactactgaataccattcttccaggacccttttatctgatattctaataagttgtttctttttaaaggcacttctccctaaaaagtgttctcaggctgcaattacacggatctgaagtgtgcggcatacggctttgctctcactctgcagtggagcttgtgggtgtggtgaaatgatgatgttttattctaaggggaggccgagaaccatctgcttctcgacggaaaccatgtgttattacaagacgctacgtcaggcgttttaacatgatacactccttgcaattatacttactaaacagaacaccactgcagaatttccctaatgttctcctcacacaccaactcaagaatcttcccctgcacctcaaatggtgcaattattttgtaaaggtctttgtcagtggattcaaaataaccagaaacaataatgattattatttagaattccagtgtaattttccagctgagatgcagcctcaggtgtggacagagtggaaaatgaggtgatttgtgtccagcccgtcttcagggaggggagaccctgctactggctcctcattgcccggcagggagtgtcctcccccaaaagatgctggaatgtggctccacgggagccatgaatccgtgtgaccctaggctcgtcactgtcacagtgcacatttcatggcctcaaacgggtcttccttgtgtgtaaacttcagagagaaagtgccttcatggggtgaacacagaagtgccaccccaggaagcctctgctgcccagcagcaggaaggggggtcgagtctgaggccccaaggaaggaggaactgagctctgctgtagggagccccgtccagggatgagcaaggcgggaggggaaggccgggaagcggccagggaactctctgaaggccgccttcactctggagcctggccgaggctcagctggcttgaccacgctgcgatatgcatctccctccgcccagccctgattcctctcctttcctcacacagccgttgaccctaaacagatctcacctgcaaaatccaactgcatgtcagccacagtctacagtgcacagtggagacctcaaagacaggattattcagcccaaaatgttactagcgctgtggttgagagatccggaaacaggctgaccgcgaagagagaggaggcacagttagtaaggccggtgatgagagggaacatcaccacctcgtgctaagggaatggtatgagcaaacatatgccaataaagacgaaatgcaaaaatgcctagaaagacacaaatggccaaaactgacttgagaagaaatggaaaatcctaataggcctacgacaagtaaagacatttaaaaatcttcccaaaagaaaagccctgtccccaatggcttcattggtcgactttatcaaatatttaaagaagaaaataataccaattctacacaactttttcaggaaaacaaagagtaagtaatactccccaattcattctatgaggccaggatcaccctgataccaaagccagattaagcattacaagaaaacttcacaccaatatcttccacaaacatagatacaaaaacccctaacaaaatattagcagaccaaatgcaaccacatataaaatggattataaaccaggatcaattaaagtgtatcccagaaatccaagattggtttaatatctgcaaatcagttcatcaatagatatgaaaaaatcattaacaaaatccaatacctttcatgataaaaactcacagcaaacaagaaagaaggaacgtcctacatcttttaatggacatgcacaaaaaacctacagctaacatcatggttaatcacgaaagactgagggcttccctcctaagatgttaaacaagacaaaactgtctgttctcacattgtgctggaggagaaaaataaatgttagaattcattagtttattcacttccatgtaatgtaccaagtagacctcaggtgacaactgtgccacagaacagctgggaggtgccagaagctctccggctgtgccagaagaagggagtgtttaaatgaaagttgggcttgaaaatgtgaatcagattcaccctaaaatgttttcttttcttttttttttttttttttgagtcagtctcgctctgtcacccaggctggagtgcagtggcgcgatctcagctcactgcaagctccgcctcccaggttcacaccattctcctgcctcagcctcccaagtagctgggactacaggtgcccgccaccacacctgggtaatttttttttgtatttttagtagagacggggtttcaccatgttagccaggatggtctcgatctcctgacctcgtgatccgcccaccttggcctcccaaagtgctgggattacaagtgtgagccactgcacctggcctgttttcttttcttaatgcctgacttgtaacaataatttctcacattgtgctggagaagtggtgagaacagccagccttgtcttgttcagcatcttaggagggaaggcctcagtctttcatgattaactcctttccaaggaaggaaggaagggagggagggaggcaggaaggaaagggggagggaggaaggaagggagggagggagggagggagggagggagggagggagggaggaaggaaagaagaaagggagggagggagggagggagggagggaggaaaggggggagggagggagggagggagggagggaggaaggaaaggaaggaaggaaaggggggagggagggagggaggaaaggagggagggaggaaggggaggggggaggggagggggaaggggaggagagggttaaaaccataaatactgaaaagaagaaataaaactgtctattggagatgacctaatcgtctatgtagaaactcttaagaaatttacaaaaaagagccctactgaactaataaacaagcttatcaagattgtaagatataatatcattacacaaaaatcaattatattttatataatatcaataaacaacctgaaaattgaaaacaattccatttacaatagcatcaaaaataataaaatagtattaaatataacaagacatgcaatattcgttcactgaaagctacaaaacatcactgagttttcatcagcaaaaaccgcaaacatcgtagaagagcaaaaccaatggagagacatttgtgctctttgaaaggttcaatattatttacatattgtctccacaaattgctgtgattcaatgcaatcactatcaatttttttgtggcaattgcttttgtggcaattgacaaactgaactatttatttacatggacctgaagaatccaaaacaattttgagaaagaacaaagttggagaatggatgccactggatttcagacttcctataaagctacagggatcaagatcatctggtatcagcataaggacagacataaagatcaatggaacagaacttgaaattccaggatgctcacggtctacagtgtaaaatgctgcactttaaggcatcccctgagagcgatttctttctgttaaggactctctcaagtccggcccaccctcggttctatcttgtgccgtctgtccatggctccaatcccttctctgttttgaatcacattaagacagtcatctggggacctgcttcttagaaactctctccagtggctgtaatggaaacctggcagtgataagaaaagaagcaaactagaaggtaatttgtacataaattgcaagtgaaatttatagaggaagaatgtttcctctaacacaacattttacgttgtgtattatgaaaattttcaaacatatgcgaaagcaccaacagttctcagtccccctgcaccctccagcaccctcggtcctcagtcccgctgccctcccccctctagcaccctcggtcctcagtcccaccgccccctccagcaccctcggtcctcagtcctgctgtcctcccctccccagcaccctcggtcctcagtcccactgccctcccccctctagcaccctcggtcctcagtcccaccgccccctccagcaccctcggtcctcagtcctgctgtcctcccctccccagcaccctcggtcctcagtcccgctgccctcccccctctagcaccctcggtcctcagtcccgctgccctcccccctctagcaccctgggtcctcagtcccgctgccctcccccctctagcaccctcggtcctcagtcccgctgccctcccccctctagcacccttggtcctcagtcccgctgccctcccctctccagcaccctcggtcctcagtcccaccgccccctccagcaccctcggtcttttgtcctgcagccccctccagcacactcggtcctcagtcctgctgtcctcccctctccagcaccctcagtcctccatcccaccaccctctccagcaccctcggtcctcagtcctgcagccccctccagcacactcggtcctcagtcctgctgtcctcccctccccagcaccctcagtcctcagtcccgctgtcccctccagcaccctcagtcctcagtcccactgccccctccagcaccctcagtcctcagtcccactgccccctccagcaccgtcagtgcagcaccatctaatctcggtcatacccactagtccctaaaccaggttactttgaaataaatctcaggtatcatactatttcatctccaaatatttcagcatatatctctaaatgataagaatcttctttaagtaatattcaaataagtcatcagttttatgttttggaattatttttaaataaacagaagaaatcctcccttaagttgcatggacaacccacattcagcactaagcctagaggtctcctttaaaaggcattttaagactcatctgatgatttaaagtcaaataagtcctatgcttatttttccaaaatatgtactttttccagctgcaaagaatgcattacaatacgcaatcgcaaatggcctgctgctgtatggccagaacaaatgtgttaggaaaataaatgttagaatgcattagttttttcacttccatgtaatgtaccgagtagacctcaggtgacaactgtgccacagaagagttgggaggtgccagaagctctctggctgcaccagacaaagggaatttttaaatgaaagttgggcttagaaacacgaatcagactcaccctaaaatatgttttcttctcttaatgccagacttctcataacaatttcataaattaaacctgagctgtatgggaaggctcaaacagcaaaacattcaatgccatctctccctgctataattaaaaacacacctggtgaaaattctaagacaaaacgggatccttctaactcagagtcgctagagttaccaccacaatcaaatgcaccctagaagcttttggcggtgtgtgcgcgtgggctcagggctcgtgaccctctgttccggcccacgcttctgaccggtgattagaaagcggcacgttctatcctcggccctgtcagccctgcagggcgcaccagctgctctcacgggccacagaatcacagatgcggtcctcacctctcgggagcggccttctcctagacagcacacgagccatctacgttttcccggttgtctttttcattccaaagtccacatgtgcgctaccacctcctttaaaacataaaaacagaaaagcaaaacgacgaaaaaggtagcagttccctttagccacagtgcagcgcatttgttttcattattcctccgttttactgagagtaatgtgccatccagacaagcccatgggagcggtaaaaagagtcagggaatagtcgattgagctggaacggcccccatgctcacgcaccttatagagcagattcaactggcctgtgtgttaggatgcacggtgcaaactgttctgacggtaatccatcatggaatagcatcttccatgcagatgtactttttgcttatagacaccttgtcttacggagctctctccccacaatgacaagattctgacagtggaggcatcgctttctccgcgtcacatcagcagggcccctccactcacggggactttccacattttgctctttttctctgcctcatgtatcgaaataaaagcaaccgcaaacacatgcctcttctggaatgcgtgctctgtctcaaaacccagcccaaaaggaagaagaggaggaagaggaggaggagggggaggaagaaactggttttccctgttggcctattttatgcagttaaaaacacaccgaagaaaaatcggaggggatgtctacttatggcagtaaggcaggccagacacttggaagggtcctcaccaacaaaaccatccgatcctgcctgagacttggttttcctgccagtattgggcttgaatgaaataagggacttcttcaaggctcccttcgtgacctgaattcagaggagggaaatcccataatgaaatggaaaaggtgaggttgccctgggaggacttgccacatcagagccacctaaaggttgtctgggccaggaggtgagctggggctccaggcccagcagaggaggcaaatgtgctccccactggggtccccagcttgagccagtagtaaacaccaccgggttctcacagagtgacatcaggcaaacctgagctcacggccaaagagcagcaaacacacgcagaggaacgcgtccgtgagcaaaagtcagcacgcacgacccgaacacaaaacagactcagacccgcagaggcaccaaaattagaggttagagctggagaaattgtgcagaatgcataacagaaaaacagggaggcaaaaaatatttgaaagattaagaggaagagattatagaataaggtctaacgaatatctattcatagttctaggaagtgagaccaaaaaggaagagggaaaaatgattaattaaagagatgatgcttgaaaacctgcaagaattgatgagagtcgtgaatacacaataaattccaaacagagtaaataaaaagaaatccacccatagacacatgcaagaaatccacccatagacacttccattgacatgcaagaaaatgtcagaacactgaggccaggcacggtggctcacgcctgtactcccagcatttcgggaggctaaggcgggtggatcacctgaggtcaagggtttgagaccagcctggccaccatggtgaaaccttgtctgtgctaaaaatacaaaaattagctgggcatggtcgcgggcacctgtaatcccagctacctgggaggctgaggcaggaggctaaggttgcagtgagccaagatcgctccattgcactccagtctgggcgacaagagcgaaaactccgtctcaaaaaagaaaaaaaaaaaattcagggcaccgaagacaaacagaagacagatcacctataaagccaacaataagactaacagattttattttcttcttttttttttttgttttggttttattcaagacagagtcttgctctgtcacccaggttggagtccagtggcacagtcttggctcactgcaacctccacctcacaggttcaagccattctcatgccttggcctcccgagtagctaggattacaggagtgtgccattatgcctggctaatttttgtattttcggtagagacaggatttcaccatgtcggccaggctggtcttgaactcctgacctcaggtgatccaccctcctcggcctcccaaaatgttgggattacaggcgtgagccactgtgccatgcccagattttcgacagcaaaaatagaaactggaatccagtggaatcatgtcttctaaaaacaaattgtcattctactgctgtctacccaaaccgtctttccacaatgagagcaaataaaacattctcaaagaaacagaaactgagagttaaactccaataaaactttcctaaaggagttctaaagaatgttctctaagcaggtggaaactaatcccataagggcatgatagacttatgcataacatcgtgtggtgtgtagcatgtattatgcagcgtgtattacgtagcgtgtattacgcagcattacgtagcgtgtattacgtagcgtgtattacacagtgcgtattacgcagcgtgtattacgcagcgtgtattacgtatagattacatattctataactattttagatgtctgttagatatgcattgttttagtagaaccagttcctttacattgagatagatctttttcctaataaattgttactttaaaaaaggaagttataaaatatcagatgaaatgacaaacaaataaattgttaaatatatgttaaatctaaacaaacactgtctataagataataaccacaatatctaacttaggagttttaaaagttatagagctaaaatattgaacaatgttagtttgaaagtctggagaagagtgttctaaggtttatgttgttgagaaggaaactgaagtattaaacttaaatttattatgttagaaatgcaaagtaaaatttcaatggcaatcaccaaaagaacaacaatgaagtgaacacaaatttttaaaatagacaaaaaagcagatctccatagattcccaaaggaaaagtgtgtaacagaggagaaaaaatacatacacacgcacatatatatatagagagagagagagagacagagagagggagggaagacacacacacacaagcaaagttgataaaaccgcaggcgaaattggcaaatgcacttttaaagtgagagattttgacacatctctttagactactgctttttcaattagaaaaaaagtaaacatatagtaaatttgaataacacattcaacaagcttaatttattagatagacatagaatgctgaaccaaatcagaaaataatacacattcctttgaagcaaatattaaccatatactactgggctttatgctaactgcattaaatttcagaataatagtatcatacattttatgttatctaaccatagtgcaattaatttagaaatcaacaatacaaagataaagaaatttcctatacatttggaaattttaagatgtactttgaactaactccttcatcaaagaaaaagattgcgatagaaataaagccatactcgaatgattgactattttgaaacttgtgagaggaagcaaaagtgagatctagtagggcatttatagctctgagatttgattcaaatgaacacaggcttaaaattaatgagctaaacatccaatttaagatgatgaaaaagaacaataatgaatccaaagaaattggcaaattcctagaaaatataatttccaaaagtgaaacatctcattttgagatgagacaggtctaaacagacatttaactatgaaagaaatctaatcagtaaattaaaattttcccacaaagaaataccaagacaagaaaggcttaaagttatatcaaacattttaaaaaggtcatcccacacttataaaaatgctttcaaaaatggaattagagacagaaaagaggaaagcttcccaactcattctataagcccaatacacctttgatttccaattcagcaaggataacacaagagaggaacacaggcgtttctcacttgtaaacatggccataaaaagattaagtcaaatattagctaactacaaatctacttatggaattgggtttatcccagaaatacataactgaatctggttttagaaacagaataatgtatacattacacatatgcaaatatatgtatttccctgtcttaacaaaatgaaagagaaaaaccatatggtcatctcaacagaggcagacaaccatttgatattattctaaaacagtcataaaaatcttttagaagactagggatgaactgaagtttctttaacctgagaaaagacaggccagaaaaacccttagcataaatctttcctgatggagaaatgtcggaaactttccctttaccatctggaataagacaaggagacccactataactgattctgttaatcactgcactatggggctaaactacccacagcaatgcaagaaaagaaagaaaagctacaaaacttggaagggaagcataaaacaatcatcattcataaatgatatgtgtttttaccatggaaactgcaaataatctaccgatatactattagaaataaaagatcttagtaaggtgagtgcgtggcgccagttcatgaaaatccactgcagttctgtaagccagcagcaatcagccggaaaacggcagtttttaaaaagctatcgtgtgcaatagcaacagaaaataaagtaaccaggaataaatacaaaacaaaaatgagcaagtgctatacggagaaaatcataaaaccttattggaggactttgaaatggacctaagcaagtgaaatggtagaccaagttgacagatgggaaaattcaaatcacaaaactgccagttctcctcagagcgacttagattccacacagccctgttaaggccctaacaggttttatcaataaacttgacacattaattctacaagttatgaaacaacaaataccaagaacagccacaaaacttctgaagaaacttctaaagaatcgtggggccctggccctcccagatgtcatgacttacggagctctagcaattccaacagcgcagtagaagccagaatagaaaatctggcctggccggtgcgtggctcacgcctgtcatcccagcactgtgggaggccaaggtgggcggatcacctgaggtcaggagttcgagaccagcctggccaacatggtgaaaccccgtctctactaaaaaatacaaaaaaattagccaggcttggtggcacatgcctgtagtcccagctactcgggaggctgaggcaggagaatcacttgaatgagggaggcagaggttgcagtgaactgagatcacgccactgcactccagcctgggcaacaaagcaagaccctgtctcaaaaaaaaaaaaaaaaaaaaaacagagactggtatatatcagagatgacatcacagatcaaagagaacagaagtttttcaatatatagtgctgggacaattggttattcatatggaaaatgaattggattcctgccttacatcatatatgaaacatccatttcttattaagtaaatggttagctgtgaagggcaaatttcatacattttaaaagtataaaaggaagatatctttaaaatcctcatgttagggaaggcattcttaaaattaacagcttctgttcatcaaagtgtctcagaaagaaaatgaaaaagacaaacacaaaattggtagacaacatgagtaacatataaacaataaaatactttccttcagaagccacagggaactactacaaatcagtaataaaaagacaaacaccccaacagaaaaatgagcaacaaacatgaacaggcatttcacaggaaaaaaaactcaaatggcagataaaaaatagaaaaataagctaaaccatatggtcattaggagactgacaatcagaactacaagttttcattttaacacaggtttttacttggcatggcagagaccaagttggataacatagacttgttgaggatgtggatggaaagtaactcctttgttgctggtgggattataaattaaaacaaccatttcaaaaaattggttgtcacttcattcatctgaacatttgcacactctatgattctgcagtcccctccacacacacaccctcctccacacgcacaccctccggaggctttaactcaggtgcaccaagaatcatacagaatgttcgctgcagtacttcccatgaaagcaactaaatgtccatgtataaagactcaggaacacattctgttacaccaaatgtccatgtataaagatggcatgaacacgttctgttacagccacgtaataggatattatacagcaatcccaatcaacaaaccacagccaaacaaaatcatttagaggaagatgcagatacacaatgattagtgcaacaaccatcactgaagaatatatatgatgctatttttataaacctcagaaacaagccaaactaaacaatatctttgtatgtgtatatatatatatatctttgtatatgtgtgtgtgtgtatatatatatctttgtatgtgtgtgtgtatatatatatatatatatatatatactcatgcaataaaacaccatagaaaaggaacatgatcaacaccaggttgaggctggtggatctgctggtggggaagcaaagggcagagtgggatggggagctctccagcggttgttgtgatgttggtgacaccctggatttcaggtcagctgatgggctcattgtagggttaggcttcatagctcacccaatatgttacacacagtctgctctgtactgtatggggagcctggaagctggaaaccctggagaaaagtggccacactcagcacctggccaggcctgaggacccggggctgtgaaagaagctaggccagggaggctgtgagggatggcaggatggagatggcggccaaggaaacagaggcgggggtcagagaacacgggggttccacactcctccttgagaggtctgagtccaggagggctttgtgatactgagaaaaaggaggcgaggtaaatgacaatggcagtcctctgactccggaccgcgttgttcagttggcctgatcccaagtgaaacagcattgccgtccaccgtgcccttggtccacagaagagcggcaggtgtagctgctccgtgggccagtgggagggtgggatgtctgcgtggggatgaccagacagggccgccctggtctcagctgcagagcctcctggcccagacctcgccctgcacagagaaggccggcaagactgcactccctgctgctctgtccacaaaaggttggcagggaactcccgctgagacagaagagacctgcttttgttttgccccagcctgcagtggctccaagttatgccaaaatgaaaccacgtcagtcacagagagcccacaggtcggcgccagcagcttctttcactcgtgaaagcagcaaggccagcagaggtgataccctgggaggattgagtcttccttccagcaggacactttaacaccctgggcctaatgcaccgattcttacccggtgcttttcactggcgtccttgccattttcccccagcaacgtgcatcccagctgcatctcaggagagacggaggaaggtccgggctcacgcgcatcccagctgcggcccaggtgaggtggaggaaggccctgctcatgttgccctcaccactacctgctgagggagcgagtttctgggagtgatatcttgagcctcttctgcttgatctcctgggagggctcatccgttcaggtccacaggacattttaaagagctccctgtgcgatcgtgaggtatattgaagtttaagaaccactacttcaggaggtttgtgctattataaggccaatattctgctctattttatgttctataaatgtgaattttatactttggattttctaaaagaaggacatgtgttcttatgttgtttatcaatatactaaaaatattagaataaaaacaacacgtggaaatggctgctttaaatgtctaagatgctcaccccaacaaactggcaacggctactgctgcagttccaaaccacggcaataaagtgagtatcacaataaagcaagtcacatgcatcattctggtttcctggtgctttataaaattatgtttacactatactgtagtcttattaactgtgaaataccattatgtcttaaaaaatgcacatgccttaattgaaaactaatttattgctaaaaaatgacgaccgtctgccccttcagtgagtccaaatctcttgctgctggagggtcttacctcagtgctgacagctgctgactgatcagggtggtggcagctgacggctggggtggctgtggcaatttttaaaaataggacagcagcgaactttatcgtgttgatcaactcttgctttcacgagagtgtgatgccgatggacagcgttttacccacagcagagctttgttcagaatcagttaatctgctcacaccctgccgctgctttatcaactcgtttacggaatattctaaattctttgtttcatttcaacaatcttcaccgtgtcttcatcaggagcagatttcatctcaagaaaccactttctttgctcgtccagaagcagcagcccctcgtccgtccaagtttcatcctgagattgcagcagttcagtcccatcttcaggccccgtctaatcgtctaattctagttctcttgctatttccaccacgtctgaagttatttcccccactaaagcctcaaactccccaaagttatccctgagggctggaatcaacttcttctaaacccctgttaatgttgatattttgacgtcctcccataaatcatgaatgttcctaatggcatgtaaaatgatgaattcctttcagaaggttttcaattgactttgcctagattcatcagaggaataaactatagccttagaaaacgtatttctgaaataataagacttgaaagtcagaatcattctggatccttgggctgcggggtggatgtggtgtcagcagcatgaaaacaacattcctctcctgtacgtctccatcagagctcttgggtgaccatgagcaggaatttttctgaaaagaatctctctttctgagcaacaggtctcaagagtggacttagaacatgcggtaagccatgctgtggacagaggtgctgtcatccaggcttcgttgttccgcggatggagcacaggcagaggagatttagcatcattcttaagggccctgggattttcagaatggcaaatgagcactggcttcaacattagcccctagcaagggggtcagcctgtcctttgaagctttgaagccaggcgctgacttctcctctccacctatgaaagtcctagacggcatcttcttccgatagaaggctgtttatctgcatgtaaaatctgttgtttagtgcagcctccttcatcagtggtctcagctgggtcttctggggaacttgctgcagcttctccaccagcagctgaggcttcaccttcacttttatgttacagaaacggcttctttccttcaacctcatgaatgaacttctgctggtttccaacctttcttctttctgaagaaagtggagagaggcagcttcctcgcctctccagccttcatggagttgaagggagttaaggcctccatctagatgaggctgtggcttcagggagtatcacggctggtttgatgttctatctaaaccactgaaattttctctgtattagcaataaggctgttttactttcttatcgtttgtgttcactggagtcgcacttttaatctccttcaagaacttgtcctttgcattcacaattaggctaaccatttggtgtaagaagcctagcttttggcctatctcggcttctgatgtgccttcctcaccaagcttaatcatttctagcttttgatttaaagtgaggtacctggaactcttcctttcagtgaaatgtgtagaggacattgtaaggttattaactggccagattttaatattgttctgtctgaaggaatagggaggctgaggacaggagagagacgggaacgccgggtcaggggagctgtcagaacacaattaattttggtgtctcacgtgggcagttacggtgctccaaaacaattgcagtagtaacatcaaagatcactgatgacagatcaccataggtgataaaaatgaaaaagtttggactgtgaggattaccaaaatgtgacacagagacacgaagtgggcaggagctgttgggaaaacggtgccaaccgacttgttcaaggcagagttgccacaaattcaatttgtgcaaaatgcagtatctttgagcacaataaagtcaaatgcaataagatgcctgtgtatggcaaccagtttgagaactatttcacggcgcactggtaactgactgtacttagaagctgccggttttgacagagctcacctgtgaagtggtgatggctgcctcgccggggcccaggacctgggcgtggccgggagctccctcccggggtctttcttgggctccaggacctgcagagtgtaagctgcagttcggtggacaagcatggccaggacagattgtgctcctggggactgggcgccttcccctagaaaatcagtgatgtaggaaacagctgtattagttgtgagtgacctcagcgagcgtggttctcagcagtcctgtgagaggcaatgctaccctcccatttatatttttaaaaagaataacctggtggggcttttaagcttttgggataaaataaaacaggaaaagaaacagcttttcttgataagaccgatacataccccaggtcttcctccctgaaagtgtgaccattgttgagaggttgaaagagaatggcctgcaccacatccgatgaccgttcagcttccctccttcctgtaaaagcttccacggcatttggcgagactcctccacgtgctatcccgtcctttcactcagtgaaaatgagtgaaaatggctgggaacagaggctcatgcctgtaatccctgcactttgggaggccgaggcgggtggatctcctgaggtcaggagtttgagaccagactggccaacatggtgaaaccccgtctttactaaaaatacaaaaattagccgggcatggtggtgcacacctgggtgtaatcccagctacccaggagactgaggcaggagactcacttgaacccgaggggcagaggttgcagtgagccaagatcacgccagtgcactccagcctgagtgacaagagagagactccatctcaaaaaaaagaaaaaaaactcaaaaacctagttgtaaaatgtaaatttgaaggcacctgtagtattgtaacatagactgtttctcacaggttaattttggtggaggcataaaagtcattagaatcaaaatgaaggcacttgtgttagaaaaacaaacaaacaaaaagcccccacgaatggagccagtgaacgccgtgaagggagtgttcccacatccatcgaataacaaaaaatatgatagaagacgctgcaaaacccaaaaccttgcacaaagaccagcacaaccttacacaaaaaatacttctgcaaggatgtctgcccagcacctgcctgtccaaccttggactggcatcacccttgctattgatctttgtagcccggaataattctttcaaactaattctgtcatcctccgaattttccctttagaaccctttgtcttcctttacccgaatatgcacgtaatttactgtggcatgtgtattcccatttcaatgttctattcttgaataagttacttcttctttgagtgagcctctctctgttacttcgactgatacatatggtgtcagaaatgggactaggaaaatatcaccatcggaagaaatcatttttactcccattttttggagccgttgtgcagtatttactccagctgtttgagttcttcatttccacagcttgatttttcaccctggcgagtcctttctcaggctgagcctttctctttgtgctggaggctttttgatgctactcagaatgtgacttggatgaggctgccttgataaaggaccacacatccagcccgagatgataaacagcctttttgtcttttctgctaagtcctttctggtacaaaggcataaatctttctgggttgaatgctctgatttgtacagaattaacattctctctgtaaggcatgtgtttacttgtgaattcacttttgatctgcatgcctggtttaacattttgttctatgtggacacctaggttaaaatttttgtgaacactcttaccttggttccttttgacttgatttgagtctttccccttgatggtttttaaaaatcttctgagaacaaaaataaacattctaaatggtgagtgcagaattgctaactaaaggccatcagggcagccaccgccatctcaaacatggtctaaactcctgacattccctggctggatttgcagattttctttgctctcaagagattaataagaattgaatgagattctaacacattaaggtatgcctggtgtgctgggattccagccagttacatattgtggcccattctcatgcacattttttaagtgattggcaaaatgacaccaaggaaaattcagagctcaatggccattatttgaactctctaaaaaagcaaccctctcaaaaaaacaaccttggggcaatagagttaacatggagtcttctaaggtctgtatctctcccccaactttttttttttttttttttttttttttgcctattttgaattttctgactcttctgctgggttgagatgaaactcactgcttatggcattctagccaagatttttttcaaagtcttaaagggctttcaaattaacggctttagaaattccgacagctccatggtaaccaacaacctagacaccttttagagacatcaatttaggtttgactgactaacaattgcttatggtgatggagcactaaattgaaaaattaataatctaaaagaaaaggaactacatattcataaatgtttataaaagttaggctctcagattacagaggtcaaaagctggagcacagagcaataatgtaaggtatctctgtccagcataaaaattgtattactttttctgccatgcagagtccaaaaagaaaaagccaaaaacaaaataaaaccaaaaccctgctgcaatgcttcctgcccacatctctaaccaagcaaacaagaccagcaaccaaaagacatttgctgctagttcaagtcttcttggagattcttatacaatgcagtcaatcctagctaaaatgtttttttttcttttatagatagatatagatctagatacacatacagatacagatatatagatagatatagatatagatatagatatatagatacagggtcttgctctgttacccagcctagagtacagtgttacaatcatggctcactgcagtcttgacctcccgggctcaagtgatcctcctgcctcagcttcccaagtaggtgggactacagacatgcaccaccagacatgactagttttgttgtcgttttatagagatggggtttcaatctattgcccaggctggtgtagaactcctgagctcaagtaattcacctgccttaattcacctgcctcagactccaaaagggtttggattacaggcataagccaccatgcctggcccacctagctaaaatgtaaacagttgaaaatttagccctaacctcatttgaaaatgaaaaaaaaaaaaaaagaaagaagtgggtgggggtagaaatggcgtttttcatttttatttttaaactgcatggaaactgtttacccaaaattttggtccagagccttcattagatttcctaccagggtaagtagcacaaaaccaaaaatcttggtcccctattgtattagtccattctcgcactgctataaagatactacctgagactgggtaatttgtaaagaaataaggtttaagtgactcacagttcctcatggctggagaggcctcaggaaacttacagtcatggcagaggggaagaggcatgtcttacatggtggcaggtgagagagagaagcaagagcagggaaactgcctgataaaaccatcagagctcctgagaatgcactcactatcacaagaatagcacggggaaaactgcctccatgatccaaccacctcccaccgggttcttccctcaacatgtgggattatagggattataattggagtagagatttgggtggggacacagagccaaaccatatcacctagggattacaactggagtggagatttgggtggggacacaaagccaaaccatatcacctagggattacaaatggagtggagatttgggtggggacacagagccaaaccatatcacctatgttagaacaaggttttcttaaagtattgatttgcccttaggaaaattgcaagaggttttgatgtttaatcctgaaatgtttctttttttcccattttttgtagagatgggggggtcttcctatgttgcccaggctagtctcgaactcctgggctcaagcaatcctcctgccttggcctcccagagtgctgggattacaggcatgagccactggcctggccggcttttcctgatgtgtctggattattctgtgtaaccaagaaaattcctgtgctgttactaagagtcatgtaattccctgctccaggcactcctttgcttgtttacagtcctctatgataaagtgaacactcataaccctggacgcactcttcctgtgtctaattaaattcaagtacccttttcttcaggtttgacttctgggttatctaaggagaagcaatcatacagcaggaggttcttctttactttttgtaactagcctaaacacaagacatttttacattttatcaagttagatttgtttttttattaagtttttgattactcaagcggaaaactgagctttaaatgggttaaggcttttacattcatgtaactttccgtatttgcttttgaagtattttaactatcactctgcttaaatgaatgattaatattttacatgacttgtaatttttttttttttttgagacaggagtctcactctgttgcccaggctggagtgcagtggtgcaatctcagctcactgcaactgccaccttccagatttaagcgattctcctgcctcaatctccctagtagctaggattacaggcacctgccacaacgcctggctaatttctgtgtttttagtggagacagggtttcaccatgttggccaagctggtcttgaactcctgacctcaagtgatccacctgcctcaacctcccaaagtgctggaattacaggcacgagccaccacgcctggccctgtgattctgttttgatcaagtgttttatactttttgatatattttgtaggcttcccaaatatcagaataccaaattaagtctttttgacctagaactaacttttggattttctatttgtgctcctgaagagactcaaaacatgtatctctcgtcttgttgagacattaaataatcaggcttatttggtaaattgtagggaagcattgtcaaattataagtgatactagatcttctttcagatacatttatcggtatgttgttgatatgtttcaaaaattatgtaaactcatagaaatctaatatgttatctgtcataattttcgttgttatattacattttttctgaagctatatttgtatgactatgttattaatgcattctaaagatgatgtgaaatttataagtttcatggtcctggtatcagtccagctgtcagtcatgattccggttgttatcttaaaatgccatatgttggccgggcacagtggctcacgcctgtaatcacagcactttgggaggctgaggcgggtggatcacgaggtcaggagattgagaccatcctggctaacatgttgaaaaccccatctctactaaaaacacaaaaaaactagccgggcatggtggcgggtgcctgtagtcccagctactcgggaggctgaggcaggagaatggcgtgaacccaggaggtggagcttgcagtgagccaagatcgtgccactgcactccagcctggatgacagagggaaactctgccaaaaaaaagaaaaaaaaagccatatgttgtatgtaagtaactaaatttccttgataattaggaattttcatcagatttttaaccacggccattctaagcatttgggcttctctcgttattattttcgattattccctaaaagtatttgcaatcaactacagtcccaaattgcctttcataaaaagacttgcaagaactcttggacacagatttctgataactttaagatcatgaacggaaaaagaatttccagaactctgatgaagaaactgacgggtccatgacactgctaaccaagatcaagcaaaacaaaatactaattatatgaaatttaaaaattaacacgttttaatgacttttatttgaaacattgtaagttctttacctacatgttttattttccagatttaagaaaattgtctctcaaaagctgtctatagtttacaacaatttggtatagtttagtgaacaaaggtggaggcatttgattttactgtttacttgattgttccaaaatttggaaactattcatgtatagtcctagttttaagtacaatataattatttatataagttcaacaaaaatctattctctctttacagcaggatacaattggaaacattgattatagtacagaggttttgactgaatatcatatttgaaggtatccatagaaagcctggttttaagactttccagccttacaatcagtaaataaaaattgtaatttcctggcaggcccaggaacattcaggttgtaagtacaatcgaagatctgcccaggtttggctttctagcctcaaaaggtttttaaatctgataacctacgtcatcagtgtagggagaaaaagttatgtttctaaagaaaaactatcatacccttgttattagactgtagctctgagccttgttttcgagttcttgttatctacctgtagaatgggctagatcctgaattctcctaattttcttcattgtttggttataattctccaactaaaaactaaaactgcttctcttctaaagccctgtaagatgaacctaaacacattttaagaaacaagcctcatgcctgatgtatggtccacacataaggttcaccaaactgcttgatgccacaaccagagatattcaagctgcaaactgggaggaaaagttgatgttttcatgttgtaaacagttttccctggacattggaacaagactccatatcataaggagactctaactcaactcctcttaatgtctatccttttcacttgacaggataataatgaaattgaaatttcacaatcagtagcttctgctggtaacttaacagaacgtaacctttaaaaatcttttagtaacacccgtaatcccagcactttgggaggccgaggcgggtggatcacctgaggtaaggagttcgagaccagcctggtcaacatggtgaaaccccgtctctactaaaaaataccaaaaattagctgggtgcagtggtggatgcctgtaatcccagctactcaggaggctgagacaggaaaatcgcttgaacccgggaggcggaggttgcagtgagctgagatcacaccactgcactccagcctgggtgacaagagtgaaactccgtctcaaaaaaaaaaaaaaaaaatcctttagtattcattggttaaataagaaaatgcctgtgcatttcttattgtggtacctggataaattcctctgggaaagttgagacccatatacacaaaagaagaaaacaggccacatcattcaagtcttacctaattccctatggtcattgattcattcgtctttaagcctaccaagttcatggatgcaaactgggattgtcacattactattaattttactttttatttcccctttttaaactttgtatctgttacttgtcattttttttccatctaggatacataggaataaagataatttttttgagataggatattgctatgttgtccaggctggccttgaactcctggactcaaacagtcttcccacctcaggctcctgagtagctgggactataggcatgagccaccatgcctggttacttgttaactgatctgcagaagtacaactcctaataacataatgctggcccagcactttcagatgatagcaaaagatcatggaaaagacaaaactgcacttaacaatgcactccaggtagacttatccagggagccactcccttcaaacctcccttgctgctcagatgtggctaaaagggttttgacactggatcctagtcaccaatcattcccctcaaagtggggtgagaccaccaacgatgacaggtccatcccagcacggagaggcatcaaaacgcaaccacaggttgattgatcagtgaggcttttaaagaaagatcttgatcagaagaggaaatgtgaaaattgtcagagtcaaaaaagggtcactagtgttaaagaaaaaaaagtcagaaaagattcactagtttaaagaaaaacaaacaagcaaacaaacaaaaactcctgacaaatagagtcagggaaggccttgaagagagggttctcatgcttgtatattgataacaaaaatgatgacaaaacccaaaaccttgcaccaaggctatcacaaccttacacaaaaggtgctttggcaagaacacctgcccagcaattgcctgtccagccccagactggatcgtccttgttaccgatctctgtactgaggacaattatctcagaataattatgtgattccttccctgtctgaatatgcagcgtttactgtggaacgcatattcccattgcagtgctctatctttaggttgacagaagcattaggttttctcatctgtgcctcatctagtgagctttgaggttcaacaaacatttttgcatcatgatactgtgctctcacagtaggcatcaacttatgggagggtcacccaaaacttcttcagtgagaaatgtggtttacattttgtatcagttttgtagagatatagtttacaaatcatcaaatttaaagcatgcaattcaattgttttaatacatgtcctgggttatggaatcgtcaccgtaatccagtctcagaatattttaatctccccccaaagaaaccccgtacccttagcagtcacccctcgtttcccatgcacctgctaactccctcagccctgagcaagtgctggtctatattttgtccctatagacctgcctcttctggacacttcatataaatataatcgtacagtatgtggtcttttgtgcctggcttatttcacttagcatgatgtttgcaaggttcatccatgttgtaccatgtatccgaacttcattttttatggccaaataatattccatttcatggacataccaattttgtttatccattaatcatttgctgaacgtttaggtcatttccaccttttagctattgcgaaaagtgccgctatgaatatttaggtacaagttttcatatggacatatattttcaattctcctgggcatacacttaggaattctgggtcataagacaacttgatgtttaacattttgaggccaaatgttgtccaaggttgctgcaccattttacattcctgctggcaacttatgagggtcccaatttctccacagaatcacctgttatttttattttaatacactttattttttggagtatttttaggtttagggaaaaaatgcacagagagtacaaagaattcccacatactcttccatcccctcacccccagtttctgcaattgttaacatcttgcattagtgtggtccatttgttacaggatgacccaatataatcacattactatttttatcgtttttattattatagccatctgtcttagtccattttgctttgctataacagaatatcagagactggggaatttataaataaaagaaatgtatttgacccaggattctggaggtggaaaaatccaagatccaggggccacaactgctgagggtccaacagtgtgtgtgagaacaagagcaagaggctgagggtccaacagtgtgtgtgaaaacaagagcaagaggctgagggtccaacagtgtgtgtgaaaacaagagcaagagaaggccaagctccctttcatcaggaactcaagtccgtaatcacgaacccactcctttgataacagcatcagccattcacgaaggcagggctgtcacagcctaatcacctcttataggccacacctctcaacacagttgtactggggatcaggtttccaacacatgaactttgtgggacacactcaagccatagcaccatcctgacaggtatgaggtggtttctcattgtggttttgatttgcagatccctgactgatatggtttggctgtgtccccacccaaatctcaccttgaattgtagctcccataattcccacgtcatgggagggacccggtgggaggtaactgaatcatgggggtgggaattccgtgtgctgttctcaggatagtgaataagtctcacaagatctgatggtttgataaagggcagttcccctgcatacgttctcttgcccgccgccatgtaagtcgtgactttgctcctcctttgccttctgccatgattgtgaggcctccccagccctgtggaactgagtcaattaaacctctttcctttataaattacgcagtctcaggtatgtattcattagcagcatgagaacagactaatacattgacctttaaagacactgaacatcttgtcatgtgttcactggtcatttacatattgtcagcaccatttgttgaaaacacttttcttttgcccaataagatgtcttcacatccttgaaaatcagttgaccataaatatgagggtttacttctggactctaaattctatttagactggaattctattccactgatctacatttctatcctgatgtcagtaccacattgtcttgattactgcagctttgtagggaattctgagtactctaaataatttttcaagattctttctgctatcctgggtccctttcatttttatgaattttaggatcagcttgtcaacttctgcataaaagtcagctgggattttgaaaaggattgtattgactctatagatcgatttgggaaatatttccttcttaacaatattaagtcttctgatccataaacatgagatatctttcaatctatttaaatcttctttattttctttcaacaatgctttgcagttttcagtgttcacatcttgaacttcttaagtctattcctgagtattttattctttttggtgctattataaacggaattgtttgcttattttggctttctcattgctggtatatagaaacacaatttatatcctgcaacattgctaaacatggtttttctaaggtttttaaaatgaattccagccgggcgcggtggctcatgcctgtaatcccagcactttgggaggccaaggtgggcagatcacctgaggtcaggagttgcagaccagcctggccaacatggtgaaaccctgtctctaccaaaaatacaaaaattagccaggtgtggtggcgggtgcctgtaatcccagctactcgggaggctgaggcaggagaattgcttgaacccaggaggtagaggttacagtgagctgagaacgcgccactgcactccagcctgggtaacaagagcaaaactcgtctcaaaaaaaaaagattccataggttgtttgtttgtttgttttgtagagatggggtctcactgtgttgccctggctggccttgaactcctgggctcaagcagtcctctcaccttggcctcccaaagcactgggatcataggtgtgagccattgtgccctgccataggctttttttacataaaagattaagccatcttcaacaatctctagagattgttttatacctttcttttgaattggatgctttttttcttgactaactgccctggctagagccttctgtacacaattacctagaaggggcaagccgctcttgttttattcctgattttaggcgaaggcctcccatcttcaagcattgagtctgatgtcagctacaggttttttgtagaggctgtttatcaagctaaagaaatttccttccattcctcgtatgttgagactgaaattcagcagacagctggcacactgactgaagttcaaagctcggaacctgaacgtgagcctgagtgaggcagctccctgagggggcagaactgttgccttatgtgacagctagtgggtatggaggaatgaaaggagcctccactccttgctgccctgatctggctcctgacattttccttcaaatggcatcaggaccaggggccagctgggctctgtgaaacgcaggaagcagggagctgcgtccacccgccagcctgccctcacctccctagagccttgccttctctgtactgcacacttaggcacggtgagcccagcccaaggcatcattctcacctgcccctgaagtcagaccagtctagcggcctccgtccccttcctgccagtcctcttgtaaggagggcaaaaataaaacaccaaacaaaacatcaactatattctgtatttcctacattattcagataaattgtatttatcgaaaaagctgtcccgtttcgttttgacggccctggagtacggccccttcatcagctgagatcacaaagacgtctagcggaggtaacgggagcagggtctgcagtcagccacctggcttccagatgccagtcctgcccgctcctggctgtgcagctgagcacccaaacctccgcaggcctcgctttcctctcttatctgtaagctggaaaccgtagctacctcagtgagtcatggtgcagatgaaatgagaccaggctctgcaatgcacttggtacagcagctggcaaagtgtcatctgcccccgacaataagcaccatccttgcctctgcagagatgcttagcaaggtaagtgggttctcagtgttaagattcacagtgtaaccaacatctaaagctgttcatgattttggcctgaatgggaagttaggaagaactcacaaagaaatcacaaaggaaagtaaaaaaaggaaaaaagaaagtcatcaaggggagtaaaaactggttaacatttcattttcttttcttttttggcctagagattattaacttttagaaacaggtgtcacaggcaatggtctttaaagagcatctaaatagacctggaatttgcttttttaaatgtacttaattcccattacctctgtgcttctcaagcaattctggttcacattatgaaatgagtacattctcagattatttagttcagaaatcggaatatttattctattatgccacaaattaagcagaactctgcaaagtgatctctaaaaataagtctgaaaaataatcatctaattccagtagaggcctcttacactttttaaatgttaactccaggccgggtgtggtggctcacgcctgttatcccagcactttgggaggccaagatgcgtggatcacttgaacccaggagtttgagaccagcctggccaacatggtgaaatcccatctctactgaaaatacaaaaattagccgggcatggtggtgggtgcccgtagtcccatctattcaggaggctgaggcaggagaactgcttgaacccgagagatgggggttgcagtgagccgagattgcaccaccgcactccaccctgggcaacagagcaagattccatctcaataaaaaataataatacattttaattgtggttaaaaaatacataaaatttaccatattaactgtttttaagtgtacactttagtagcattgtttattcatattggtctgaattttttttatcttgcaaaactaaaactctgtacccatcaaacaactgcccaccctgcccccagccctggtaactaccattttgttttctgtttctataaatttgactttaggcatctcacagaaggggaataagacggtattgcacagccaagatcatgccactgcactccagcttggcaacagagcaagactctgtctcaaaagaaaaaaaaaaaaagacagtatttgccttttcgcagctggcttatttcacttggcatagtttcttcaaggttcacccatgttgtagcatgggtcagaatttcattcctttttttttttggagatggagtcttgctctgtcgccaaggctggagtgcagtggcgcgatctcggctcaccgcaagctccgcctcccagttcacaccattctcctgcctcagcctccggagtagctgggactacaggtgcccaccaccacacccggctaattctttgtatttttagtagagatggggtttcaccatgttagccaggatggtctcgatctcctgacctcgtgatccacccacctcggcctcccaaagtgctgggattacaggcatgagacactgtgcctggccttcattcctttttaaggcttaataatatcccatctcacaggccacctggcttgtccattcatctgttgattgacgctatgttgtttctgcctcttggctactgtgaacagtgcagctgtgaacatggtgtgcaagtggctctttagactttgctttcaattctttgggtaaatacgtacaggtgggattcctggatcacatgctaactctgaggaaaacctccatgctgttttcatcacagccatcctaactccatgctgtttttcatcatagccatcctcatgagtatggagtgatcatctcattgtgactgtggttcgcatttctctaatggtcagtgattttgagcatcttttcatgtgcctactggtcatctgtaaatacgactgtcccttggtatctgtgggggactggttccagaacctcccacggaccaaaatctaaggatgttgggagtatttgcctgtaacctatgcacaccctcctgcatcctttaaatcgtcactagattacttataatagctaatgcaaagtaaatgctatgtaaatagttgttacactatattgtttagagaacaatgagaaggaaagtctgtacatgttcagcatgggcacatttttttaataaaaatattttcaatccctggctggttacatccagggatgcaaaacccatcgatagagtgctgactgtatatcctcttcagagaagtgtctgttgaagtcccttgctcatttttaaatgaggtgacttgttttactgttgagtggtggttgtctatatattccagatattaaccccttatcagatatatgatttgcagatattttctcacattccacaggttaccttttccctgcacagaagggaaaggttgattgtgtccttcgatgcacagaagtttctaagcctgatgtcgtcttagttttacttttgttgcccgtgtctttggtgtcatatccaataaatcactgctaaatccaatgtcataaatttttcccgttttcttctagaaattgtatacctttatttcttgtttagtctttaatccactgagttttcacataaggtgtcagataagggtcttgggggccacatgttggcctgtgcaacagttaaagggccccaagcatagtcacatacgtgcagatgatgttcacacacagatacccaggcccaggagatcttggactccccaaggccatattctattcctacaactgctgtccttccccttaacctccttttgttctggccttgctagcacagacccttgcatgctaatcaaatgacacagttgagtttggaggaaacatacatcagtgaggaaaagtgaccacagaatccttccaggtttcaccaaaaccacccgtgacgtagataaaactagaattctggggactgggattcctccttttcccctgagccactacgtaaaggtgactgcattacagtcccatacctcttatctgtggccccagtatccattttttttaagacagggtctcgctctgttgctcagactggaggacagtggtgcaatcacagctcactgcagccttgacctcctaggctcaatggatcctcccacctcagcctcctgagtagctgggactccagacaggtgcacaccaccacactcagctaattttttgtagaaatgaggtctcactatgttgcccaggttggtcttgaactcccgggctcaagtgatccacctgtctcagcctctcaaagtgctgggattacaggcatgagtcacagtgcctggcccaaattcatagtcctaaacatggaaagttttgtgtacttcatttggcggaaagtctaacctgatttggcacgagacgacccatgatccttttcgtcctgcttgtattttgctgcaggaatatcagtttgatgagggtgttgccccaggccccaagtggaatatgcacacgtcactttcctaaaatcagaacaattcagagttctgaaacacacgaaacacagctgtttctaagattcttgactaagaggttgtggcttatgctatttttcctgactgtggcctcactttcttcccaataaatgtttcaatctgttgatactaatgttttttctcatgatacttgtaagataactgattttaacaaaaggtggcacacctattaaagacatggttaagtttcattggctgtatagcatctctaattggaagactacatggcatctatccaggttggagttgtaatcacctagggatgtctacatctgtctacctagatcagtctgtcagttccatcgaggtctgtatttcaaagtccatacataacacacggttcttcccattttacagaattattttttcaaaccaaagttcacatactgctggtgggaacaggttcaaatagggaatgctgatacatatcaacaacctttgagacaaacctgttcacacagtgagtgtggagcccttggcccccctactttctctctcgcaggccccgacatcaccctgggcttgcgctgttggtagtgttcaaaggaaaactttagaaacattaaattttacagagtttaattgagcaaagaatgattcaggaatcagggaacccctcaaaccagaataggctcagagagactccagtgccactgtgtggccaaagacttacggacagaaaagggagtgaggcacagaaggcagaggtgaggcctgcaaacagcagggtggctacagctcgtgtctggcttattgaaacagagtttgaagtgctgctgcctgtgactgattcaagagtaggttacagtgtccacacatccaattagatgactgttcactacgtatggagaaacctataggctaaacttacagtatgtaaggaggcggcttcaggctacagctgagtagtgtgtccttacagttggaaccaggagttcatgggaattcttcatcatccagtggtctgtaaatgttgcccatgctgagtagtctgtccttacagtgtgaaccaggggttcatgggaattcttcaccatccagtagtctgtaaatgttgcccatgctgagtagtgtgtccttacagtgtgaaccaggggttcatgggaattcttcaccatccagtggtctgtaaatgttgcccatgctttagttttgttacctggttgctctgtttttatgggattgtgagaaactgaaaaactgtgactgctggagccattttcccacaatccccattttttaaaaatcccataaaggctctctcgtgagcaccgcacgttttcccttgtagtcacgagggtaggggctggagaaagcagcagagatagtcaaaaacccacagctacaaaaaatgcactcctaagagcaagtaatggcgagggctaaaaggcactgtgccccttctgggccattctaattaccacatttaaatggttttgagaaaagagaatttttatctgaggaacgcgagttcttttaattatcaggccgagagagacattcaaatgaggcgacaatcgcgccctactaccccttgacctgtgttcacctctttaaactgctactggtggcaacagcgccacaaacagctataaattaacctaatgacgccacaatggacactatacccacactcaatagctgaacaacatatagtcagtcactaatcaatgttatttctgtaaaccagtgagaattcctcacaaacaagttcctattagtccactccctggcccccttttttgcctttaaaatccactgttaactgctaatcggagtacacattcagggcgccttgaatttgtgctcaagtgtggcccaaataaactctctacttagagaaactgtgtctccgctcgttttcaggccgacagtttccaaaatgttagtattcagcctaacatgagaaaagtcaccatataaaagtgaggggggaaaagcaaatacaggataatctcaattgtatataaaatttatatacgtaaggacaaagatacatagtaaaaaaaaaattctggcaggtattaaggctgaaaaaattaaaacagtccagagcggtctggctcaggccagcctgggcctgccgagtagctgggacctcagccaccgcgcctggctaagtattaatgaatctgttttagagatagggtcttgctacgttgcgcaggctggtctccaactcccaggctcaggtgatccgcccgccacagcctcccgaagtgctgagcctcccaaagtgctgagactacaggcctggccgcccgcccgccagcttaattcacgtaaattccagacaaacgtagaaagtggctcctttagtaagccacttgcggctgctgctcatcagggttcgcctggggccactgagaccacgcgccggtgcccgccctcccgctgcggtccgattttctgaaccaaccaggcgcttccgggcgccttgccccagacgggcccaccgcctgcgcgggccgagggcggcgcacctgcccctgcgcttccgcatcgaaggtgaggtcggaggaagagaagaccgcaacccccaagctcccgcggcgtggggtccggggggggacacgaggcggggccaccaggacgccgacagcctcacgtctctgggcccgcggcgcgcaaggcatgccgggacccgtagtcccgcgacgttgcgactcacagtgcgcgatgggagtggaggagagcggctcgcggtgcatgccggaactcgtagtctcgggatgctgggtctcagcgcgtgatggggtaatggcacgcaggcctgcgttgaacgctgggactcgtagtcccgccatgctctgtccgcggtgcacgccgggatacgtagttccgagcgcgccaagaccgtcactgggactgggcgacagcggcccgcgttgcatgccgctgctccacggtgccggcgctccgaggaaaagtaggtagggctcaggaacgcagttcttcacggccggcacgcagggttggtcccaggacggagccggctccggccccgcgcggcgctcgtatttacacgcgcacgtacgcacgtacgcggcgcccttgcgtgacgtcacgcgccctccaggaagtcggcgcgggctaggcgacgggtggaagccggtaccgagaggaactacagcgtcgccgcctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtcctccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccagggtgagtgtgctgagccgggcggggccgagggcgggcggctccggggagggatcctggaggacccccgggctgctgcgtccgcggtgggcaggggcgcccctggtgagggagcgataaagcgggacgcaggcactgcgcttctcccctaaaactggatagtcaccacctgtggttttaccaacggggagcattttgagataaaaggaaagggtcctgcgtagcgacacgaagttactgtttggaaaagctatgtttgtttctttctttctgcagtgatagtccccgccccttcctttagctccacctttgtgacttaggaaaactcatgggtggctgtgagcacaagagtcatcaggcaggctccagacctgttattgaaatataaactgttgggtgtgtgcacatctttaaatttttgtaaactttgtgaaacgcagttgtaaaacctggtgcagttctgtttcgtggctaaggaacgggcggaacccaggcctgcagcgaaggcagtagccccgtggttgaccacagtgggcattgtcgcaggctgcttcagggtgacgtgggcgttgtgacagactccacagctctcagtagctgtgctctgaccccagaaggggatatgtttccgtagcaccgaagtgtccagccatgtttgaatctacccttgtgttctgggatgggcgggcaagtggacacgcgtgtgcgcctggctctggtagttttgattgtgagaacagaaactccagggagaggtggacactccagcccgcagtgggccgggcgtgagctccctctgggaaaggtgccgctccttctggggatgccactctcttccctcctcggcagccgcggctcctcgtccctttggcttgccctgaccctgtgtttgttgaggatcttctctgcatctggttccgcaagagtgaggactgggacaggagtcttcccgtcacagccccagaacgtcctggctccgcttcctttggagacagagcctgggtccttgaccctcggcacgggcactcactcctgccccctgcgtgctggtgggtggggctgggaggttcagggccttgcctcccagaaaatgccttcacggcttcctcagtgggcactggccgtacctgggaggattgtggaggcagatcccaatgctggtgtattccctggacagaaaaccccaggatggaagatccctactgaggtttcattctgttcctctgattgtacagaaagggctgctttggcctagacaggtgagtaacttggttatgtggcaagttagtattgaaattccatgttcagtcagtctagtgaataaaaccaacccagtgcatcagtcagtcagccagccaggtcatgagcttgatgacgggttcccagcagtcagtagtgtttacagggaggtgctgtttgagatcttggggtacctcacagggccctttgagacactgatgtgatatcatttctcctcagatggagcgtctgtgtggcaccaggtgtccctctggttccaggaggctcatctctctgcctccagtccatgggcggcaggtaaatccttgccttagagaaagccacagacggtgctgcctggaatttgaggtggcttcttccccgtttctgtgtactcctgtgggtttgtgtacatgggttttatgagcgttctggggagtgtggtggtggtggtgtgacgtcagcatttccggaggtgttcctgcccgtgcagtgggcgtgggtgccatagatccaggaaggagcgactggaagggctttagtctaaagccctgtgtgcatgtgccctggcagttctggtcgtctgtttggaatcaggttcctgcctcgcagttgcattagccagctgaattcgggaggtgcatttgcagcaggagtccatgctgctgacggtcggctccgtgtggtccagatgacactgccctggctctggggggctgccgttgggagccggtatgtgttggcctccccaaaatgcctgctgcacctttgtggaacacagttgaaaattactagattcagtcacttgttgacagattttgtgaacagggtgggttacaagtgcgtttctctggcagcacccctgtgatgggagtagcgccctgcagtgtggacttgtggtggctttgctgacgtctctccatagagagttgcaggtagaaatctccgcagcttttgcttaaagccaacagtgatggatttctccaggacgttgagttccagctcagcagctctttatacacaatttacagctaaccctcgaacaacttgctttggtctgcgagggccacctttatgtagatgtttttcagtaaatcgtctgctgttcgcatccatgggttccacgcccaacactgtttgctgggtgtggagcccagcctgtttatacagagcgctgactttctggatcagtgggttctccaggttgactgcgggacctgagtatctgtggatgtggaatttggtatctgaaggagtcctgcagcccgtcccccgtgagaatgagggactgattaaatatggaagtctttccataatagattgtgccgctttgtgatgaagtagagaatattgggcataattccatcctgatgttggaaggtgataggtgtgagtttagttctcatccctgcgacgcctctgggacgtcggttggtgaagagcatctgccttcctctagagagcctgagtcactttcacttaaaaggtttttcctctgtttttctttttttctctgattgctggtgtggtcatttccagcaacagctccgcggttctcttctgcggtgtcccaccacttggaggctggaaggtgaagacatcagggaagaggaactgccttcaaccgtcattgactctgctcaccagcccaggtgtttgatttttactaagcaagttcccagaattgcacgtgggctgttttataattgacttatcttgaccacctctaaaagttctcttgaagttacagattcctgagatctttatctgggagagcaagcatttggttgaagtttgctttaaatgtttatagactgattatcgtgtattgatccttagagtacccctttcagattatgcaaataacacgcacttgtatagacaagcatgggcagaatccacaactgcttttgtggaggctccaaccctggcttcagctcatctgcgtgtgagggcaggggaggtgcagaatctgctcctgggcttgtgctgaaaggaggtcccttttaacagggacctcccagcaccaatggaaccccgtggctcttggtgagagagagcaggtcctgcccagctgatggatcagaaactcaggtgtcagaaacggggtttcagggcggctgcctgaggaatgcgcaggcgatctgacgttggaattctggcttgggcgaagcccttgatgtggccacacagttttggtccctcaagggcttactggttgcctgcgtgccctggtggctccttggtgaggggcctttggagaaagtcttgggaaatcagatttcccgagggtgttgttgaggacattgctgacgaggtgtgggatttacggggaggacagcctgtctcttgaggcttggtcgctgtgttcaccctgcaggtgttatgaattagcttctggcccaggacggttttgggaccggggggtgcctacccactgttgttcctttatcttgatcctttcacagggcttataaaaatacttatttttcaggaataacgggaagtatctttgaaaacatagcattaaatctgctgaactggagcttgcagagagcagacagcggcagcagcctgagtgtgctaagctcaagcgtcgcttgtgtgccatcaccttagtgaaggtggctcttgaccccactggccgccggctgcttgacagtaacttgtttagctgagactgtgtttgagaaactgagaggtgtggatgttgcttgtacatgtgcagccagcatgctcacagtgccgaggagcagactacgcgctgctccagagcgtagattagaacgtcagtctaaacagttctttatagcatggaattttaacaaagaaagaagaatcccacgtgggtatgtgtgagtgagccttgtgtagcttagtgtcggttactgaggcggagcactgcggagagaggtaatggaacctgtggccctgtgaaacctccctctataaatagcaggtgtgagtgaacctgtgaaaagcaccagcaccagccaggcagggtgggtccgtgccctcgttgcctgcattgttgtcaccaggcaaggtgggtccctgctcttgttaccttcattgttgtcaccaggcaaggtgggtccgtgccctcgttgcctgcgttgttgtcaccaggcaaggtgggtccgtgccctcgttgcctgcattgttgttaccagcaacatttatcctaaccacatcagtggttatttttagacaaagaaccattctgggaacttaaaaacactgcatttgggtgaagttacaatagtcactagattgtcgttttgatctttaataagattgtatgtttttgtcgggcttcatcctatctggcagaagtaagaacctcctcactccattggaaagaaactgaggttccaagaagtttggacctgccctgccccttacagggtgtgaggtcctggtgaggaggacggtgcagggacctcgtggtctctactcccggtttctctgcggtgctccttacggggtgtgaggtcctggtgaggaggacggtgcagggacctcgtggtctctactcccagtttctctgcggtgctccttacggggtgtgaggtcctggtgaggaggacggtgcagatgcctcgtggtgtgctcaggcccttgagagagcctctgtccttggttctctgcgtgctgctctctgtagaccaggtttcagccctggagattcctagtgtggggggagtagctagaacaatagtgtttgtctgcttttataatatttatgtggagtacaattattttaatagaaaatattctgacaggtcaccatctttcagaaactaagtcttttttttcctgcagatttctttgctttggctttttcccagtcactcacagggaggtatttaaatcgccacagaaaggggaaggtacctaaaatgatctgggagcctgcagtgactggtgagaactaacaggcggaggccgtgtgcgagggttgatgacgtctgacagactgtacctgtgcctttagcgtgtccacaggaagggcatctgcattcaccagcgcagggtgtgagagtgccacagagaagcagaaaaacattgctgaataaaatgaagatcattccaacagcaacggtattgctgtctttattgctttgtagattttggaatgagaatctctgagaaatagtaatacagttagaataggctgcaacctaagattagtccccgaatttattgttctgtgatgagggagtagaagcctctgaaattctaaatgtgcttcagtcagtgcacgaacgtcgtcacctaagggtccggtcctggaaataaggacatttcgttttcatcctggtaccaagaatcttgatgaattggtaattcttttagaatagttttattattaacaattctaataattatttagaatacttttattcttccctgttgacgcctgcactatttaaaggatgatactttaaaaaagatatttgtgcctaaaatttggggggctgtcactttgtcagcccattaaacgtgggtaagttgcacttcaaacgttttgctttgtttttcccacttttcacctaacagaaaaccactgggccttgttacttgcttggttttgttcgtctgtgatttacctttgtcatgggtttttaggtatctccgatctaatcttttagataaaggactttgaagcacgtctgcctggaaatggtttgtaggtttcagaaattttgtgtgcattatcagatttgtctccattttcatggtttctttaaagttagttttaaagtgggttatgtgaaatcatctagtatctgggtacagaggaatggatgaattctcagttttatgtgtgttttaaaagtgcacaaatacaaaacggaaaacaagcgatgtaagttgtctcagaaaaaagtgctttttatattttcaggagaaagagaatgtagagagaatggaactgatgagtttgaagagattcaggtgatatttcttaaaggataaatgcacattttaaaggttatgaagagatggtcttggtaggtttttaaatatacatctagcatcatatgtgcaaaattccttacaatgttaagaggaacttgagctaaaacttaactcatttaatatttgtaacatttttgaagtagcgtttaaaagacagtaatttccctacggtgctttaaatggtgaagaatgctggtgtcgtacgattttgatgcattttttgtgctgactatagactggcgggaatgatgcagttagcgagttgatacccagcatcatgttggcttctccagttcactggtgggcctgcaccacagcagttggcttctccagttcactggtgggcctgcaccgcagcagttggcttcgtcagttcactggtgggcctgcaccgcagcagttggcttcgccagttcactggtgggcctgcaccgcagcagttggcttctccagttcactggtgggcctgcaccgcagcagttggcttctccagttcactggtgggcctgcaccgcagcagttggcttctccagttcactggtgggcctgcaccgcagcagttgacttctccagttcactggtgggcctgcaccgcagcagttggcttcgtcagttcactggtgggcctgcaccgcagcagttggcttctccagttcactggtgggcctgcaccgcagcagttggcttcgtcagttcactggtgggcctgcaccgcagcagttggcttctccagttcactggtgggcatgcaccgcagcagttggcttcgtcagttcactggtgggcctgcaccagagcagttggcttctccagttcactggtgggcctgcaccgcagcagttggcttcgccagttcactggtgggcctgcaccgcagcagttggcttcgtcagttcactggtgggcctgcaccggagcagttggcttctccagttcactggtgggcctgcaccgcagcagttggcttcgccagttcactggtgggcctgcaccgcagcagttggcttcgtcagttcactggtgggcctgcaccggagcagttggcttctccagttcactggtgggcctgcaccgcagcagttggcttctccagttcactggtgggcctgcaccgcagcagttggcttctccagttcactggtgggcctgcaccgcagcagttggcttcgccagttcactggtgggcctgcaccgcagcagttgacttctccagttcactggtgggcatgcaccggagcagttggttggttgtcctgagcataccaccagggggttaaagtgttttcaggctggaagcatttgacaccatggctccctggggtctgtggaggttctgaggcaaggactttccttgcaggtctgtttacccagcagagagggcagtagggtctgaatggtgtggtgcacgtggtgccacgtggttttgagacgtgctgggaactggttttgttggatgactcgctctagaccacagtggcagtgttgaagctttccagccacggctctgtggatgtgtgcagtgttgggaatcaggctgggctgcccttgttccttctttacattcctcagacgttgtgctttacagccacagtttcagtaaccgctgccagagccccacctgtgcgtgttctccaggatggctgcgtctgggctctgggcgactgaaccaggtgcagagcgtcagccacagctgacgactgcactgcactggactccagcctggggctcccacccctgtggctgcacaggagacaaaacaacaacacttgttcctttgaagctgtttgttttttgttttgagatgaagtttcactgttgtcacccaggctggagtgcagcggtgcaatctcagttcactgcaacctccacctcctgggttcaagcgattctcctgcctcggcctcctgagtagctgggattacaggtgcccaccaccatgcccagctaattattgtatttttagtagagacagggtttcaccatgttggccaggctggtctcgaactcctgacctcaggtgatccacctgcctcggcctcctgaagtgttgggattacaggcgtgagccaccgcgcccaactaatttttgtatttttagtagaggcagggttttaccatgttggccaggctcatctcgaactcctgacctcaggtgacccacctgccttggcttcccaaagtgctgggattacaggcgtgagccatcactcccagccacacccggctaatttttgtatttttagtagagacgatttcaccacgttggccaggctggtctggaacttctgacctcaggtgatcctgcctcagcctcgctaagtgctgggattacaggcgtgagccaccacacccagccactctggctcttttgggacataatttttgaccttaaagttgcaagaacagtgcacagaattctcacaccagcttcaccccagattccgcaaatgttaatgctttgctgagtttgcttatctttccccatgcacacgcacatttttctggagttggagagttagttgcaggtgtgatgtcacttcacccctaaatacttgagtttcctgaaaacaaagacgtgctcttacatagcactaatagtcctaataaagtcctttgtaacaaaagcaagccctggaccccacgtggcatcgctggttgaaccctcaagagtcagctccttcgtctttctttctttctgtatcattgcctggtttagtaggacatccctcagttagatcgcagctgtgcactctggtgagactgtcccagagcctgcgtttagtgaaggtggtgtctgttgtaaaaagttacaacttttcctgttgtaattcagtatcttgaaagagatactttgttaccacataaatacatttgcaccaagctgacccacattttgggtatctgtcagtgattcctgcttgaatcgcttcatttctaggatgatagtccagtggtggtgttctcaattccagcatttcttctccactttttggttgactttctgccgtaagaacaaataaggccaggcgtagtggctcacgcctgtaatcccagcactttgggaggccaaggtgaacagatcacctgaggtcaggaattcgagaccagcctggccaatatggtgaaaccccatctctactaaaaatacaaaaataggcgtgatggtgcgcacctgcagtcccagctactcgggaggctgaggcaagagaatcacttgaaccccagaggcagagattgcagtgagctaagatcacaccactgcactgcaaactaggtgacggagcgagactccgtcacaaataagtaacatgtctatttagcagtgtaggctcatggtttcttatttaatggcttataatctgttattgttattatttgccttgacacaaaacttatcccagctgtggccggcgggatccccgtggtgctggttcccggcggctgagtcttgaggcattgccgccttgtctgcataacggattctaggctgctgctctcctggccacagtcctggaatcagccattctccaacaaatcctgctgcttcttggtggagaatgacatttagaaacccaaggtctaggtgcaaaaaatacactcttccctctaaatacatttctacactcagaatgttggaacttagggaagaccctggagccctcctgatctgtagaaggaagggagaaggttggacccacctggaggcgatgctcagaggtgatggcgtccatggtccaggcccagcccgtagccctctctgatgtacccatgccctcggacctcccctgagagagctgagaggccagaaccccacagagtttggtacttactatacttgtgtattttgaggcaaataacttgtttagaagttgcatgtcatggctttctcatggattttctttaggacaaaccagaaaacatttattggtgactgattggacgtttttgggctgagctctttggttgggtgtttttacgtttgtgtatccgcattcaagaatccacaacgtgtcacacccctttttaaggtgtggagacgtttctctgcctggagcgtggaggctggaatgagagcgttcagggcttttcacccctgttttctgtcagcatctgcaaagacgaagtgtagaaatgtctcgtattaagaaaagacattgctctctgctccctgtctgcacgcgggtttcccagcctttgcacacacagacattctgagccagatggcctggctgggagcatcctgcatgctgtgggttgctgagcagcttccctgcctccaggtgtgatatccaggagtgtctccagccactacaggagtcctggggtggggggtggagcagagcctgcactagaataagacagtcagaacctttcaaccgcagtacagaaaattacgtgactccgacgtggccagtatgcgagtgattttctacgaaggcctgtgtttggtcacgttgctggaagcctgcggagtgctgcctgcgtgcactgggcgcaggtgcccttggcgtcaggagccggccttgtctctgccaccgggaccttgcgtggttgccatttccagccctcacctgcttcctactcgtctgtcaagacccagctgttacagctgctgtgacactgttctagaagcttccttcctcgtgtagaactaggcatctgctgtagtcatctgccggtggcacctccgtcttgcagtcgctctcgtctgactcgtattacactgttggtgacagcaggcagtgcgcacccgactcagcttatagtcaactttcttcagacctcaggctgcgctggtggcccaagggaggctgtttgtgggaagcagggccagcttacactcgctcttagacctgtgctggggaaggcaggtggcacctgggcttgctaccagcccttccttggagcaggaggcccccgtcctttgtggcagcctagtgtcaatgtgcgacgggtcacacagcttcccaggcaggactcgggctggggaacagtggacagctcccagggtggactcggggtggggaggagtggacggctcccagggtggactcggggtgggggaggagtggacggctcccagggtggactcggggtgggggaggagtggacggctcccagggtggactcggggtggggaggagtggacggctcccagggtggactcggggtggggaggagtggacggctcccagggtggactcggggtgggggaggagtggacggctcccagggtggactcggggtgggggaggagtggacggctcccagggtggactcggggtggggaggagtggacggctcccagggtggactcggggtgggagaagagtggacggctcccagggtggactcggggtggggaggagtggacggctcccagggtggactcggggtgggggaggagtggacggctcccagggtggacttggggtgggggaggagtggacggctcccagggtggactcggggtgggggaggagtggacggctcccagggtggactcggggtgggggaggagtggacggctcccagggtggactcggggtggggaggagtggacggctcccagggtggactcggggtggggaggagtggacggctcccagggtggactcggggtgggagaagagtggacggctcccagggtggactcggggtggggaggagtggacggctcccagggtggactccgggtggggaacagtggagaaaacctttgcagaacacactctgcaggcgtttgtcagccgttgatccatttgtgtgaagccccactggctggaaggtgccccccgcccgccatggagttttctgggcaccttggtgggtcgtctgtcggtcatacctttgagtctttctggactcctctgttccatgcgtttatgttgtatgcctgataagttctgaagtcaggtagtaaaagttctctgttatttttgaaaattgagattctaggttttctgaacttccatataaatttcagaagcaacttgtcaatttctacaaaaaaacacctgtttattggttaaactagagccaccccagatccttcttcatgttaacatgtttaggagagattggcaaaatcctcctagttcatatttgaggattcctttccctctcttccccttgcagggggtagagcaaggaggagcccgcggtgagctggtgtcttgcatggggcagggggtagagcgaggagcccgccgtgagctggtgtcctgcgtggggcagagggtagagcaaggaacccgccgtgagctggtgtcctgtgtggggcagggggtagaatgaggagcctgccatgagctggtgtcctgtgtggggcaggagctgtgcagagtttccttgcagaaggctgattgcaaaatgatgtcagctggagaccagggaagcctgttagaggggctggggctcccaagtggggttgctgccaggactgggggagcagtgcccagggaaaggacgtggggccattgggaggactgggtttgggtgttggcggtggggccgcagagccctgtggatggacgaaaacagctcagccggggagttgggggctgccaggcatcggagaggagcctggatgtggaggccccgagtgcgatggcggtagggacacagactcctgggcggggatggcccctgtggcctcagcaagcagggagcaggtgtccctgaggcctgtgaagcctggcagtgtctttgagcaggtgtggtgaccgggagggaggatggtccagtgtggggtttgtgcgttttttttgtttttgtttttgttttttttcagagattgggtttttaggttaagtctctgctcattggggcattttagggcagaactctaatcattcattgtaaagtattttgataaaattaaggaaatcatacttgtcaccttagaaagtttaacacactttttcaaacaaggtgtcactattttgttgtctggtttaagaaaaaaacctgatacaggttgagtctcccatatccaaactgcttggaaacagaagtgttttggatttctgggtttttttggattttggaatatttgcacgtatacatgacgagatgtcttggggatgggacgtgagtaaacgcggaatccatttgtgttgcacatgcactgtgtacgcacaggcccaggacccggaggagctcagattcttgatagtcaccggcagcccactccatccccgagggctcggagccccgcaccgtgtgtcctcagcaccgttcctcctccagggtgatccgcacacgcccatcctcctccccaggaagaactcccctccactcccctccaggctacagacccgcccctcccattctccctgcaggatgctggctacagacccgcccctccgagtctccctgaaggatgcaggctacagacccgcccctccgctcccctgcaggatgcaggctgcagacccgcccctcccagtctcccagcacagcctgccatggcacagtgggcatggaggatgtggctccgccttgtttccgcctgtggcctgatccttgcgccctctcgatgacatggctgggggtcttggtgggccatggggcatcccgcctggaaaggtcccattgacagatgcagcttgggtggctgtctcatgtccgcgggtcagggtggtcggagcagcccggctgggacgggagtgtgggggctgtgagcacctaggggcgggtgctgagtgctgggcggcctcatgtctgcagggcagggtggtcggagcagcccggctgggatgggagtgtgggggctacaggcacctaggggtgggcgctgagtgctgggcggtctcatgtccacggggtggggtggtcggagcagcccagctgggacgggagtgtgggggttgcgagctcctagggacactgagtgccgggcagcctcgtgtccgcggggcgcggtggtcggagcagcccggctgggatgggagtgtgggggctacaggcacctaggggtgggcgctgagtgctgggcggtctcatgtccacggggtggggtggtcggagcagcccggctggggtgggagtgtgggggctgcggacacctagggtcaggcgctgagtgctgggtggtctcatgttcgcagggtggggcggtcggagcagcccggctggggtgggagtgtgggggctgagggcacctaggggcgggcgctgagtgccaggcggcctctggtctcatagccttcagatttcagcacttcttccatggcttctgccagaagaccactgtttggacaaataaaacagtttgtgtttatataaaacgaacattacagtcattttgtcaggaaaatgtagttgcatcagcctctgtctagactgggaatgatatgaaagttttagattttataaattctctaacggaaatgtcagaggatcacatataaatagtgtgttttgagacaactttatgttatccccaagtctcctctttggaccagacatccttagttttttcagctgttccacgggtggcacgggggtggtgaggtgtggtggcgtgtcatttttcatgagagacacctgtaggtggaaagtcctttcattttatagacaaagaaatgccctcaaggggtgatgtcacctgcctacaaagttatgcaagggttagtgtagaattggtacaaaaacctagattttaaaattcttacttgggggctcttttgataaaccaagagattttaaagtgttgttccccttgtgtttttttgtagagcggttctggtgaggttggaaggatgcagccacccggttgtcatgaaaggcctgtgtgctgaatgtggccaagacctcacccagtaagtatccggaagagtgagatcgctgcctgctggggctcgaggtggtggcctccggggagtccgagaagctgtgctgggaacacagtgaggcccttggtttcccagcggcagatgcagacgcctcccttgggccccatacgagtcacactcaatgggtttccctggaggcagtccttcctgctctgtgaccccagcctcatgccattctcaggtgtggtgggggggcatgctggagggccgagacctgttttctcctgactgaagacgcagatcgctgagtgcctggagcagcccctccctctgggccgctgagcgccccatgctgggggctgctttacctctaatgccaagtgggaggtgcggcagctactttttctgcgttttcatggttgagggcctgtttctgcttctgtgtgactttgcagtttgttttcatgaaggactatggctctgtgtgttcatgagtgtggccacgagctcagtgtttccaccagttttcctgtctgtggagaatgtttccacgtttgccgacagaatcaagtctgtgctaagatagcagcgtgtgtccgttaaaacatcagctagaatcctgtcacttagagcccagtgtgcatctgtgcgcagagactcagctgaaagccctgaacctgtccttgcacttgcaggttgcagagtaagaacgggaagcagcaggtgccgctgtccacggcgaccgtgtccatggtgcacagcgtgccggagttgatggtgagctccgaggtgagccgggcatcagtggcggcgtgttggggaagcgtggtgctctgaggagggcggctgcaggaggagggtggctgcagaagcacggacgtgtggttgtcatcgtcgttactgaaacaacccctcatcacacggatgacttatgggactgcggccttcctgaagcagggacggttgcccttggttctccacagacaagtctgcctgcaaaagcgactcagggccccgaggctgtgtgacctgcgtgtcgggaacaccaggtgctgccgccgcagctgtgaacagccaggctcagcctgggttcccttgagccaagtcctaactggggagggatgtgacagctgctcatggagctcaggaggtggccgcgctgccgaggcatgtgctggatgacccgggagggcaaagcgcatattggggcagataatggcgaggagtcggtggccgggggtaggggcggggggacgtggttggtagcaccttgttggctacaggagcggctgctgctggcaccattgggaagctggctcgggagagtgggcacatgcaggggcgggttgggggtcccaggagtgtttgccttgtagccgacaggagagcccatggggggtacgcagggtggagaggacgggcaggtgttcacgtgcccagttaagagtgagatgggtttttatcttcgagtgctacgcctcgtttatgtatttcaggagttgctggggcactgtgggtcagcggctccgggcacctcctgtgcttgaggcagacaccgtctccccgacctcgcttcaccccgtgggtgaaaatgctctgggagctgagaaaaactagtttgtgatcttacagactttcagggctgcacagttttgtaaataggtaaaacactttccagtgttacgattttagtaaattcgtgcttttaaatgatggacaccaatttcagtctatctttttatgggaaaagcaaaatgccagatacaggattctgggttttctgaattaccaaactttaaacaaatgtaaaatgtgtatgcgtaaaccaaagctggcaagtttgagggtgaagggaggaggaagtaccccccatctttctggcacctgccagcccttccgtgcgtttcccttcggggatgggcacgggaggaggtcccccctgagcgggaccaggattttgttgtgaagagtgagggccagttacagtgagaaaggcagcgtggtgcgtcacatcccgtgtcccatgccgggctcctgatgccggggtgaccgggcccttgttaggagctccactctgggccccgcgtggagggacaccccgatgcgctgttgccaggcccccgggtctcttcgaggcacaagaataggctgagcgtggaaggttctgagcgcgggagattctgagcgcattgcccttaccagtctctgctgcccagcttgggccacccagcgtctcccagccggccgacttggtttcttcattaattttgcagttcacttttattgagcactccatactgttgaatccagcttttatagaaacaaccagtttcccttccccctccgttttcattggctcatgtatttaactgaattataaaattgtggtcacaagcgaggttgccgtgaccaggttggtgacccagccctgcctctcggcctgtacggcgcagtccatggagcgtggggggctggaggggaacacattgatatagttttgtgtttctcgatgaaatggagttttaccttggatgcaaacatactgactttgtcatttcttgtttctttttaattgtagcaagctgaacagctgggaagagaagaccagcagcgactgcaccgaaaccggaagctggtgctcatggtggacttggaccagacgttgattcacacaaccgagcagcactgtcagcagatgtcgaataaagtgagtgcagtcagcatctacggacagtttcccaggaaccgcgggtcctagaattttgattcagaagtgtgttctcttgttttttagatgatttcccgtaggtcagcctgggtttggaaagcagacttgctagttctgggcgtgggccgtgtgtctgctgggctgttggggagcatccgcggctcccgggcagacatcccgacgcccactgtgtctcacgcttccttccgtgtgtgtgggaaccctttgtgtgcctgcccggcacgatgtcggagaaggcagaaacgtcccgagcctgtgaggatggtgtggtggatggtgcgaggcgtgtcctgagaggggcagtcttggtggggaggacgttggtgttggatgcctttatgttgctaggatgtcaagggcaggtggacgcctgggtttgtgcttgggagaactgggctggaggaaaagcctgggtgggaggtgaccagcgtacattctccaggggaaacacggggaaatgcagggtgagggcagaaccctgtttaatgcacacgaaacccttcctgtgcctcagctgtgtcctcaggatggaaccagagaagctgaatttctagaccgaaggctttgaatgtctgtgcccagaggcttgcgcagaggcttgtgtcggcctagacggtggccatcagggaggccctcaccaacactgagttgttttttaagtgtttgctattgaacagtatgtggactctggcgttagatttgggatttcagaggcccatcagttctgaccttaccagttctaaaggttcctggggatcctgcaggtcccaatagcagacacccagcaggctggaggatgcaccacggagccgggcatcctccgctgctgaatgccggggcgtggtaccaacagctgggacagattgatgacagttacacataagtcaaatttgtgacaagcttcatctggaagaagtttggttaagtttggccttgtaagtcagtcaggtggtcagggtgagctgcacagaccccccaggtggcacaaactctcgcgttttatgctgtttgcagaatggagagaatcgagtaactgccgtgctgcacaggagtttgtttagggccggaattcaggtctaacccacaaaacagcttctatttctggctgtgttagtcatttgtgtgtctcgtggcatcttacacagcagtctattcttctgtgcagtataaactgtgactagatattttcagattgcttcgttcatacccgctactctactcactaaggttttttgtttgtttgtttttgagacagagcctcactctgtcacccaggctggagtgcagtggcaggatcttggctcactgcaagctctacctcccgagttcacgccattctcctccctcagactcccaagtagctgggactacaggtgcccgccaccacacctggctaattttttgtattttttttagtagagacggggtttcaccgtgttagccaggatggtctcaatctcctgactttgtgatccgcctgcctcggcctcccaaagtgctgggattacaggcatgagccaccgcgcccgcccaaggttttttttttaatgcctattttctgacaaactaggtattttgaaggatgtaaggactttatgaaaatacattctgcacacatataccttcatgagttgctgtggctgtttcctgcttttattgtgcctttgaagttgggcattgagtgagttttacaggcacacctcattttatggtgcttcactgatactgtgttcacagggaggaggctcggagcaacctggcgagcacgtctgcaggtgccattttccagcagcatgtgcccccaggtgttgtgccacgctctggaaatttcccgtgtacttcagcctcctcgttagtgctctgctgttacagggagctgtagtcagtgatctttgaggtcactgttgtcatagttgcttcatcagtgttctgtcagctatagggatttgtggtcagtgatctttgaggtcactgttgtcattgttttggggtgccacgaaccacacccacataagacggcaaacgtaatgggtagatgtgtgtgtcctgactgctccaccaactggccattccctgtctctgtcccggtgctcaggcctccctattccctgagacataacagtattgaaattaggccagcgtagtaaccctacagtgacctctgagtgttcaagtgggaggaaggctcaccagtctctcactttaaatcaaaaggtagacgtgattatgcttagtgaggaatgcacgccagaagccaggaaaggctgcaagctggtcctcttgcactaaacagccaaggtgtgaatgcaaaggaaaagttcttgaagcaaactaaaaatactacttcagtgaacacacagatgatgagacagtgaaacagccttattgctgagaaagagaaagttttagtggtctgagtagaagatcaaaccagtcacaacattcccttaagccaaagcctaatccagagcaaggccccaactgtcttcaattctgtgaaggttgagaggggtgaggaagctgcagaagaaaagctggaaaccagcacaggttggttcatgagggtgaaggaagaagccgtctccgtaacacaaaagtgaaggtgaagcagcaggtgctgttggagaaactgcggcaagttcccctggagataggctgagatcactgatgaaactaaacacgctaaacaacagattttcagtgcagacaaaacagccttctgttggaagaagatgccgtctaggactttcatagctggagaggagaagtcagtgtctggcttcaaaggacaggctgactctctcgttggagactaactaatgcagctggtgactttaagttgaagccagtgctcatttgccattctgaaaatcccagggcccttaagaatgatgctaaatctcctctgcctgtgctccatccatggaacaacaaaggctggatgacagcacctctgttcacagcatggtttactgaccattctaagcccgctcttgagacctgttactcagaaagagagattcttctaagaaatattcctgctcattgaccatgcacctggtcacccaagagctctgatggagacgtacaggagaggaatgttgttttcatgctgctgacaccacatccaccctgcagcccagggctcaagaaatgatttccagcttcaagtcttattatttaagaactacatctcctggccaggcgcggtggctcacacctataattccagcactttgggaggacaaggcgggtggatcacgaggtcaggagatcaagaccatcctggctaatgcggtgaaaccctgtctctactaaaaatacaaaaaattagccgggtgtggtggcgggtgcctgtagtcccagctactcgggaggctgaggcaggagaatggcgtgaacccgggaggcggagcttgcagtgagccacgatcgcaccactgcactccagcctgggtgacagagcaagactccatctcaaaaaaaataataaataaattaaataaataaataaataaataaataaataaataaataaataaaagagctacatctcctaaggctggagctgccttagagagcaattctgatgaatctgggaaaatcaaacagaaaatccttctggaaaggattcaccattgtgacattgcaagtgccaccaggaacatttgtgattcatgggaagaggtcagagtatctgcatcaaccaggagttgggaagatgtcgattccaaccctcagttcggaagatgttgattctgaccttcatggatgacttccagggcttcgagaccccagcggaggaaggagctgcaggtgtggtggaaatagcgagagaattaggagtggagcctgaagatgactgaactgcggcaacttcaggatgaaactcgaacagatgaggagttgcttcttacggatgagcaaagaaagtagtttcttgaaatggaatctgctcctggagaagatgctgcgaatgttgttgaaatgaccaaaaaggatttggaagattccatcaacttagttggtaaaccagcggcagggtctacgaggattgctcctagttttgaaagcagttcttctgtgggtaaaacgctgtcaaacagcattgcatgctacagagaaaccttttgtgaaaggaagagttgattgatgggacaaacttcattgtcatcttatttcaagaaatcatcacagccacccccagccttcagtaaacacccctctgatcagtcagcagccatcagcatcaaggtgagaccctgcgccgacagaaagactatgacttgctgaaggttcagatggttgttagcattttttaatcataaaattattttttattttttattttttaattttttgagacggagtcttgctgggttgcccaggctggagtgcagtgacacgatctctctatcctgcaacctccacctcccgggttcaagccattcttgtgcctcagcctcccgagtagctgggactacaggcgtgtaccaccacacccagttaatttttatatttttagtagagacggggttgtgccatattggccaggctggtctcgaactcctgacctcaagtgatcctcccgcctcggcctcccaaagtgttgggattataggcattgagccaccacgcccggtgatttttaataataaagtatttttaaattaagttaggtacattgttcttttagatataatgctattgaatgtttaataagctgcagtagagtgtcagcatggattatattcactgggaaaccaaaaaattcatgtgattctcagtatctccaggataggcctgctgaagacagtggagtctagttataatgtggctgtttctcagttgtgtggtctggaaggtgacagtgtcctgatgtagtggggaggggggtctaagcatgaacggtctgtcctctgcctcctcagtagcagtagtgtgccccacttgacatccagaggagaccctgaggctggtgcctggccctactgctggcccctctgaaagcaatttcagggatcagaagtggtgctggccacagctcccgaagcctggacagctgctggactttttactgttgagtaatgggaaagttgttactagaacttctcactcctaaatatttgacagagtagcttcttcatgacggtcgtgactaacttagagctagaaaaatgtaactgggaaagttgttactagaacttctcactcctaaaccttgaacagagtagcttcttcatgagggtcgtaactaacttagaactagaaaaatgtaactgagcttaagtcatctacctttttttaaagccattaagagtaaatattttactgagaaaataacaggatttaaaggatcgaagtttagcttcctaaggaaagcagactcatttgcatgtcgatcatatgtaagcgagtcggtgttgctcatttcactgtctactaaatatgacttagaatactttcagcttttatgttgtatatgtagatgaaagaaactgtctgaaaatcacccatgcgttataccaggttacccgggaatgttgatttcctttattcagtagctcaggaaaacactgtcagcacgtgatgttggtggaggtctgttccgagcagctgcggtggccttgctgtgtaacacgtatcagcgaggaaacaaaggcagaagtgacatcagtggttagctcatagttagtgtaggttgttactgttggcgtggttatcaggggtggttatgtcctaggcggtcgttgcaggtaggtagttaccaggagtagttagtgtagctatcatcggtggttatgtagttatcataggtggtgactgttggcgtggttattggggatggttatcgtgtagttatcacaggctgttactcttggctggttatcgggggtggttatcctaggcgggtcgttgcaggcaggtagctattgtgagtagttagtgtagctgtcatcggtggttatcatgtagttaccgtaggctgttactgttaacgtggtacccagggtggttatcttgaacagttgttgcaggtaggtggttatcctagttaccacgggcagtcagtattcacactcactgagggcattcccgcagcagagaaggccgcactcactcactcgtaccgcgtgcatggaaactacttacacagtgggttttaaatgccacgggtagccccttgcaccagttagggtcacgtccttatttggagggtcaggcggacatgcgtcctctgtcccacgtggagaggtgtgtgcacactcctatcccctgtcccatgtggaggggcgggtgcaaacgcatcctctgtcccacgtggagtggtgtgtccacacgcatgtcctctgtcccatgcccacgtggaggggcgtgtacacacgcatgtcctctgtcccgtgtggaggggcgtgtacacgcacacgtgtcctctgtcccgtgtggaggggcgtgtacatgctcacatgtgtcctctgtcccgtgtggaggggcgtgtacatgcaaacgtgtatcctctgtcccatgtggagggatgggcacatgtgtgtcttcaggacgcctgtctcaggcacccgtgtgtcttcaggacgcctgtcgggcacacgcgtgtcttcagaacgcttgtctggggcacacgtgtgttctcaggatgcctgtctcgggcacacaggttgcgggggcggccggggctcctcaggccttttctcccgactgttgctactattctttttagggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggtcagtcaagccgcagccgaagaggccgtgtgaacagtgggtttctttcctgttttcggtgatggtttcttaaagatgaagaaagaaaagaagctctcctgcaactcagttgtagtcttagggttggccgttgtgcagggggttgtgagaggtaagggaattctgccaccagggctgttgggtggggccgcggctgctctggccgggtgcggtactgggtgggccgctttgggagtttgtcaggaccacatgggcacgtggaaacttctgcgagcgtcctccgacagataccttcttaaatcagttcacagggactttgggccgggctgcttgtgtgtgctcttgctgggtgctgtcactgcacacagcatgattgtcccctgcctacacatgggtacccttagggtttagcgtttgcttctgtctccctgggtgatagcgtgaatgccaggctacggtgccctctgggaggcagcaccagcaggacgaatcgaggggacagtgccacgggacggtgactgtcccatgtggatgcagtgaggggacgccacaggatggtgaccgtctgtccttcatggacaaagcgaggggacaaagtgggacagcgaccgtctgttccacgtggacgaagcaacgtctgtcccacgtggacgaagcaaggggacagtgcgggacggcgaccgtctgtcccacgtggacaaagcgagggggctgccacgggacggcgaccgtctgtcccacatggatgtaggcgccgagtggcagtgtaggcaagctcctccgtactggctccagaggttgttagactgagcattttaaaattcaaaggtctttctagattggtcttagtcttttgttgttgttggggaaatgaattttgaatcctcctttaatatttagtgcctttataggaaattgtgatcatgacctttaattcctcttgtaattgaaatttgaaatattcacctgtaacattatggctgctgctgcatagctgcctgagacagatgatgtgaagacgagtaattatgcacaagggtgatattgctcacttcctcgggccagtgaagaaataatgcctgctatgatctgagggttttacagcccccaagtccatgtgttaaaacccagtcccagggcgagggtgttaggaggggcgtgggaggtggtgaggtcctgtggactccatcctcgtgaatggaatcagggcccttacccaggtgggccctgggagctgcgggaaatgcagcaagccggcgcccactgacctgcagccaagttgctggcgccgtggtcggacgccggcctccagaactgtgaggaagggacgtgtgttcctgagtcacccacactatggagtttctttagagcagcccaggccgactaagctgcccactgtgtggaaatagacccccaaatccccatgtgttccagccccagattgtgccgttgcagccagtgccaggcacctcccagaggacaacccataagtcacacaaaccgcagggacagtgacgcccactcaaaccagacaactgagcggggcatcactctcacaataacaaatgtcagggaaagactaaaaaccagaaaattattcctcacgctcatcatatccatggctgtcccctattctctggttttttttttgtatgtataattttgcctagtttgtcttaatatatgtacaagtttacataccgttcttttcacataagatttcatcactaagaatttatccatcacgttgttataaatcttcatcattttatgtaagatttttttccctcctctgtggactggatcctctgggtgagttcctaaaaccaggattgttcggtgagggagtggttcctgacccccaggactgtgaggactgcacgccgcatggcctgctccctgggagggtgacgggtttgcctcccgcctcccacacaaggcgcacaccagcgggcacagcccggtgacctgcacgtctgagtccaggatgccagtgatgtttcttctcctcctgtcccgtcttccatacgttgatctggtgcccgtgcaagtgtttctcatttcggatttccttctccaggtctctctctgaagctgggcttctttaggttcgctgtttcacacgtcttgcttatcctttcctgaggtgcatcgatgtttgctggtcagagcacacaagccccagtgaggaggagcatgtggaaggctcggatctgtttaaatgcttggctggaggggtttgggctaaaagcagagggtcccaggttttagccgggctacacccttgccacccgtcacaccagcaggcagggtatgggtcaccacagtctgattccacgttcatgaggcctcgtgtggtgagagatgaagcaggtgacgagaacgccatgtttctttatcagcctgaaagctggagggagcctgggagctgctcgcagattcagcagagcatccatgcagacatccgcaggcctctgagccgcttagacagcagagcagggagcctgctggtgggcgcttggctgcggagagcctcgagcgcgggtcctcctgcagtgagaccagctaggtttgttgagcgtcaccgggccgtctggtgccttctccgtttcaagctctgctttctatgctaaagttccagcattccaacgtgtccaagggatgtcggccaaaaccagacgaagacatcacaagaaaactgcagaccagtatccctttgaacatggatgcagaaattctcaacagaacatgggccctcgagcccagcaacgcaggaggaagactgtgtccaggctgtggttcaggaaggccgagctttgcttcattgtggctggcgggatctgtagagatgacctgggtcagcttttctacaagtgagaaagtgaggtccggactgaagcctgaggtggtcgccgagcatctgcttttgatgcttttcattttgaaagtgaccgtgttgatagcatgcgtgctttcagtatgactaggacagagatgttaagagtttgcgatgcgtgtcttttatctgatagtagagacgctaataattctattaacagactttagatctagcgacttcatggcctcagtgatcatctggaatttacgcatagtgagaaacaatcgcatttatttctcctttaagcccaagtatcttttggttaatgaaatactaacaaaccagtggtatcagggaacggaaagctcctggcagtactgcatttgaaacgtctggaggtggtgatgcttcagccaggaagcaggttcatcttcccagaagatcttacggatcccacagtgcattgtgcatagtgccgtggggctgcagggtaactgaggtggtgcacagagcagctcttctgttttaattgtaatgtgtatgttttaacctgtatcaaaaacagcaaatgtgtttctcgcatttgtgatctcagaggtggtggtgcagaggttgagcccagtagggatgggtgcagggagtagttgattaaaagccagcgtgaaaacaatagtgattatgtggagtgcagtcagggcacgttcagatccggaagtggaccccgtgtgccacgtggggacgtggagccaggcgttccggggtgcattcggatccggaagtggaccccgtgtgccatgcagaggcgtggagccaggcgttccagtgagacttaagtcttgagagaatgtgggctgcgtggttggactttgggttcacagtgcttttgagatgtctcatctacctcctttgcttcatgcataactaacggttatgcaggggacctgcgtgccatgacaagaccacagtcccagctcccgactctggaccggctcactcttgtgcaatccagtccccgttttgttccacggcacctgcacgtgtcaggccagatagaggttgtgtgttaatgtgttcaattttcttacaatttcagcctcttgggagagtaataattatgttgtattcattcccgcaccttatattcctagcaaaattccaagtaatgttaaactcagtaaatgttaaatgatcgaatacccttaaacacgttatgtgggtgccatggaatacctatctcttgaggtatgtgcagatttatggcttcagccacttgtatgatgagtagctgaaacatttctttttgaggcttcataattaaccgtagctttttctctccagaatgttttaaatggctggtgaaattaaattgacattgaacttgatgcctccaacatattttaccaatggaataaattacctgaaaggttgttttgtttttgtttagtacccctacttctacaaactgaaatatgtttcctatatactctgtggttcttgtaaactaacaagagataacttatttttaaattatctttatttaaaaatatgagcactttactgtaaattgaagactttgcaaacttaggaagataacacagtaggcttaaagttcagaagataaatttatagatcaagaaacccagagcagaggtgatcccaagaaacctctgcctgatttgttgattttcacagtggtgcttcctgaagtgtagaagggatgtttgcagatagcttggttttactatctttaaggagtcgaagctgagcatcaagcatgtgaagctctttagaaaattactgttaaaaagttaaactagacttgtaattaacggatgtcatgtgaagtgcaagtgtcaaatgtagcctaagcggattcttcgctgtggaagcaccttctgcactagctggtcaaggtggtgtcccggatgtccttccttcccagtctcctctgtcaggcaggcttcctcgatgttgcctaaattaccattattaaaacgtgtataatagttagaaataaccggcctttctgtgtatttctacaacacagagtgtgagtttgtataattctactaaagtaacttgggagaagcaaacttccttgataacctttcctccactaaccattacagatgagagcagtgggccacccgcctggggttaggaaagatcatatccgaggtgacgcagagtaatttcagcttagtgtccagactccatcacgtgaagaaccacatgcagagtgttttgagatcaaatgatgacttacctgttttacttatgcaagtgccttccataattttcatatccatctggtttagataggcacttcagtaagatattacaaatttttcatgttagtagaattataaacacttatcaacatggtttgtgtttgagaaataagttcaccataagagaaaagaagccccacacgagccacgtcttacctcaaaagggatgaagtgtttggtgccagttcatcatgttgtgtgtctgccactttaaaaaaaacattcaaggcttcaccatgtgccgtgtgaccgaaacgtgtctcaggtatgtaatctttgtcctgttttcttttccaaggctttttagaccccgagaagaagcttttttctcaccgaatattatcaagggatgaatgtattgacccattttctaaaacgggaaaccttaggtatgtacccagccgcgctcctcacaaagacctcgctgttcatttcccatttcaaaaatcgcatcttgaaatttagagcagtatttctttttttctttttttttgagacggagtcttgctgttgcccaggctagagtgcagtggcgcgatctcggctcactgcaagctctgcttccagagttcacgccattctcctgcctcagcctcctgagtagctaggactacaggcacccaccacctcgcccggcaattttttttttttttttttttttttttttttttgtatttttagtacagacggtggtttcactgtgttagccaggatggcctcgatctcctgacctcgtgatcttcccgcctcagcctcccaaagtgttgggattacaggcatgagccactgcacccggcctagagcagtatttctgtattgatgttttttaggaatttaacatcccctttccagttttcattgttagcctcagaatacttagaaagttcctttctaacctgtactcccactgtctcccaggtgcctgagccctggtgcttgtgcagggcccccaatccaggctctgccccatcccaatagccctgtcctgccctgaaactgcccttgagctgggcttttgtgtctgtggaggcggggactgtcatcctctctgcctcgtctctgttagacagcacaattcgatgtcagcccgccacctgacgttgtgtatctgtcatcctctctgcctcatctctgtcagacggcactgattcgatgtcagcccgccacctgacgttgtgtatctgtttgcttaaccaaccctggcatatgtgatcattctagtcccttgacctccaaattttcattcctatgcgaagacctggcatcgagatttgtggttggagaggcaggaggcaggcgtgtgtccccacagtagccagctgtgaaggatttggcccttttgcctctgagtatccagggaatggccagggctcctggggaactcagcgactggactttcgggcccagaacccaggagggcaggcgtagggacgggatggcatcagggaggtggcagtcgaaaggacccgagtgggcagaggaatgtgaatagccccaccccacgcacaagctcagcagctctgcggggccactggtttagcggcagttcttgacatcagcgtcagcatctgaggttgataattttcttaggagcttgcttgtgttaatcctactaataatttacaaaatcctaagtcacttgactattatgcccatatttttgccttttgccatttcttcctttccatcagctccagagccccttcctgtcagctcctctgagcctttttgacagggcaggccgctccccgcccctccgcaaagactttttaatattcttttatatgctttgacgtttcttgcccactgtattcgaggagtttccccatttccacccggaagtccgtccttgctgatgtaacaccatgtcaggtgtggcttgttttcccgaggagcctggtggccacagcctcagcttcagccacttcctggttctcggtggccagtccccacagactgtgagacctatgcttgctaatgttaactaagaagagaatctgaaagtatttacttcagaaacctcctttttgctagttagcgccagagtgagtagattaatcagggcaaaagagaatgagaggtgctgttagtgtgttacagggaaaagtcacccgaaggcagaatgataggatcgaatggggacatgcccaggataggccccagtggtgggtactgtggtttgcatggaggtagctggaggtccgcttagaaattctgcatcagcactgggtctggtttttgtttttttgtttttgagacggtctggctcggtcgcccaggcttaagtgcagtagtgtggtctcagctcaccacagtcttgacttcctgggctcaagctatcctcccacttcagccttctgagtagccgggactacgggcgcacacccccacacctgtctaacttttgtatgttttgtagagacagggtcttcctatgttgcccaggctggtgtcagactcctaggctcaagagaccctcctgccaagacctcccgaagtgctggaattgcaggcattagccacacagcgcctagcctggtctgtttacagagtcagcaaattctggcctttaggctacccagccttgtttgtacatgaagttttattgaaacatggtcacgcccacacggtcagagttgggtttcgtccccgtggcccgtaatgcctaaaatagtgactctggcgctttaagaaacagtttgggaactcctgcctgaaggagaatcggaaacagcactgaagatgttactgaggtttaaatgcgacccaaacagaaagggcttcggggcggttggtgtccgtctgattaacctgctgtctgctggttacatgtggattagaatcttaaactgttacgcttggcaagatgaatgactacaacttttcattattattttttgtaaattatgcattttcacttgtagaaatctctttccttgtggagactcaatggtttgcattattgatgatcgagaagatgtctggaagtttgcccccaatctgataactgtgaagaaatatgtatacttccagggcacgggtgatatgaatgcgccccctgggtcccgagaatctcagacgagaaagaaaggtgggtaacctccttcctgattctctagaagaattcacatttgcttattgtttagctcttcttatttcttatctctgttttgactgctataaattcaagatacactttttttatttgtgtttcagtagagattattggatttatttatagagtactgaaaaacaggatattaggttgtttcaatttgggctttaaaaaaaatggccctcacttaagcgttttcccagttgaataaaaactagaggatgctgtttaacctaacacatccgaataactcccttcatcccagttttccttaaacacatccctgggtattgggccatagtgttctgtagagagagtgaatgtgggggcggtggctctgcggggaataaccgttccccatgcgcagtggtcaggctgggcgctggctggggccccagagagcagcgtggtttaacttgtcagtcaggcatgcagctgacgtccaccctacgaaagttaagtgttttttgatctttagttttttgaaaaatattttgaggcacacgtttattgctgtagtcactaaaatggaacttggaggttaggaccaggggagggtgaaactaggggcattcctgtagaaggtagagactttcaccagatgggtggggtcagcgtggagttgctgacttcctccagaccgtggcttgggaaaccgtggccatggtggtgccaggtcatccggggcttacagtcacggtggcgccaggtctgcaggggcttacggccacggtggcgccaggtctgcaggggcttacggccacggtggcgccaggtctgcaggggcttacggccacggtggcgccaggtctgcaggggcttacggccacggtggtgccaggtctgcaggggcttacggccacggtggcgccaggtcgtcaggggcttacggccacggtggcgccaggtctgcaggggcttacggtcacggtggcgccaggtctgcagcccggaaacctctagttgtccttacaggtggaggatccctcctcccccaaatccaaagctttttgagtgcccacatggtgcttaaaggaaatactcattagggtattttggattttttggattggggatgttcagctggtaagtttaacgcaaatactccaaactcagaaaaaaattcaatatccaaaacgtccctggtcccacgcacttcaggtaaggggtgctcaccctgtccggcctcttcacagcaaggttgccaaggcctggtctagagggtggtggacttcacagccatggagaagggtgctgctttaacttggaacgttatttaatgtttaatgctaaattgcggtaacttttccttttgcatgcatatttagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggtgagtgctgcctccctgtgccctgggcatggtcaggcccgcgggctccttgcaggcactccttagagttggcattgctgtttatctcactttcaattttcagaaacatttcccagaatcaccatcttttaagaatagatcatgacagtgggtgaaattggagtttgggcacgttcatgctttcagaccgcagtcatcgcacacaccattcaggggtgggagttactcgtgtgtagaaagttcaaccttctccctggagtaagccatggccgggttggaaaacagggaatcagcgatagggacgtagtggagaaattcgaggcaggaacaggagttcgcaggtaaaagattgacaaaccctctgagttagaaaactaaatgcaaggtttcagctgaaacgtgcacagaaggacacgttgtggctgggagggcggaggacaggcctgctgtctcccgacggtgaaacctgtcccggacggggcaggctgctctgacatgttgaaacttccgccgaataaaacaacctttcagcaataggtgattcttgaaggaagacttaacaccccggtgcttaaaaaacccaaatacctcgttattctagttattctgtgaaaatgctcccataagcacctggattttccgcgaatgaagattgcggtttttctcctccaatctgcttcctgtcctggcggcgtttcctgagagggcttctcagtgcgtggccccgcctccggggctcaggaaagccttgtggggtgagctcatccctgtccacgcacgctccctgacagcaggtgtggtcttatttgaggccacggctctggcacgtatcatggggcgttggacacgcatgtgctcagtaaagcatttgaatcaagggtaaatggaaggttccatctcagtgtgaaatagccaggtgctagctgcagggcagaggcgggctttccgtggagcccagcgagacccttgatcccaggagaaagccaagccctggcctcctgtgggcagtcagacccttctctcctgagcgtggagccgggccaggccggggtcctccttggcccctcaggtgcctgtctgccctgccgcgtgtctgcccagctcctgacccttctctcctgagcatggagctgggccaggccagggtcctccttggcccctcaggtgcccgcctgccctgtcctgtgagtgcccaagctcctggcccttctctcgcattccttccttccccctgaattgtgctcacgtttcctttttgcttctgtgtacgtggcctcactgttgagaggctttgctgaacacatgctaagagaggtcctcctgctgctcaggtcacccgctgtgcccggctccccgtctgagatccaccccttcccaccatggctgcctatccctggcctggcagatgggaacctgcagtgggcagccctggtggggtgcagccgggtgagggccctggtggggtgcagccgagtgagggccctgagccctagtggggtacagctgggtaaaggccctgagtcctggtgggtacagccgggtgagggccctgagccctggtgggctgcagccgagtgagggccctgagccctggtggggtacagctgggtgaaggccctgagtcctggtgggtactgccaggtgagggccctgggccctggtggggtgtagccgggtgggggccctggtggggtgcagccgagtgagggccctgagccctggtggggtacagctgggtgaaggccctgagtcctggagaggtgcagccgagtgagggccttggtggggtgcagccgggtgagggccctggtggggtacagctgggtgagggccctgagccctgcaggggtgcagtcaggtgaaggccctggtgggatgcagccgagtgagggccctgagccctggtggggtacagccaggtgagggccctggtgggtgcagccggatgtgggccctgagcctccagtgctggccggaacagcctgacgcagccgggtctcctgcaggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagaggtgggtcctcgctgcacccagcaggtccgtgccaggcgttcccttgctggacagctgttggttcatgcacctgggcagtgcccctcatcacccggacgccccgctcatggccctcgttctcttcctccgacagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcaggtacgtggcggcccagccactgtccccagctaatgagggctcttcaagcttgctgctccagtctgttggggggatggcgtcagttgcccgaagtgagggcgggtggaggctgcagacggtgactcctgcttccaccttgtgggagcgccgcccccgcttgcagtcttgggtccttttgtttttctctcctgtcttgggtcccaaaactaaaacaaaaccccgaccatcagcttctcagatgttgtccaggcacccgcatgtgcccacctgtggccgccccgcagagcactcggtcctgggaacactcagcagagaacgagcagagccgggctggttctgagcccccctccccactcgcctcaccatctgctctccgccggctccacgtttgctgctctgccaaccccaggctgccctcttcgtttccacacagagcagatgcaggggttggtggcagtggcggctggtaaacagcactgtgaggaagggaaacttgattggactggaaggcgttggtagccgggatctgtgctgccctggagtggggagattgcaggccctgagggatgcttcctgagcatgtggcctctgtgcctgtttgcccgcgtggacccgagatcagccctcagcctaaggttgtggcccctggagaccccatgtaaatggctgtgggacattgttggagatttaagtgaggagtctttgtttgtaccgtggttgttgctttgaaattcaaccaaaagttcaactcaattaaacttgacccaggcaaggagcacccaccaagacctggtgtgcgtttgcccctggaagccgtctgacaggtcacaacacctcagatcctgtgacgggtacagaatgcaggctgctagagggagacgggtgctcacggttaatggggagatggagaggtacggcttgatgtccttttcgagcctttgcaggatccagcactgtccctgcgtggggatgctgaggcctggagtgcatggccctcccaagtcaggagcaggggtggccagggcgtggccttcgcacagtgggtggcagctcccgaacctgggtggacaggtgagaaggccccgccaggcaccgcggcaaagcccagccggctttcgggagaggccgctccctctggaaacgcgctctagttcctccccggttttctgtttcatagattgtgttttgtcttttacgattctggagagcagcgtgtgcccctctcggctgatttcacggcccttgaggtcatggtggagagtgttgctaagaggaggagtcgggtcgggtgactgggatgtgggcaggtgcagggtggctgcgggcagctgggccggtgcgggtggcttcccgtgcggcagcctggcgacgctctgggacctagggggtggggggtttgggatgaatctgaggtcctccattctgatgacagggaagaggatccccagccacagagatgatgtcatccctgatggataggaaggtgtcctcgtgatgatgtcacctcccgttgttaggaaggcatcctggtgatgtcacctccagttgttaggaaggtgtcctggtgatgtcacttcccattaggaaggcgtcctggtgatgatgtcacctcccattaggaaggcgtcctggtgttgatgtcacctcccatcattaggaaagcgtcctggtgatgatgtcacctcccattaggaaggcgtcctggtgatgatgtcacctcccatcgtgtcctggtgatgctgtcacctcccatcattaggaaggcatcctggtgatgatgtcacctcccattgtgtcctggtgatgatgtcatctcctgctgttaggaaggcgtcctggtgatgctgtcacctcccattaggaaggtgtcctggtgatgatgtcacctcccatcgtgtcctggtgatgatgtcacctcccatcattaggaaggcatcctggtgatgatgtcacctcccattgtgtcctggtgacgatgtcatctcctgtcgttaggaaggcgtcctggtgatgctgtcacctcccattaggaaggcgtcctggtgatgatgtcacctcccatcgtgtcctggtgatgatgtcacctcccatcattaggaaggcatcctggtgatgatgtcacctcccactgtgtcctggtgatgatgtcacctgttgtgtcctggtgacgatgtcatctcctgtcgttaggaaggcgtcctggtgatgctgtcacctcccattgtgtcctggtgatgtcacctcccatcattaggagggcatcctggtgatgatgtcacctcctattgtgtcctggtgatgctgtcacctcccgtcattaggagggcgtcctggtgatgatgtcacctcctattgtgtcctggtgatgctgtcacctcccgtcattaggaaggcgtcctggtgatgatgtcacctcccatcgtgtcctggtgatgctgtcacctcctgtcattaggagggcgtcctcgtgatgatgtcacctcccatcgtgtcctagtgatgatgtcaccacccgtcattagcgcattctggtgatgatgtcacctcccatcgtgtcctggtgatgtcacttcccatcgtgttctggtgacgatgtcatctcctgttaaggcatcctcgtggtgatgtcgtttcaggtctttagaagggcttcctgttgcgggctggttgggtttttaatacaaggtgtctttccaacactgcttctctagctcttcgaggccagcaggtgcctaaagttcagtttgtttctgacgctgacgacccacggttgtcatcaggccttgagtctaggggctcagtcccaccaggctgccctcatctcggacccccaggccacctcactgtccagcttggccacagtgttgggggtccccacacacagacttgtgcagttttgataatctgctgaatcggctcacaaaattctggaaaacgtttcactcagcaataccagtttattttaaaggctcaagaacagccgaatgagggggcgcctggggcagggtccagaagggccctgagcatggcacgtgccctctggaagctctccgtcctttcatctgtggcgaaggcatagctgatcccacacgctgcccacttgctcctgcgaagcctcctaccctggagccgctcaggcccagcccacagccactctcaccactgcggtgatcccagggactgggaacaggtctctttctgtaacaccagggcttagtgctttggtgctactcttacttctttatttgacttaattaattccaactctccagccagttgacaaagctcctggacacttctgagaacagcagggcggaacctggcctatgggattgctgtgggccagtcagtgaacgggccagcaccacctagagcagaaggatgtggagaccccccgtctaggaagtcagggtctgttctgtactgtcattctaatcagtagaagcacgatggcaggacagatacgtgcactgaagtgatactgctgagatttggtttcgaaattatgtgataatttaaagcagccacacgatcagtactgcgaacagcacctgttctttagacgctgcttttcatactgttgaataaaatatccaggggggtggctcgcactgtagtcccagtgctttgggaggtggacccgcaaggatctctcgagctcaggagttcaaggctgcagtgagctgtgatcgcacccctgcgcttcatcctgggccacagggtgagagcctgtctcaaaaaaaaatttttcttaataatttaaaataaaatcacaaacctttgacttattttttcttcagtatttttatttatttttttttttttgagacggaatcttgctccatcgtccaggctggagtgcagtggtgcaatcttggctcactgcaacctccgcctcccaggttcaagcaattctcatgcctcagcctcttgagcagctggaattacaggcacgtgccaccacgcctggctaatctgtgtatttttagcagagatggggtttcatcatgttgctgaggttggtctcaagctcctgtcctcattgtcttaaactacataaagtggttaaagattagatacaaaactggtgttttaataattcagccttgcttgaagtgagctaggaatttctaagatcaatgagaaaaaaataattgttatctgaaaacagacttgcagatggtaagctggatttgaatgaagtcaaacacttttacttgaatgacactaataacatggcagccgataactgtgtatgtgtgttctgaaatgtgtataatttacgtgaacagcagcagttcagtttcgaatggcacgtcataaacaactgtttagctgtgccttccgtgaggaagatgcacgctgggctgtagttcatttgaataagtcgacttttgatgaaattttcttctgtttttaatgtgaaagtgtaatttgcaccaaaatatcaatattacttcagttaataccagctcatttatacgaaaggatgttaatgtgatttgttaggttgcgataatcgtcagtttggtggcgggaagcagcgttgttgtggctgcagcagcgggccccctggtctgggtgattgcaggctggatgcatctttgtcacgttaaggaaatgtctctcccttcacttgtacgtgttggaaactgagttctcctaaaatgagcctgggttctgctttttgatagttttcaaaattgatgaaacgacctacttacatcagaaaaaaggaatccctgtttgaatgtctccctccccaggctagacatagtgctggaagtctgaggaaacgggaccagccggcaggagttctgcggggccttcgtgctgcggtgaggacctgggcctgtgtggattggccacgcctctggtcccaccctcccttttctccgtaggcctccatcttggaggaacagtagagtgttttcttctggtttaatccaagagtcccccctgcttgtctgagttcatgtggcgcctgcccagttccctgcactaaatagacctgtgtccgcaatgccactccacgtgtggacccctagtgcctgcaggaccactccacctgtataaacgggtccagcgtggtctcctgcagccaccctcacacgcttgcaacagcactggtgccctgcagcccagttcccccatggcactcctgtctcacggagggtcccacacctgagcagccccaggcctcatctgtcacgggcattggttgcccgattcccccatggcatcccgtctcacagtgggtcccgtgcctgagtggccccaggcctcatatgttgtgtgcattggttgtgctgctgtggaggtggccccgtctccccaccctcctgagagtggtggttcctcattctgttctcggaaccccgtgcagaccccattgtgacaggacgcttggcagtgagggcagttggcccttcgtccctggactggtcctcatctaagtctttgaacgttgtacgttttttctaattctggctttgacctttttggtgctgggctggcaggctggctcactggggacctgggggtgagtgggaacattcagttttttggttagactttttgagatatttgtagatatatatgcagtgataatgcagagaggccctttggaccctttatcctgtttcccctgtggttgcctcttgtgaaagtggggaacaggctcaccactaggacccacacagactcatccagacacagaaccctcacaccagctcccctgcggcccttcatggcctcagccgcttccccttccctgacccttggccctccacctgctgtccctccctgcaccgcgccctctccggagtgctgtgtacggcaagtcggcaaccttctggagttggccctcctccctcagccagttcctggagcacctccgtgcccctcattcatgtccttctcttgcggagccgggtctcatggtgtgtggtggagccaactgtggtttcaccgttcaccctttgagggatatttgggttgtttccagcctttgctctaaatgtttgcacaggttgagcctctcatccgaaaatccaaaattgggaatgctccaaggttcgcatctttctgagcacgaagattcgcacctttctgagcactgacgtggccctggaaggaagtgctcatcagagcattcggatttggggtcaccggttgcagatgctcagcccgtaagtgtaacacagatatttcaaaattcaaaaatccaaaatcggaaacacttttggtctcaagcatgttggatatgggatgcttaacctatctaagtttttatttctttgggataaatgtccagtggtagatacagttgctaaattggatggtgagtgtgtgtttagctttttaaagaaactgccagacctttttctggaatacctgcatcatcatttcatgttttcagcagcggtgagtgacccaggtggcgtggccagtgctgtttattgcagccattctgataggtgtgtcctgagctggttgtggctgtaacctgcatttccgtggtgaataattacccatcactcctgtgtttgttccatctgctagtccttggttggatgtgtggcttacaaatcctttcctcccagtcagcaacttgagttttcatcctctagagggtctttggcagagcaaaagttattaattttcacgagattctatttatcacttctttcttttaggaatcgtgcttttgctgtgaagttaactagtagcccagtcccagatcccagagattttcttgatgttttatcctaaaagttctatagtctttcatgcgacacctcagccccagatgctcttgagggtggttttctggccccagccgcattgtcgccggcgccgtcctccctccatggctgcttctgccgcagcgtctcgagggcactcaggtgcacctgtgtggtctgtttctgggttttctgcccgtagatgcccttgatcaagttggatttcctgttttctgtgtgttgttatcaccagtgggtgttgaattttttaggagtttgttgattgatatgatggtgtgtgtggtttttcttcttttgcctgtcagtatgtggtggtcacattgactgatttttggacatgaaaacaaccttgcaccccagaaacaattcccgttggttgtggtgtatagtaaccttgatgcgcttctgtgaagtgtctttatgttgacgttgaggggcctgtggggctgcacttgtcacgttgtgtgccgtctgcccccaggtttgctgtggctcccgtgatgaggtgggaagcgccccaccctccagcatcactggtgagactgcggacttgccccttcctttcacatattcgggagaattctccagtgagaccgtctggtcctggagattttatttttgcaaggtttaaaatttcatattcattttccttaacagttacagggcttttcacaggacctgctgcgtttgggtgagttgtggttgtgtttttgaaggaattgctccgcttaccttctctattttttttttgtttgtttttcagcctccttatttcgtactttccttctgcttgctttgggattatttcttatgacttttgttttgacagtcaagtgtggtctagagaactcgagcggagtctccggtgcttgcccggattcctgcttccgtcctcacgggaggttccctcggggtcccttccctcccgacctgacctggagtgtccatcatgctctcggggcaggcctgggccctctccagtccctcccttgctgggggacgttttcacaggacaagactctgggttgatcttcctttttctcggggcctgaaaaacatccggcttccttctgggctccgtggttctgatgagtgatcttctgtctttgaccgtttttcctgtaggtaagctgtgttttctctttcactgccttccacgtttttctctgtctttagctgaggtttgatgacgaggtgtcctggtgtagatttggagggtttaccttgtttatgtttgactctgctttttgagttggaaggtttatgtcttttgacgtctttgggacatttccagccattgcttttcagggccatctctgccatgctgggacagcagggacacggatgctgaggctttttgtatctcgtgcatctctaagctgtgttctttttcctgttcagctcgttttctctgttgtccaggttgggtgacttctgttagattttcgggttcacagccttcctctgtctccttcatttgttgctagtctgtccaggacattttttggttttagtttttattttctgtttataaaatgtctgtatcttctatttctttgccaatcctttctgtgtttttcagttgtttcaagcatacttgcaattgcctcttgaagcatttttatcatggatgctataaaatcattgtgaattttagcatctctgccctctcagcttggcccttgttgattgtccttttctccatagtttgagatcttcctggttcttgctgtggcaagtgatactggattgaaacctggacctgtcacatcatgttaggagactctggatcttatttaaaccttctcccatcactgattttttttttttgggccatgctccagcagcaggagtggaggcccccttgttcctgccatttgggataggagtccagttccccacacggcctctttttgatgcctgagagtgggggatggaggtgacgaggccattgctggtggacggctgtgggggatgggggtgacaccattgctggtggacggctgtgggggaagggggtgacgctgttgctggtggacggctgtgggggatgggggtgacgccattgctggtggactgctgtgggggtggggtgacgccgttgctggtggatggctgtcggggtgggatgacgccgttgctggtggacgtctgtggggtatggggttgatgccgttgctggtggactgctgtgggggtggggtgacgccgttgctggtggacagctgtggggtatgggggtgacgcccttgctggtggacggctgtgggggctggtgagaatcctgaccttcccgcgtgggtgtgtggggcctcattgctgccggtggggttggatgtcaggctcctccatggccttctctgagaccccagaggtggggtgtttggcgggagtagagcagttatcataggtttttaacatttagttgaaacatttaattcagtttaaaataacagtgcagttggccctttgaacaacactgctttggactgcgtgtgtccagttgtacgtacatgggtgtttcagccaaatgcaggtgggaagcacagcgttcgcggtgttcgcgggatgggaagcgtggcgttcacgggatggaaagcgcagcgttcacggtgttcacgggatgggaagcgcagcgttcgtggggtgggaagcctggcattcacggtgttcgtgggatgggaagcgcggctttcgcggggtgggaagcgtggcgtttgcggcgttcgtgggatgggaagcgcgtgttcacagagggccgccgtgaagagtggactttgacaaggcttgggaagtcctgaattccaaacagcgcagatcagcactttcagatttctgggcagaaaatcttctctccattagtaaatagcctaacatggttgtgtctttttagttttgtgactttgacttagtgcccgttttccttcaccaggatgggttttatcaccttcatcctcgtgcctgtcccgagcgagttggtatctgggacgcacgcttagtgcctcctggtctcatcctttggtcatccagggaagaaccagcagctagaaacagccgcctctcaggagggccgcaccacccctttcccagaggcttgccttaaattccagcagtcagaggcatgcatcagaatatattaataagattgacatatccagatcgagaaagatgtgtacagaggagagaaactatttcaaacggagctgcggtttgaacatagcagaaagatccttgaaacagaagattggccctttctagttgatttattacattaatatttaactatacaagcacaagatttacctttttctgttttttcgtgaattttttttttaaggtggagtcttgctctgttgcccaggctggagtgcagtggcgcaatctcggctcactgcaacctctgcctcccaggttcaagcgattctcctgcctcagcctcctgagtagctgggattacaggcgtgcaccaccacaccgggctaatttttgtatttttagtagagatggggtttagccatgttggccaggctggtctcgaactcctcacctgaagtgatccacctgcctcggcctcccaaagtgctggctttacaagcatgagccaccgtgctgacctgtgaaatgattttaatttcagcccactgacgtctgttttgtcacttggccgttttttgtgtctgttttcgtagcctggagatgttgcattttcttgttttgtgttttgccgtgtagctctccggaccctattttgagggtgaatgacatgtcctgggggttcccagaacacgcttcatctcccgtctctctttgccctttattctaagatgccagagcctggcagatgctctctgccccacgggggttttgtggataaaagaagatgggtgttatttttccacaggatagtcagaaacgtgttttgccagtcaccctggctcagttagcaaattctgatccattaacctctgaaaagtgtattggcgaaacatcacgtttttcatacgtgttccctgttggggtgtgtgagtgtttacctagtccgagagccaggagtctgattcggtgcggaaaagtgccattcgaactgaccttcctcatgtgggacctatgaaattcctttcagagcggttccgccaccccagccgcagatgtttggtgaagagctgcctgacgctcaggacggagagcagcctggcccttctagaagaaagcgacagcccagtatgtctgagacaatgccgctgtacactctttgtaaggaggatttagagagtatggacaaagaggtgagccaaccccacgccccggtgcccgcgccagcgctcgtgctggggccgcagagctctggtgtgcgggcggattgctgagctgtgcacctggaggccgagctagagtcctgcacttgtgtagttgtgtctggtttgggacgagcacttgtgtttttcacgcaacttcctattcaaggagacctagaacagcattaagcaatgtgtccgcagtgtgtggcatgagaacacgtggaagttgtggcttaggattcgtgcctgcgtcttcaccaggaccgatgccgcccagcccctccggctctcccggctcaccccaaggacatgggacggggtctggaggcactcatggtcatgacaaggggtgaccctggggccggtcaacaccccctgcctgacgccgaccggcccccattgagaaacgctggagggctgtgtgttgcacgtgggccttaaacacacgcacacagagtgactggtgattctcacagcatctcgttatcacagcgcgaaacaactttaggcagcatcggtggagctggggttttctcagccgggtcctgcttggcccctgtgtcctgggccccttggcccgtgtgcttctcctcttgggtcccaggccgccccctgatagaaggttccacaacagtccggatgttagggatgggcgatctgcgcagcaccgtccttcggagactgttctttaggaggactgtcctggaaaaccacatcccatgtcctcctgtaaggtgccctcatgggtggcgcctgtgtggggtgctcacctgcagctggtcagggcacaggccgtccccttccctcaggtcttcatgttcccaccagagcctatcctccctgcccgcctggcaccgctgtcctctggagagagccaccattctgtttgcatccagaaggcagcagaggttcttgaggaggaaaacagctcctgtgtatcttcaacagtagcagaaaaatgcagatagttctattcaggacagactcgtctcagtaactcaggtcatcacctttagacgccagtttatcttgtgaggatcagacccttttttgaggtgtgctgaatttctctgccatttttctgtctttttgaacattagctgttttttgtttcacaaaaatgttttctctaaaaaaaatttttctcagccactacctgtaagcccagaccactttatttaagattccagaaggttctgtataaggaacagtcacctgcctaggaccaggggtgggaggagaggagggagggacgctgcctcttcctgcctggaagctgctgacacgtcccgtctccctcctggtttcctggtcgggcgtggaggactcggggtctgttccccacgcagtcctgtttcaggcagtggtgacaactggttcttaatggttgaattctcaatgggagacagatgtcttgaacgcactcagcagctttcagccaccccaaaacctaatcctttctctcagaaataaaaagtaatcgtaaccccccagatgtagctctttgggaacaaatggtattgaaagcagaaggctgcagccgtggattgttctgtgcatgggagagaggccagagggttttatgttcgtgaatttttaaagcctccttgattctctgtgagtcctgggcccttaagacaatcagcgcctgcaggcaggagaaggggtcagaggagccccggcgccaaggacccgaggcctctggaagctggaagatgtgaggaagggattctcccagtggacacctggattttggtcctgtgaggctcatgttggacttctgacctgcacagctgtgaggttgtgaatttggatcttttgagccgtggcgcctggttattacagcagcctcaggaagctcctcgtggcctggccctggcctgacagcctcgtctcacatgtgtccctcttccactccatgtgcttggggcagatgaggcagcttcaccccagataagcctgtctctcgggcccattgcctgcacccccccgtgggcctgtgagacggactaggtacctgcccccgggtgctccctggaggctgccgtggcccctcttcatcctggggacacatggggtggggctgctgctcgttttggggcacagacgatggggagtcaagaggatctggaaccagggtcaagtgcagcccgtcagggggcctttgagtgaggggtgtcgagatctctggccatttccggcgcgtcagtgtgttaggtgggcattggctgctccagtggtagaggaagggtctccacgtcgacagaggagaggcaaagttgctgacccaagagtagcacctgccgtgggggatgctgctcccacccacactgacaagggcttccccgcccctcatgtgaggagcagctttgggaactcgcgcctggtcagtgctgtgggaatgtgtgcccagttccttgagacccagtaggcatctggatttcttctcgggtttaaaccacggaggcttctacagctaggagaccactcacttgatgtcactgctttcaaggaaaacccgtccccgtgtagcacatgcttctgacctccacgtccagaacatgcctaagcagagcgaggcatggcgtcagtaagcgttcacctgcaacggctttgaagaaacctgaaagccatgaaaattaacgttgtaattttatcttaaccatttttaaattctgcatttaatatacgtggaagccaagaaatatgatgaccctgataaaatgcctcaagaacagaggccgggtgtggggccaccatcaccaggagtgctcccaagatcacatgagatgtaagaactcactaacatcaggagtgctcccaaaatcacgtgagatgtaagaactcacattaggagtgctccccaaatcaggtgagacatgagaactcactaacatgaggaatgctcccaaaatcccatgagatgtaagaactcactaacatcaggagtgctcccaaaatcacatagacatgagaactcgctaacatcaggagtgctcccaaatcacatgagatgtaagaacttgctgacatcaggagtgctcccaaaatcacgtgagacataagaactaacatcaggagtgctcccaaaatcaccagacgtaagaactcgctgtcatcaggagtgctcccaaaatcacatgagacttgagaactcactaacatgagaagtgctcccaaaatcacagacatgagaactcgctaacatcaggagtgctcccaaaatcacttgagacatgagaactaacatcaggagtgctcccaaaatcacgtgagacatgagaactcacatcaggagtgctcccaaaatcacgcgagacatgagaactcaggagtgctcccaaaatcacgtgagacatgagaactcacatcaggagtgctcccaaaatcacgtgagacatgagaactcacatcaggagtgctcccaaaatcacgtgagacatgagaactcacatcaggagtgctcccaaaatcacgtgagacatgagaactcacatcaggagtgctcccaaaatcacgtgagacatgagaactaacatcaggagtgctcccaaaatcacgtgagacgtaagaactcactgtcatcaggagtgctcccaaaatcacttgagacttgagaactcgctgacatcaggagtgctcccaaaatcacgagacataagaactcactgtcaccaggagtgctcccaaaatcatgtgagacgtaagaactccctaacaggagtgctcccaaaatcatgagatgtaagaactcagctgtcaccaggagcgctcccaaaatcatgtgagacgtaagaactcgctaacatcaggagtgctcccaaaatcacctgagacatgaaaactcgctctcaccatgagtgctcccaaaatcacaggagatgtgagaactcgctaacgtggatttttcttctggaagcgactctaaagcatgcacccccacacagtccctgagtctcctcgtggtgggcgtggccaaagcactgtgcctggtgactgtgtgtgaatagcactcagtcctcgtgctgtggcctcagcacaggacgaatgtgtgttgtgtgtgtggatcctcacgccacggcctcggcacaggacgggtgtgcgtttgtcgtgtgtggatcctcacgctgcggcctcagcagaggacaggtgtgcgtttggcgtgtgtggatcctcgcgccgcagcctcggcacaggacgggtgtgcgtttggtgtgtttgtgcacaaacacccgcctgtctcagccagctcacaaagagactcacacccatgtgtcggtccccctgcaggttcctgtgtgatcatggaactgcggggaagggaaggtgccggaaccagggctgggagatcactgagggttgaggtggggcccgtctcctgtacacccctgcggaaaagcctgctgggccccagagccggcgtccgctgcctctgcagctgcgttacctcgttcctgcctgttctgctgggccccaaagccggcgtccgctgcctctccagctgcgttacctcgtttctgcgtgttctgctgggccccaaagctggcgtccgctgcctctccagctgcgttacctcgtttcagcctgttctgcttctcatgctcaggatgctttcccgaccttgctctgtgtctcttcttgtttcccgtcctctctcttgaagccgtcccacctcactccagcgcagagctggggagagttttattctgtgatccagggtcgtgcaaggaggttggtagaaacatttcatttccgtgcattgacaggataccgtagcatctgctgttatctgtatttgctctttggtagaaattccaacacttaggtatgaattcacttgtgttttttctctttacatacttttaaattttccttaagattaaaaaaaattatgttagcatgttttaagtgaagtaaatacaaacgaccctcaactttacaatagttcgcttaacaattttctaactttacaatgatgtgcaagtgacgtgtgtttggtagaaaccacactttgaattagaagtcttggctcagaattctgtagaacagcttgttccaagtcggccttgtgctggacgactttgccagcgatggggtaatgtctgagcgtggaaggcggctgggccgggtgtgctgacacgttttcagcctgtgatgggctcatctggacgtgaccccatcctgagtcaaggagcctctgtaatgaagaaaactgtttttcagaaagcgcagtcaccttttttgtaaaaacaagcccaggaaaggtaggtgtcgttcccacatcagtgtgtttacacgagtcaggcagaaagagggagaggagatcggaggagcatgatgtaggcgaggtcaggttttaatgtgaatgtgtgcccacgtttctggcttggctgtgcaaaacgtacctccagatcttccagatagcagcacgggggcacgtgccgggctgccctgcctcaccagcgttggcacggacgtctgaggccctcccaggtggggcgccacactagcgagggtccctcgggtccgtgggctgccgtgctggccggcccgcctgcccttggctgtcaagtgtaaaataacagattttaacagtgccttgtttttctctcttgacaaggtatgatgccgtgttaaaggccctaagtatttcagaatagaatttagtagaattattcccgtaggagatttgccatcgaaacagtaaattcagtgatgtaagcattctggtgaagtgtgaatattagtaaccttgtcgagtaaccagatgctcttattaaataccattccatgccagcgtccctgggaacatgttacttttagagatcattataatgacctgatgataaagccgctgccttagctaattaaccattggttaaaatgtttctgccttttaatgattcaggccagggcacatgtgctgtgactagctggacacgtggcgatgagtttgaaattgcagagtggacggggtggatgcgtcggcctccatgtgggctcgggggctgagctgtgatttctgatcgaagcggcttcacaccgagtctctgtgactctggactcggcctcgactgctccgaaccgcgcctgtctcgggagttgtgctccgtcctctgtggccgtttctcgtacctgctgcgggggtggggttaggtcggcgtcggtgagtgcccctcaaggccccagccaggtgtgcacccccagatccctcctgggaaacagcctgcgctgggggactgtggtcaggccgccccgcctcacctgcctgtctcagggaccacggggctgtgccgtcgcacacagacgccctcaacgtcggagagctgtgagcggggccgtgctcttgggatgggagcccccgggagagctgcccgccaacaccactccgacgtgatccatgctggacataaagtgctcttccctccgctagtcatcggccgagcgggcccctcgctcctgggtgtaagttctttctgtgcgtccttctcccatctccgtgcagttcaggagaggaggggagaacttgagttcacctcccggcactgggctcagcctctcccgccgccacatcgaggcactgacggtacccacctcccgcctgctgaggttcggggaggctgaggtttggatgcggtactcccatcacctgctcacttgcctgccgcctctgttgccactcccgtccgcgtcacacgtgtcaggcgtggggccggctgagctcaccccaggtgttcaggagtcgccctctctgcatgtttcccaaattggaggcgtgcccagagcgagcgggtggacatcttagcgagcgtccctgtggcacggccacgtctccacccccaggtggctgctctcccagattccaggatgggaaggactgggacgcctccctgaaagccctgccactcaggagtcttgctgtgaatctcattgatcttgaaaatttcaagcaaatattctgattattcaccataaaatccaacagtgcaccaggaataaagtccctgttcacataagggacagaaggaatttaaacccaatctttgcctgcgaaccgactgggtttgctctgtggatttccaagcgtcttttgcccggggctttgttaaggattggttgagtttcaagccccagggctcaggtagaaagcagagtgctacctccagcccccaccctgctgcactcagagccctggactctgccgggagaagcctgttgcggaggaacggggcccgggaaggaggtctgtcgctgactcttggctgtttgtcaggtggacgacatccttggagaaggcagcgacgacagcgacagcgagaagaggaggcctgaggagcaggaggaggagccccagccccggaagccagggacccgcagggagcggacgctcggggcacctgcgtccagcgagaggagcgcggcagggggccgggggcccaggtgagtgcggggtctgaggtgggaggggcctgacacgggctcccggaggtgactctgcagttggtgggccgcctacctgcatctcattcttcacgccctccaccattctgtgtgtgacaccagcagcttccaaactcagcagcccctggtgatggccacttggttgtctccatgctgatccatgtcatcttacatgtgtgcaggcgtgtgaggtgtgtgcaggtgtggggggggatctgtacatctgcgcaggcgtgtgtggggtgtctacacgtgcacaggcgtgtggtgggggtatgcacgtgtgcgcaggcatgtgtgaggtgtctacaggcgtgtgtgaggtatctacacgtgcgcacaggcgtgtgtgggttctgcaggtggggggtctgcacgtgtgcacgcaggcatgtacggggtctgtatgtgtgcacaggcgtgtgcagggtctgcacatggcactgctggtcaggagccagcgtcctgcatgtcgagggtggtgcctgatgtgggtcccccgccggtgacagtggtccccgcctccagcgtgcggtctgtgggtgggaagagctgagcaccgtggtttgctttgcgcttccttcgccatgaatgaggcctgttttcgggcgtttggccgcaacagcgcactctaaacgctgctcacctgctccttgtgactggtcagtgttttctgcattgccgtgaaaggtatctttttgtcacctttaacttggatgacatttctgccatgcagagatgttactattgtgcagatcttacagctgcttggttctgaatcttgtccgagaatcttaaccctgtgtcttttccttggatgcgtttacgtttgaccttttctacatatgaatctttgtaaattaagatttattttttagtaagggggggatttagcttttttcccagatgattagctcacggtcccatcgcagtttctgacatcatctttctccactaatcggctttgttctctggatctctgtgctgctgtcgaatggtggggaggagccggtttgctttgagacatcttttctcaggttggtcgatgaacaggcatgaaacccagggtgtggagaggtccccgtcccgcatcccccatgcatgtccttgtgtgaaaggcagccacctcactgcccggttctgggtggtggcggagacctgccgtgccgttaggcattttgggtgccgtctgttgattcttagcgttcaacatacagactgcgtctcttcttgcctccgccctgccaatatcaacacgccaggatttgggggtgtggaatgacgcagtgtttcctatgaccgtaaattgcttttaccaaatagaataggacacggtgatgctgttccctttcttaaacatctgttttacctggatttgataatcacctcacttttgttagctttcttcctttttgcctgtttctgaatccctggctgcctctccgctccactcccccggcctcccccgcaggtccccgcctccccccgcccgccctgctcaccgcccccgggagttgccttccccactctctggggtgttctctgtctctgcattttggtggagtacatctcccagaagcttcctgagaaagcgtctgtcctgtccatacgtccgcagtcagcgggctgcgtaaccccaggtggcagcatctccttgaggatttagaagcacggctcccgtcttcagctccggggctgctccgaggccgtccgaggtaacctcggaggctttgtcttgcccgcctgttagacaggatgtggccctccaggtcctgccgacatcctcagtacagacttgtgtcccgaggatttgccctgagaacttggtctccagagccttcttgcatctgctgcggggccgtgggccggtatttggacctctgcatcctggtttcctcacctgtgaaatgaggtaggagcagcgccagcctcggaggagctgctcccagcttcagcaggctagcagggggcactccaggtacacgtctggtgtctgtggtgaagaagacagtgcagactgctttctttctccccacgtctggtcttactcttaggctctcctgtaggtgaataaacagcatttcaagaaaagagcgtaactcattcaggcaatccagttacaaaattgggccagaaattccagcaacagatgcagacaagacaagatagtcattgttccgtttgcaggaattacttacagaaaatcacttgatttgcagctctgtggtttagcagggaaatgagtgcagcttctctcctggcaacccactctgtgtttaccacgtagaaagcagcattttccagctgtgttgaaatgatatgaagttgttttaggagagattttgaaattccgtattgggtgataacaagccttggttcttcccacatgaattacggggtggttttgcctggccgtaccttccttcacttttcggtgtagacccattgggtctgtcatgaagctctggggtcaggcctggggaaggcggtgcactgggggcctctgggagggttccactgccctcccctgaagaccctctagcccggggctgagctgagccagctccaaggagtctgtctgccgtggccatgttagtatctgcggatttgcagcgtgctctttgtatgaacataggtggtttaacctgatagtttttttttctaattaaaagaagaaacccaaagtgcttttccactaagaccagtcagggtgttgctggcggccagccacgtcatccaggatacgtgctgcatccgtgtctccccctgtgggcaactggatgtggcgctcagcgggtcgggacccagagctgctgaagacttgggggccaggactggagttagcacccctgggtttttgtggtttttttttttttgctaaatgacctgcgcacggcagaactgaccctcacgggtgaaaccacgcaagcacgattagagaaccacgcaagcacggaactgaccctccctggtgaaaccacacgagcatgattagaaaacccctcggctctggcgcggcttccatgctgccctcccagctgcaggaggtggttggggttctgcctctccattctggctcctcgggcaaggaccagatcagtactgtaattgccgtttcactctatgtcttacagactcggtgggcttgggtgatttcagaatttgagatcaggagaataaagtgtcctgggagtctgttcaggttctgctgcgcagccttcatacccgccgccaggacgggtgggactctcatacccacggccgggacgggtgggactctcatacccacggccgggacgggtgggactctcatacccacggccgggacgggtgggactctcatacccacggccgggacgggtgggactctcatacccacggccgggacgggtgggactctcatacccacggccgggacgggtgggactctcatacccacggccgggacgggtgggactctcatacccacggccgggacgggtgggactctcatacccacggccgggacgggtgggactctcatacccacggccgggacgggtgggactctcatacccacggccgggacgggtgggactctcatacccacggccgggacgggtgggactctcatacccacggccgggacgggtgggactctcatacccacggccgggacgggtgggactcggcgcttgctccctgcctgcaccacgcctgccgtttgcggatcgctgtggacgtgtggccgcgatagcagcctgactgctgggggccgtgtgtgcccctcaaaagggtggggcggtggggtcttttcagcttcctgtccagctgggtttttgtgactcttggactttggggacctcacttcttccttaaagaccagggacttccagttttatttcattcctgtttatggggtattcagtgagatgtgaatgttttgaaatttttcacatgaaatttttgcttgtaacgaagtaaatgtggtttgagttttttatttttgcatgttgaacatgtaggtttcatcatgattctttcccatgcgtggcaatgcgtttcgtacagaagctggaggtcactctgctctttcctgtcagtgctctagctggtggtacgtcttgctaatttcgcatggccaagctgttccacagaatcttaatgtcagttgaacttgaaaatgagttttaacataagggggaaggttgtgttttttacttgtctaccaagagtgattcattcttctctcaagtcaacaaacatcagatgcctgttctatatgcagccgcctgccgggcactttcactccttaaaataaatcctcaaaataaaaaaccaaacaagtcatcttcagaatgtttaaggatctcacagacacatcgtcccaacaccagttccaggtaccgaaaagaacaggcgcccaggtgaggtgaggtctcctgcacaggttgggtgaggtcccccgtgcggttgatctgtccctgagtccctgaggtcccccgtgcggttgatctgtccctgagtccctgaggtcccccgtacggttgatctgtcccttagcccatggttgggtgaggtccccgtgtggttgatctgtccctgagtccccgaggtccccttgcggttgatctgtccctgagcccgtggttgggtgaggtccccgtgcggttgatctgtccctgagtccctgaggtcccccgtgtggttgatctgtccctgagcctgtggttgggtgaggtcccccgtgcggttgatctctccctgagcctatccttttatgcttttggtggccggaggtgaatcatcactcacaaaggcaactttaaaatataccatagcctctttcttcagatcattcctagagttcgcggagaagtgaaaacgacattgagttaactgccaagaaacatagcacagcatggtgggagctgttatgttactggcaagaagatgagctggtcgttcccatgatctgttgacagagacaacagctgatgatggctccctaagtacttggagattttagtcctggtgcccccgtttcctgtcccatctggtgcagtgataaacaggaaaggaaaacagcaccacgttttaaaggcttagtttcctgacacgagtacccagatcccaacactcagctcttctccacaggggtgtgtggtcagcctgcgtgggagacacagggcggcaggcagggtccttctgaggttcacctcctcttgtccgtttgggagggttgcgtgagctcccactcttagacaacagggaatagtgctccaccagaaacactcacacatcaaagttgtttttaatcttggataattaactaagaaagataatctttaggagagagaggagcagaaaaactattcaaagacataatgactgaaaactccccaaatgtaatggaaaacattaatttatacatcccagaagcacaacaaactccaaataggatgaacacaaagatctttacctaggcacatcccagtggaagaggaaatgccgggagcagggctgggggcccagaggaagcatgaggcgtcgtgggagagaggcctgggggcagcagaggaggcatgaggtggaggcctgggggcagcagaggaggcatgaggtggaggcctgggggcagcagaggaagcatgaagcatgagagagagagagagagagagagagaggcctggcaccagaggaagcgtgaggggttggtggagagaggcctgagggcagcagaggaggtgtgaggtgtccacgagagagaggcctgagggcagcagaggaggcatgaggcgtccatgggagagaggcctgagggtgggagaacccatcacaccacagccgcttctcctcagagatggcaccaccacacccaggcccctgtatccagcaaaacaacctttcaaaaacaaaggcagggttttcccagacaaagtgggaattcactagcagacgcaccttacaagaagttctaaaggaagctcttcaggctgaaagcaggtgacttagatgaaatctgaatccacacaaacaagcaagcacgaggaatgcagattatgtaactctgtaaggtagcgtgttgcttctcctttattctcttgatttaaaaagcagtatagttttatagtataagactctatgcctggacatgtggtggctgtggctcacgcctgtaatcctagcactttaggatgccgaggtgggcagatgacttgaggtcaggagttcaagaccaacctggccaacatggtgaaaccctgtctctactgaaaatacaaaaattagctgggcatggtggtgcacgcctgtaatttcagctactcaggaggctgaggcacaagaatcactagaacccagaggggaggttgcagtgagccaagatcatgccactgcactcccgcctgggccacagagcaagaccctgtcacaaaacgaaataaaacaactctttgtacctaattgtattgttgggcccataccatgtggagatgtaacatttgccagtagccgcgccgaggaggggcctaggattaaatgacagcagatggtgactggaatttacagcaagagctgaagagacccaggagtgctgaacaagaaggttggtctcaccgtgctccgagtgtgcacctgttccctgtcctgctgtaaataattacaacgatgcattgttgggtttgtagcatgcatggatgtggtatcgtacagtgaagcaaggccgagcacggtggctcatgcttgtaatcccagcactctaggaagctgaggcgggcggattgcctgagttcaggagttcgagaacagcctgggcaacatggtgaaaccccatctctactaaaatacaaaaaattagctggacatggcagcatgcgcctgtagtcccagctactcaggaggctgaggcaggagaattgcttgaacccaggaggtggaggttgcggtgagccgagatcgtgccactacactccaccctggacaacggagtgagactccgtctccaaaaaaaaaaaaaaaaaacagtgaagcacaaagtgaggagtctgagtgtgcacctgctctcactcctgctgtaaataattacaacgatgcattgttgggttcatggcgtgcatggatgtggtattgtacagtgaagcacaaagtgaggaggggctgagctgtgcagcagccatgtctccgtatcgaattggaattaggccagcatgagtccaaaattgattctgatcaagcgagatatacgtatgctaaacccaagagcagaagctaaggaagtaactcaaaatacatcgtgaaacagatcatacaagtgtgaaaggaggataaaccttgggccccaccatcatgaaactgaagggaaaagtcacactgggaactgctcagggccagcctgcctcccgttctatccaacctcccgcccattctatccaaagccaccctccgctcactgagacagatgcagctcagggcaaacccgccacccattctatccaaagccaccttctgctcactgagacaggtgcagatctgatggcctcctttggagaggctgatcagaaactcaggaggatgcagccatttgtctcttgtctacctgtgacctggaagtccctccctggttccagctgtcccacctttccagagtgaaccagtgttcatcttacatatgttctttcatgtctcatgtctccctaaaatgtgtaaaacagagccgtgccccgaccacctcaggcacatgtcaggccctcctgaggccgtgtcacaggcaggtgaccccaaccttggcaaaataaactttttaagttaagtgagacctgacacagatacttggagttcacaaaaggaaccaaaatgttacattagacagtattcacttaatgcaaaagaaaacagaaaagggaagacaggaactaaaactacatgaggcatgagaaacaaagcagagtggcggtgtgaacgtgaggggattcagagctttaactatgagtggatggacaactgggtcagaggccatcaccgtaggaaagctggagtgttccgctaatatcagagaagactgaatttaaacaaagaatgcttctacaggtaaagaaggacgctttataatgataacggatggaattacgatgctaagagctggatccatcgggaagagtgacagttgctagcacatgtgcaccggaagtgagaaccaactcaccagtggcagaaactgacaagcaaagggagaggcggccatggcgagaccttggaggttcccccgccactcagtcatggggggcgtcgtgggaggatgctgcccctggaggggccacagaccagtcctgaagctcttacaggaacgcaggagaccctggagggtcttgaggaagagcaggccagaggacgcacatcgtgcttcagagtaacggaggctggtgtgatgacagtgtgctgggccgtggagcaggagtgtccatcccagaacagccccatgtccatggccagctggctctcagcaggggtaccaggccactccatgggaaagacttgtgggtcctgagagtggggtggggaatcagaaggtgctcctgggattaggaggtgtccccacgacatgtaagttcatgtgagtttcaggcttttccaaagcagttgtaatgactgtggcatggataatttttgtggggaagatgagtggtcagcacacatacgtgtttgactggattgtgcgtccctcccatgcgcgttctgtccctgcgtccctcccgtgcgcgttctgtccctgcgtccctcccgtgcgcgttctgtccctgcgtccctcccgtgcgcgttctgtgcccgcgtccctcccgtgcgcgttctgtgcccgcgtccctcccgtgcgcgttctgtccccgcgtccctcccgtgcgcgttctgtccccgcgtccctcccgtgcgcgttctgtccccgcgtccctcccgtgcgcgttctgtccccgcgtccctcccgtgcgcgttctgtccccgcgtccctcccgtgcgggttctgtccccgcgtccctcccgtgcgcgttctgtccccgcgtccctcccgtgcgcgttctgtgcccgcgtccctcccgtgcgcgttctgtgcccgcgtccctcccgtgcgcgttctgtgcccgcgtccctcccgtgcgcgttctgtgcccgcgtccctcccgtgcgcgttctgtgcccgcgtccctcccgtgcgcgttctgtgcccgcgtccctcccgtgcgcgttctgtccccgcgtccctcccgtgcgcgttctgtccccgcgtccctcccgtgcgcgttctgtccccgcgtccctcccgtgcgcgttctgtccccgcgtccctcccgtgcgggttctgtccccgcgtccctcccgtgcgcgttctgtccccgcgtccctcccgtgcgcgttctgtgcccgcgtccctcccgtgcgcgttctgtgcccgcgtccctcccgtgcgcgttctgtgcccgcgtccctcccgtgcgcgttctgtgcccgcgtccctcccgtgcgcgttctgtgcccgcgtccctcccgtgcgcgttctgtgcccgcgtccctcccgtgcgcgttctgtccccgcgtccctcccgtgcgcgttctgtccccgcgtccctcccgtgcgcgttctgtccccgcgtccctcccgtgcgcgttctgtccccgcgtccctcccgtgcgggttctgtccccgcgtccctcccgtgcgcgttctgaccccgcgtccctcccgtgcgcgttctgtgcccgcgtccctcccgtgcgcgttctgtccctgcgtccctcccgtgcgcgttctgtccccgcgtccctcccgtgcgcgttctgaccctgcgtccctcccatgcgcgttctgtccgtgcgtccctcccatgcgtgttctgactctgcggtctcttcagggtttgccactcgagggtgtcggaggtggaggttgtgttcgttctcccttcacatagcacgcggagttttggtttgtgaaagtttgctttttcgtgttttcatagctacacaaactgcatctcttggaaaagtgagagcgttttgacaactgctgtcactgtgaacaggtcaggaggccctgccttgcccaccccatacttaggggcttaagaaacaaggtctcactctgttgcctgggctggagtgcagtggcacgatcatggctcactggaagcttgaactcctgggctcaagggatcgtcccgcctcaaccttccaagtaggtaggaccacaggtgcgcaccaccatgcctggctaatgtttttaaaatttttttgtagagatggggacttcctttgttgcccattgagaccagcctggcctcaaactcctggcctccagcgatcctcccgcctcagcctcccaaagtgctggacctacaggtgtgaacaccgtgcccactgtgcctaccgtgcctaggggtgttaaagtggtccttggtgcacagggctaaaggctcctggtcgcgtgacttgaccgtgtgctgccagccactctggtgcctgcagtttagaatttgggtacaaagctgctgaatcaaatagtgttttttaatgattgcccaattttaaatgagagacattaatttttttccagtcctttcataccaatacacgaagcagcaattcttaccctaaaataggtcactgaacttcccactttaaagagccccggcctggcagcaggctctcggaggggagggtcaggtgtggtgagcgcccggccagctccctgctgggaagggcccctgcccctcttccacctgtaacacacacaggttcattctaatgccatgagattgctgaggagagcatgacaatgttcacacccagagctgtggcatccccgctggggccctgcgggaactgggactcaggtgcagacgccacggagggagggcaccgctggctctccctgggcccgggcccactctcagcagcagaccagctcttgccgcctgctttccttggcagagcccagccctgtgttgtaggtggttggactgttgggtcccgctgacgtcatctggtgggttccttccaggtccccgcggagccccccacgcttgtgtgaggcttcacctgctttgggcagccccaacgccgctctcacgccacgttccactccagggtgcactggggaaattatccgccatgcgcagcgcctcctgcaggtgtccggtgcgtgcagacctggccacgccggcacgggttttttagtgacgtggcggcctcacggtgagcagcactggtcttcccttttgttcccgcggccacgctggcagtggccacgggaaccctgtgcctgtggattgttccatcccctttggattagatgctggtgtgacacaattgtgcatttgccgcactgacggatatctttccggtgccaaatcgtgtgcactgtgacagcccagtgtgtttggaaaactgaaatatgggggtggggtatacatatatattattctgtttgtattcttgccttattcaatgttgaatttgagataaatgttaaagctgtaaattttccccaaattctatctgttaacatttctctatggagctgtgcagctggttgtatgaacaaaatacaaatattgcatgttatgctgaggaagtgaagctagtatcagttgcggacatttactaaccatagtctgcagctgtgtctaatgttcgaggtaatttttaatgactaaagtccattcatctcgtatttttaaatcccatgctccaaacatcgtttaactaagagcaaaggttttgtgccaccttagtgaggcgctccctgtacttcatcacggagcgagaccgagggtgcagcattcgcagcaccaggagggaccgcgcagggcctggggggacccatggagggagggccgccccagcccgggctctgtgacccctcagggtggaagccgttgacctggtcccagacactcagcctcatggaagccctgaccctgtctcccgagtcagctacgtttttccaaagtgcgtggaggacgtttctcagcattcttaccagcatcgtgaggtccaggcccctgctgtgagatggggatggtggcgcctgcccgcaggtttcttgtgaaaatctaaggaagaagcacttagcacagccccagaccacagcgtccccagctgtggatccacaagaaactgttcccagcgaatgccatgagcgcctgcggccgcctcatctcacacaacagcgacagagtcatgatcagaggcctttagagtcatcattatcatgtctgtgtgtgagccgtgactgcctgggagccgtgtctgcctgggagccgtgactgcacatgagccgtgtctgtgtgtgagccgttctgtgtgtttgccgtgtctgtgtgtttgccgtgtctgtgtgtgagccgtgtctgtgtgtgagccgtgttggtgcatgtgcacagggctctccagcgggagctgaggtggtcccttccgtgggctcggttcaggtcctgtggcaccctgccaagttatgctggcgtttctgaaggtgtgtcctgctgtcaacagcactctgggtgtttttgtcggccttgtgaggggaacatatttctaaacctcaaacagagagtcacagctggcatttcccattctttgccatcctcttgctgccattagaactctgccacggatggcttcctcgcttgattttagaaagaaaagaattgttggaactggttcttgcacctctcgccctccccctcctctccctgcttgccccagggtcccgcctggctctcgtctgccccgtcttcactttcggtcggggcccctgcccctgcccctgctctgctcagtgcccctgatacgtccaacccagcgtcgctgtgagggagtcaaccacacctgccagcacccccgagtctggccccactaggaggggccagggctcccttgagcaaggcatcagcacacaggcagggagccgggcaccagactgtgagggtcgcgccccgtgcacacgagatccaggcccgccccctcctggacttggtgaccgtcccgagctcgacctgagagggcacttcggctctcctgttcacagtcatgactgccccctccccgaggtcagcgccatgcactgctctgggggcctgaaacaccgcctctgttcgcaagggtctcctgtcccgtccacctgccagtgggttgagctcttccaggggttcgggacacccctcacggcagcaccttcacgtttacgagaactgtctctgtcttgttttgtttcaagttctcaaaacggagtgaggtggaggaagcctaatgggaggatgggagccgggttttcccggaacagccgtcagcgtgtatgcggaggaaaagagatgactgatgaatttgttaattgccaaaagcttgttgctgtagcaaccggaggccagactcgtggccctgacagcgtcgttagtgtcagcagagactggaaataaaggaaactcgtgtatgatacgcctggcgtcctcaaagcaaacagcaggcggtgcccagcccaacacaggcacgggcacaagatctgcagatgaggcatggaggggaagcgggcggtgcccagcccaacacaggcacgggcacaagatctgcagacgaggtgtgcagaggggaagcaggtgcacagaaaaggtgcgcggagattttttttttttaagacagggtcttgctctgtcgcccaggctggagtgcagtgttgcggtcatggcccaggctcactgcagcctccatttcctgggctcagaggatcctttttcctcagcctcccaaatagctgggactccaggcatgcaccgacactcccagctaatttgcaacccctcactctcatgtagcaattaaaagtaagcctttatttctcagtagaaaatattcattccagttgacataaaaataaattcgtttaaaacttggacggcaggtattagggcgtgcacttcccgctactctgcctttttttttcccccccgagacagagtctcgctctgtcacccaggctggagtgcagtggcgtgatctcagctcactgcaacttccgcctcccgggttcaaacaattctcgtgccccggcttcccgagtagctgggactacaggtgcccaccaccacacctggctaattttttgctttttttttttttttttttttttaatgtggagatggggtttcaccatgttggtcaggctggtcttgaactcctgacctcaggtgatccgcctgacttggcctcccaaagtgctggtattacaggtgtgagccgccacgccctgcctactccgcttttaaatgatgggatgcattgctttttaagaaaggatctcatggatccaggggtcccagtatgtgatgaaagatggcagttcccatcttacagagcgggctggactcagaggcaggccggggagggaggggctgggtacagagggcaggcttgggagggaggggctgggcacagaggacaggctggggaaggaggcactgggcgccgagggcaggtcagggagggagggaggctgggcacacagagggcaggtcagggagggagggaggctgggcacacagagggcaggccagggagggaggggctggactcagaggcaggccggggagggaggggctgggtacagagggcaggcttgggagggaggggctgggcacagaagacaggctagggagggaggggctgggcgcagaggacaggccggggagggagggaggctgggcacacagggcaggccagggaaggaggggctgggcacacagagggcaggccagggagggaggggctgggcacagaggcaggtccaggagggaaggagggagcgggggaggggctgtcatcctacggcccagtgcctgccacctggacaggacttggagttctggggcccttgtgtttctctcatgcggtatttcctggaccacgaacagttgggttctctgaacgagcttgtcgtgactgatcggctgtgtgtgccagcccacggggttctcttgtcttctgttggttccatctgatcagctgattttattccttttgtctcttataaatgaactgtgattcttctaataccagcaagaatggtttcaagttatttctgcgctatagtttgtgtatattagcctcgagtgcatgtgtgttacatgcgtgctgtgtgtgcgtgcaggtgtatcacattaccgtgctatagtttgtgtgtgagcctcgagtgcatgtgtgttatatgcctgctgtgtgtgtgtgtggctgtatcacacataatgtgtcacataggtgtgtatgttagctacattgtatctacgttagctaagaaaatattcttagggtactcacatatggtgactgtccctagtttctctcagtgacttttcgggattgtaactgaaggctagtatggctcagttgcccctaatcagggtaaaatcaaaacaggctgtgcacatttaaccaggcttccacctctaaggttgtagctgaggttccttggcgcagtgggacgtcccagcacggcaccaggagggagggtgtctggcaggacatcaggtggttggaatttcagggctctggggatctcctgggtgtgccccgatcaagtcggctcacgtcacagaaaccaggtgcacctgcagcggctcctaaggaaaacctagtggcactggctggttatgcagaggctcgtaaggaaagcctagtggcaccggctggttatgcagaggctcctaaggaaagcctagtggcaccggctggttatgcagaggctcctaaggaaagcctagtggcaccggctggttatgcagaggctcctaaggaaagcctagtggcacccgctggttatgcagaggctcgtaaggaaagcctagtggcaccggctggttatgcagaggctcgtaaggaaagcctagtggcacccgctggttatgcagaggctcctaaggaaagcctagtggcaccggctggttatgcagaggctcgtaaggaaagcctagtggcaccggctggttatgcagaggctcctaaggaaagcctagtggcaccggctggttatgcagaggctcgtaaggaaagcctagtggcaccggctggttatgcagaggctcgtaaggaaagcctagtggcaccggctggttatgcagaggctcgtaaggaaagcctagtggcaccggctggttatgcagaggctcctaaggaaagcctagtggcacccgctggttatgcagaggctcctaaggaaagcctagtggcaccggctggttatgcagaggctcgtaaggaaagcctagtggcaccggctggttatgcagaggctcctaaggaaagcctagtggcaccggctggttatgcagaggctcgtaaggaaagcctagtggcaccggctggttatgcagaggctcgtaaggaaagcctagtggcaccggctggttatgcagaggctcctaaggaaagcctagtggcaccggctggttatgcagaggctcctaaggaaagcctagtggcaccggctggttatgcagaggctcctaaggaaagcctagtggcaccggctggttatgcagaggctcgtaaggaaagcctagtggtactggctggttatgcagaggctcgtaaggaaagcctagtggcaccggctggttatgcagagggctggtgttctctttgtttattaagagtcattttagcagtggcctgaggaaatgagaatttccagaccgtggcccacttgatgagctgggaggtgcttgttcacataacactaatagttactctgacagatgatcttaacttccctgtcctgttttcctgttctgatgtcttctggcatcacaggtgttcatgagcggccggaacgtgcatttgcagcaggtgaacacctgctttgtcagtggtgtcctggtgtgtaacagggctggggcctcttctcctgcgctggggctctgctgtccacacgtgtgtgacgtggccctgggtcggtggcctgtgtgtgtccttgaccagagaattgtgccgtcttgtgttaaaaccacggaagccacttcccaaatgcagaccaggcggtgacccggcgttgtgcgtttgccacaagcatctcacaccatgtttgcttctctgcagaggccacaagaggaagctgaatgaagaggacgccgccagcgagtccagcagggagtccagcaacgaggatgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttctcttctcgtgggtgtgtggcagcggtgagcacccgcctcctccctcgctgggatccagctccttagctgtgaaacagaaacgaaaaaattcccacggacaggaccgtgtggaacggcagaaatggaaaccgcagaactgcgagcgtgatgatctcagggtttcgcctctgagcataagaaccaggcttgtagctggtattttaaaacggttaagtgtgaagaattactctcttgcattattttcatccttcccttttgtttgtttgggatgcgggggcccgagagctacaggtaggtgctgggctatggccgccgccaggacccctcccggccagcagcctcggctcacgtcccctcctcctcccagcatcagtcccgcagcgtggcggtgggaggctgcacctcgaggccacggcccttctccaaaagcacacactcctgctttccgacggcaccctcccctgaccacagctcgggaggtggcacgtgtgagaactctccatccacaggatgtggctctcgcgggacctccaggctcaggctgtctccgctgggtgtgggacctttcctgtggggttttcgatggaggttggctggggagggaggcatcctcagtgggtagaggaccccagggtcctggtgctgctgtcgtcaagatgcggcgacatggtggcagaggaaaggcaccgttacccagcagcacgccagccccgggtgactgtttcctgtactaactaggttatttgcagcgccgagtgaagaggcagcttcaccacccaacccacctgtgggttctccggggtctgcagtctgaggaggctgcaggatgaccagacgccggtcagggagttcctcctgtccagagaagcaggaggtgaactgggcccacctcaggtccgatttcgccacgagcaagaatgtaagatgaattggacagaaaacaaaaatagatgtacaagttgatacccaaagaaagcagaagattctacagtttatagggaggggcacaaaacgtgcagggagtaatgtgccggggggtgggggcaggggccgatgaacgaggccttgatgctgtgtggagacctctgggaaaggctgggagaccttccctccttccacagtggtttctccctgaaggcgattctgcgtgtggttggtcctgctgggaccaaggtggccccttgttctgctcttggccgagtcccctctggcttcatgggggtgttaatgaggctctgcaaggcctccttaaacacagtgtggaaatacaggtggtgctgcaggggcagcgagaacggggacctctgctgctgggtctggcctaggggtgaagaggacgggaggagggtggcgtggtagctggctgcgcggggcctggtgacgggaggggccggaccgcatgcagcattcaggaccagcgtggccctgggtgttcgcctgttctgaccgtgtggtcgagtgaacagagcatgcaggggagatgcagcaggttctccccgacgcggaagagcaaggggtccccggttcctggaggagcagcgggattgccccaggctctgggatcgcccacgggggcagcgggccagcacccccagccgcatctctgcacagccgtgctgcacaccttctccgtcacgtgttggaggtgggtctcagcaccagcacatccacattgatagcttaaaatgggacttttctcccgcctgtctcactgttggcccgcccccatgcagcggtggggaccccactgcagggactccaagagccccatcctgtcctcggctccagcctccatcagcaccagccgtgtccttgcagccctgactggagcaactcccaaactctgctgcccggcaggtcttctgaccctgcccgcggtgatggcaccctctggaaggctggcccaggacggcacctccatgctggcagcccctgagtgtagtgtgtgttctacacaaaagagccaggaagtcatctgtgatcattgtttaagggactgtgattaacgtttatgaaatgttctgtgctatgcgaagaaaccactgaatgttagggaaaatattaaatactgaataattatacaactgttccaaataaagtcttaagaagaaacttgaacttgcttcccttagtataaatttcatgtcaggttttaagcttaaactggctgtaaggaaatttgtgatttaaaatttgaagaggtgactccttaaatttcgagatagtcgttgcataaatagatgataaattttagaccattcaaaaatctgtaacagttaaatttaatgaaatttccttccttttctcttttgagaaatggaaagttgaaattttgtataacagcatgcacagatttcatatctgatcagtttttcatattaagttttcaaaacaaccatgaagctctaatctgcacgtgcgcttgctgtgagacggtgcctggcagacgtggagatcgggaggtagtggttctccacctggtgcccacccagtgatcacttttagcgccagacatgccataggttttgacaaatgtctgatggtgtatccaccactgtggtgtcgcacagaatcgtgtccccgtgtatccaccaccgtggtgtggcacataatcgtgttatatgactggaattagtatgtagccttttcagattggcatcttccacccagtaatatgcatttaagtttcctccatgtcttttcatgacttgagagctcatttctttttaccacggaatcacacaattcatttatccattcacctactggaagataatcttggttgtctccaagtttgggcagtgatgaacaaagctgctctaaatatccatatacatgtttttgccaggacataacttcttaatcccttagggtaatgccaaggcatgtgactgccggatcctacggtcacagtgcatttagaaactcagattgtctcccaaagcagctgtgccattttgcattcccacccacagtgaatgagagttcctgttgctctatgtcctcactggcgttcgacgcaacgcagagcatcttttcatgtgattatttgccatctctgtattcatatcttctttgacgaggttttaaaatctttagcccattttgaaatcagttcgtttctaattgttgactttctctgttgtttttttttgtttgtttgttttttgagaggctgagtttcaccatattgcccaggctggtctcaaactcctgagctcaaacaatctgctcgcctcagcctcccaaggtgctgagattgcaggcatgagccaccacgcccggcgagttttgatttctgttaggaaagagttttgtatgcattctggagaacaatcctttctcacacatgtctcttgcaagtcctgtctcctagtctgccttgtcttctaattctcttgacagtgtctttgagagggcagaattttttcattttcatgaagttcagctcatcagttacttctgtcatagactgtgcctttgctgttgtgtgaaaaggttcaccatcatacctagatcatgtaggtattccctaggggtttcatagttttgcattttatagttaggtctctgatctattttcagccaatttttgtgaaaggtgtaatgtgtgtgtcaacattcatttctttgcttatggacatccagttgttccagaaccatttgttaaaaagactcttttctccactgtattccctttgctcacttgtgaaagatcagccgactgtatctttgtgggtctgtttcatcaatccatttgtctttctttcaccagtacctcagtgtcttaattactgtcgctttagttaagtcttgaggtcgggtactgtccatcctccagcttctttcttctccttcagtattttgttgggtattcggggtcattgcctctccatataaactttaaagtcagtttgtcagtatccacaagataacttgctaggattttgattaggattgcattgaatgtgtagatcaaattgggaagaactgacaccttgaaagacttgattcttcctatccatgtacatagaatatctctctgtttcattcttccttgactttgttgatcagaattttgtagttttcctgatagagatcttatctatatatagttagatttatacaaaagtattttatttggcacaggtaatgtaagtgatactatgtttttaattccaaattccacttgttcattgctggtatataggaaagcagttgactttgtgtattaaccttgcatgctgaaaacttgctgtagttccaggaggcacttggtcggggcagtccaattcttttggattttctacacagacaattatgtcatctgcaaagagttttatttcttcgctcccaatcagtatactttttatttccttttcttactgcattagttgagacttccagtatgatgttgaaaaggagtggtgagaggatgtccttgccttgttcctgatcttaatgggaaagctttgcatttctcaccattattatagattttctgtgtcaagttgaagttcccctttattcctagtttgctgagttttatcatgaataagtattgaatttttgtcagatgctttttctgcatctgttgatacgctcacgtaatttttttgttgttgctgtgatgggttacattgattttcaaatcccagtagtctggggtaaatcccaatagtcttgctgtagaattctttttatgcattgtagctttcagttggataagatttggttgacgattttgcatctgtgttcatgagagatattggtctatagttttcttattttcatctggtttgtgtaatagagtgatgctggtctcatagaatgagcttggaagtattccctctgcttctgtcttctgaaggagatgatagaaatttcatataatttcttccttaaatatttggcaaaattcaccagtaaactcatctgggcttgatgctttctgctttggaaagttgtttattattgattcaatttcttcaatagatattggcctatttagacaaactggttcttatatgagtttcagcagattgtgtctttgaaggaattggtccatttcatctgggttatcacatttgtgggcatagagttgttcatagtattcccttattatccttttaatgtctatgggatctgtagtgatgtcccctctcattttttgatattagcagtttgtgtcctttttttttttttcttaccctggctaaagagatatcaattttctttcttttcaaagaactagcttctggcttccttacttttctgtattgatttcctattttcaatttcattgttttcatctctaattttttttatcacttctacttagtgattgttgttttttgagatggaatctcactctgtcacccaggctagagtgcagtggtgcaatcttggctcactgcaccctccaccttctgggttcaagtgattctcctgcctcagcctcctgagtagctgggactacaggcatgcaccaccacgcccagctaatttttgtatttttagtagagacggggtttcaccacattggccagtctggtctcaaactcctgacttcaggtgatctgcctgccttggcctcctaaagtgctggggattacaggcgtgagccaccgcacccagcctattacttctactttgaatttaatttgttattcttgtcttattcaggtggaagcttcagttattgattttagatcttttctaatatatgcattcagtactctgaatttctctgcagtactgcttttgctgcatcccacaaattttggtaacttgtgttttcattttcatttacttcaaaatatttttaaatttctcttggtattacttctttgtcctgtatgttatttagaaatgtgttgtttaattgctgcatgtttttgtgatttttcagttatctttctattactgatttttgctgtaatttcactgtgatctgagagcagacactgcatgatttctcctcttttaagtttgctgaggtgtgattgatggcctgtctgcatgaatgttcctgtgagcctgagaagaacgttactgtgctgctggtggataacattgtctgtagatgttaatgatatccagttgattgatggtagtgttgagtttgaccatatgcttactgattttatacctactgaccaccctgtctcctcccctccttatagcccttgctgaatttggggttgttttgatttttgcctttttgttttgtttttttggctgactgcaccatgacagcaggaatgcagtctggttggttgatgtagcttctactctcaacacagaactggctcataatatctgttcaacaaaagtttgttgaatgaataaatgcaggttctcaattcccagtatcttgcaggcatccacctaatgtggctcagtctccaggactttgtattttcctttgatctacttcccattccacgctgcccactgagtttgttttttctctgcctccaataacattttacttgctaagatcacacttgcccagttctgattgcctgtgccagttaggaaggcagtggtgaggaagagtgcacaggtgcctgcctgtggtttgtgaaaatcccttttagatcctggcagtgggttgtgggctttggtcttggtgttactcttttttcctttgcctgtgtctttgtaactactttagaggggagattgtggaggctgtatcaggaactgttagccagaagtcttttaaaaaatacttaccatttttactttttaatggaaaatggaggctggatatcccaagaatcagaggttatataaaatatatgaaacgtgatttttaaagaatgaaaatgaataaaataggacagttaggcaagaaaaagaaataaaaggcattcatattggaaaggaagaagtaaaacaatcttcacaggtggcattgtcttgtatatttaaaaagcctaaagaacctactaaaaaacaattagatacagtaagttcagcaagggtacaggatacaagatcagtatacaaaaatcaattgtatttctatacactagcagtgaacaacccagaaaagaaaggaaacaattccatctgcatgcaaaagaatgaaattagaccgttacctcacaccatatacaaaaactaattcaaaatgaatcaaagacctaaatgtaacagctaaaaactcctagagaaaaacagacataactctgtctcttgggtcagtcaaggatttctcaggtttaacaactaaagcacaggaactaaagaaaaaatagataacttggactttatgaaaattaccagctgttatgctacaaagaaaactgtcgagaaaatgaaaatacaagaattggaaaaaatatttgcaaattatctatctgataagggtctagtgtctgcagtatataaaaactcttacaactcaacaataaaaagacaatcagatgtaaaaatgggcaagagatcgagacattcccagagaagatgcccagacgtcctgcaggtgcatgaaaagcttcccatttcattcccacttctttgggcaggaggatgtgcagtgaggagtcaaagcagatgagtgtggggtttccttcaggggtggtgcaggtgttgtggaattaggctgtggtaatgtttacacaactgagaatatactgaaattccactgaattgtacacattaaaggggtgaactcatggtatgtgaattaaaatagtttttaagagtaagtaaaacccagccaggcgctgtggctcacacctgtaatcccagcactttgggaggccgaggcgggcggatcacgaggtcaggagatcgagaccatcctggctaacacggtgaaaccccgtctctactaaaaatacaaaaaattagccaggtgcggtggtgggcacctgtagtcccagctactcgggaggctgaggcaggagaatggcatgaacccgggaggcggagcttgcagtgagccgagatagcgccactgcagtctggcctggacaaaagagcaagactccgtctcaaaaaaaaaaaaaaaaaaaaaagtaaaacaaccacctgttaacccagcaccctgtgtaagaaacaggattctcggagcccttcctgtctgggtactctcctcccccgccatacccttagacaaatcctgaatttcatattaatcgctgattttttttctgcgtaattttaccacatgtatatttatgcttaagactgtatgtttggttttgcccatttttgtactcaatacggtcttcagcttaccatggtttgacaacagttttttgactttagactggttccaaagggatacacattcactagaatctgtgctccaagtatgcacacagccattctgcttaccagtttcagttcagtagtcagtacatcacgagatattcagcacttcattataacataggctttgtgtcagacaagtttgcccaactgtcggctaacatagggttctgacacgtttaatctgggctgggctaagccatgatgtttggagagttagttaagtgttcaaatgcatttccaacttgggacacttgggtttatcaggacaggaccccatggtaagtagggagggaacctgttctttctgacttctcgtgtgcttcagggttttgtccgtgcacacagccgtggtccatcactgccctccgtgctcagcgatgtttctgttccacagcttgtcctccttttgccggacgtttgtgttgcttatggctctttttatgcaaatgcagctgcctgagcattctttacctatgtcctgatccattcgtgaatgagcctctggggttaaatacccacaagtagagttactgggactggggggcaccccagtgcagttttcctggatagtgtggaattagtttctcagtcattgatgctggtttgcactccctcccagtcagtgatgctgcttcacactcccagtcagtgatgctggttcacactccctgccagagatgctggttcacactcccagtcagtgatgctggttcacactcactcccagtcattgatgctggttcacactctctcctagtcagtgatgctgcttcacactccctcccagtcagtgatactggttcacactcactcccagtcattgatgctggttcacactctctcccagtcagtgatgctacttcacactccctcccagtcagtgatgctggttcacactcccagtcagtgatgctggttcacactcccagtcagagatgctggttcacactcactcccagtcattgatgctggttcacactccctcccagtcagtgatgctgcttcacactcctgcccagtcagtgatgctggttgacactccctcccagtcagtgatgctggttcacactccccacacctggtcagccaaaaacggcttttccaacaacagaaggacctgaagggaaacctcacagcaagcccctcccaggtgggcaaagttatgtcttcagagagaatattctaaaccctcggagctgcagagccagaaagctggggcccaggcagtgtcgtcagccttcccaaagtgtctgcacgagctcattcccacagttgatggaatgacatttaactgtcacctttctctagaagtgactgcaaagcacagagattggtcttcaggctcctggacagttccctgcagggcctggtgggtggtgaccgtgtggctggcagctcgcagttgatggagactgtgtagccatcagatatgatgtcaacacaagacaccagtttttaggaaacagcctccaaggtactgcttgatgcattcaccatgggtcgtgtgcctggccagcctctacctgcctgggaagctccttcacctggggatgcctctgctggttttcctgagacacagcccttgggggcactgatggtccccgggtgaccagggtcaccagcagcgtagtcccaaccccatgtgtgagtgaccagggtcaccagcagcgtagccccaaccccatgtgtgagtgaccagggtcaccag

SEQ ID NO: 337 - DNA, 90914 bp, Homo sapiens
acctcaagtgatccacccgcctctgcctcccaaagtgctgggattacaggcctgagccaccgtgcctggctgcgtttttcatctttaaacatcataaaaacgcctcaaaactagtttctctgaaatttcacacccatcagccttattcccttatcttctcggaggaagacttccctccacttctttccaggctaggaaaggaatatcctccatattgccacaggacctaggcctattagtactctttcttggacatctgcaacctccaaccttcctgcctccactgattcaaactcttcgcagttcttaaatgtgctaaagatccctccacaccaaaggtcaatcgtggattctctcttaatttcctgataactgcttcattttcttcccttgctccttcgactatccacctcttggctagacatcacatgcatgattacatataccaggtagatcaccaatacgctgattaggcctaaatgcctagccctgactgaattagcccaaacttaccactaaacccacattttcaacctcctgatagaatcacaagcatgtctcacatgcacatcaaatgcgacctggaaagcaaagaacttgctattcttcccccaaatgacagttcccactatttggggacagaccatttctactctatgtccccaagctgaaaaactgtctttgctgcctttttgcttactcttcatacggatctattcattgattagttccgtggctgtcaatatacagttgaattctttacgatccggtttgtggcctacatccaacaccgactgagcacttgctaagtactgggatctgaagattactcagccactgtctccacggagatcatcgttaacgggagagaaagccacgtaaaacaccacgttagatggagaagcacagaggacaccacctccacgaaaaagtctcacacgcgagaaaggacccgcaccacagcacccgagcctctattaaccgccgccttccatcgtgaattaatactctcgctttcagcgttattatcaaccccctgcaagcaatcaagaggctgggttaagtccggctggaggggcagcaggcatccctgggctgtcgcgcctcccagcgcccccgatggagcaggtggcaaggctgcaaaaagaatttaaggctctaggaaagaggtggtgcagcccgcactccagtccccggcccgcagcaggcagaggaggctccgggtctccttcacccggacaccgccggcggagaggtccactcccgtgcccctaccctggatggatcgcttacctgaggacccccaaacagaggtgcgtccggcctcgcctccccagccacgcgcagccggctacccagagtcagctcccacagtccgcacccagagtcggctccgaattgcgcacgcgtctctgtccgcggctcccgctctctctccgacggcactaggcctccaaggatggaggcgccctccaggggaaaacgctgaagcgctgcaaagaagccagcgactcaatgggtgcgtcaactaggcagccgcagcactgggagtgcggcgcgggagtgacgtcaccaggcggagggggcgaggccgggcccgcttctggtcacttacggcggccggccttctttgtaggcctggcaccgtagaggtagaggagctacattggccgcgtcccctgtccctctgccctcttgcccatctgcccaaacttttgtatttgatctctgttttgatgtcgaaccccaaagcactgtaattggggggggcgggggggggggtggaacctgcggacctgagagcagcgcgcgtgcgcacgacacgcgctgtgcgccggaagagcacgcccagtccgggctgcgcggaggaagcgctggggtcccggagggcgggggtggcggcgccggaggtcgccatggctaccgagcccgaagccgcggagccggtggtgccttcgctcgtggatcgatacttcactcgctggtacaaaccgggtaagtgcggagtgatgttgatccctccttggccgcactggcctaatgctgtgtagactatgttgacagatcataagccacgcgcgctctccctggctctccgtccccacgtcagaaggcactggacttctgtgttccgtctagccccagggaatggcatttgcaaagacctggtggcctgaaatacttcagggcgcattctggggccggcgattgcagtgcgagctctagggtgttgctcgcagtaagatgagtactctaaacggaggccccaaaggtaggcggagggctaggttgcaacagtccttaagtgcctggagggattgaggggctcactctcacagggagtagcgatacataaaattatttaaatgatcagatcgaaactaaggtagaggcagtagggatggcgagaagagggtgggttagattagagacatttagaaagaagaagaatctatacatttaccttaagagacgccatctgccacttagaagtaggtattctttttgtactgttttgtgtaagcagaaccagtggtgggagcatcgttggggactctcctttcttcctttcattcagtgataatggttatactcagtttaaaaaatatatattgtagcatattttctgttggccaaacatagggtgaccaacctgtcctagttcacccatgactgaggggtttcccagaatgtcggacttgcaccaacatcaggacagtcctggaaaccaccaacaaaaaatatatatcataaagaacgggatgctaattgcattttcctagcaaaaatactacgtgtactcattttgaagtgagtgtaaagtaagatggagcaaggagttaattaccttaatgttgaataaattattctatctgggccagatctctttaaatactttctaggaaacctttaggtatgtctttttgagtaatgaagggatacccgtgatcagcatgcagcatgtatgtgtccagtcttcattatcaactatatgacccaaagaaagtaccacatagtggtagtaaatattgatttcagccaccaacagactcatgtattcttctagatgtcaaaggaaaattttgtgaggaccactgtatactacagcactctaaccggtaagcaaattgggaattttaaattatcaaaaatttttttttcctggtattgtagcctggtatggtcttgtggtcttggattgaacaaatgttcactaaacaaacatgcattaattatcttctactgtgttgaaatggtattattataggagtttgtttggcaagaatgagtattccagtgcctggccactctgaacatataaatttgattactcaaacatccaaatggaggaccacatcatcagctgctacttgaagtggccagtctgtgcccaactactgaactgttcagagcccacagaaagggctacggtagagacatgtatggtatctcgtatacacaggcatgccttatttctttgtcttctaccccagtgctacctacctaaagacctctggtactcttccctttcctgggaaagaaattcaatcttgttttctcttttattattgtattctctattctacagttatgccccaatagtagccaaaggaaaaagggggaagatgatagtttgactaaacaaataccagttcatacattcttgttccaataggagttatgggaggaaaaattattccaagcaatcacacaggatcaactttttctccttgtagaatatgtgtcatcacattggcagaatctcatccagttcttcaaagtggaaaaacaattaaaagcatttcctatcagatcagtaccaactgtagcagacttcagaacaaggtctctgggaaatttaagcgggtatgttcctgtaattctgtgattatctacttacatcctctatattcatggtaatgacagatccaatgaaccttagaatccagtagcatatgcttagcatacttctctagcagtttgaggtgctaattttaggtatactttcacctaaagaaattctcagctcccccaaattaggtatctcaggaggtgtagtatctgttatattaggttctgtgctactatccctataatgcccaggatggaggagggggaaggcaggcctttgaaaggagaactctaatagcaatataacaagatattttgtcccttctagttgtattaaactagtatgtcgagttctgtaaaatttaggtgactaactcttctttaccatatatttccacatgtaaattaaacagaaaaaaaattcccaagggagttagaaaaaaaaaaagaaaaacatgggccggtcacaatggctcacgcctataatctcagcattttgggagaccaaggtgggtggatcatgaggtcaggagtttgagactagcctggccaacggggtgaaaacccatctctataaaaatacaaaaattagccaggcacagtagtgggcacctgtaatcccagccactcgggaggctgaggcaggagaatggcttgaacctgggaggcggaggttgcagtgagctgagatcgcaccactgcactccagcctgagcggcagagcaagaccaagactccgtctcaaaaaaacaaaaacaaaaacatgaatacgagaaaatatatttgctccttactgtttttccattcctaaagcattgtcaatgtaatactcatgtacccaccccctgtacctgcacacaacactcggttatatagaatgctatctctaccctctgtaactctaggcaaaatggacagattattaaaagagtatcatgccaaggagaatttagtgacatgttaaaatgtcttaacaaacccactggttgggaaagtttctgtggatgatttaagtcgttcatttactgagttcatactaagagtttctgctaattgctctcactattctaggagacccttattcaaacccccctttgtaggcctgaagtcccctaataattactgatttattgtgctttacaattactgatttttcctcactcaagaaactagtggacttagaaaagcatgcacctctcttaaacgatagtctacaagttacaataacacttaagacttctgaagtttcaatgataaatctctgtccaaaatagtaacacttaaggcaggtacagttgctcatgcctgtaatcccagcactttgggaagccgaggcgggaagatcacttgaggccaggaatttgtgacaaacctaggcaacataacaagacctcatttctaccaaaaaaaaaaaatttttttttaattagctgggcatggtggcatgtgcctatagtcccagttacccaggaggctgaggtaagaggattgcttgagcacaggagtcaaggctgcagtgagccatgatggcagcactgcactccagcctggatgacagaacaagaccctgtctcaaaaaaaaaaaaaaaaaaaagtaacactcctgttacaagtgaagaacagagagggacctgcatattgaacccactacagtaagttttcactggatctcagaactgccaatcattctcccaaaggaggtgacaaaaaggcatcaaaacatttctgctgttttggcacagacctagctcttttgtgtctgctcttttaacacaagccttccccttccttccaaaagcagaaagtcacaatgactctagtattttaaaatgaagaacccacgtgcggaggagtgaagccaatatagtaatatctgaatgccatctaaaaatgttttgagtggtaaataaaggggtcataaagaatagcatcttaacctgaaatgcctatgtccactacaggaaaaattcatgggagaaaagagggcaacacatgaaacatgcctgcactggctctcatgagcctccctgtagatacttgtgagagcctccccaggtatatccatctagtggagtacatgaaacaataaccatgccatgacattcaaatacatacacatcaaaatgtagtattgactcatgggtcaattatttttattttgctgcttaaaacttttgttttccacattttcctcaaagtgcatgtttttgtttttgtttttcttaactagaaaaaatatcccttactaacacactggggaattacaaaggggggggggggaaagaacaatatcccttcttcaaaaagtcttagtgattgaccctggtaaataagttcctttatctattaagttctaatattaaaatgaggtagaaatcttaatgaaactaactttatacaatattgctgtcatactgtgtcatgttgaattttatattgtttcttgttgatggattttcccacacttttgaaatctttatacctggttatatgtagctttttcatttacagttgataaaatatattatcagtctgtaaattcccatttatcatgtgtcttagcttttttccctagacctaggatggcacctggcacacagtaggtacttatattcatataggttctgaaattaatgaatggtttttatatactgaagtaactgatttaaaacaccagttccaggaatacatcctgttatacacctaagggctacttctcaaaggaaagtggaaatgtccatcaactgattacttcttccgtctcattacacagggggcacagtttctaacagagcttgcacctctctgtaagatttactgctcagatggtgaagaatatactgtgtctaggtgagtaactttttagccaccatttaggagaccaaagggaggtaattttttttcttagaaacaattttttttaactaagtaaacatgctgaaatcttaaatttttttaatagttgtgttagaggacgtttgatggaagtgaatgaaaacatcctccataagccatctattcttcaagaaaaggtaaaagagagagaaaaaatatgatctcatccacataccttttattggtttttttttcatcgtttgacagtactaaatgttctttcctttccagccatctactgaaggctacattgcagttgtgttacccaaatttgaagaaagtaaaagcataacagaagggttactgacacaaaaacaatatgaagaagtcatggtgaaacgcattaatgccacaacagctacgtcatgaggattgacatggaacaaaaagcaaagtgggattcttgttacctggcctaaaccatcagggtactaaaggagaagaaccagtatatgtaaagcatacctaacagccagccatatgcaggggaggcctagtgcttcacttagttttccctctctgtcttcataatgagccttggttcccatttgtctacagcctgccagatctggcctgcccatgtactcacactgttctcttgcatctctctaacaactggcatgcaaggcatgtttttctgattaaaaacaaacaaagctctttgaagaagatttagaaaatacagaagagttttaagtagccaagtaaaaataatttacccatcatcccataatccagaagtaaatacatttgacccttgagcaacataggtttgaactgcaagggtccacttatgcatggactattttcaactataaacgagtcaaaaatatatcattaaccaaacacgaaacccacttatagagcaggttcatatactcaggttccaaagggccaactgcaggacttgagttctcacgtatggatttgggtatatgtggaagttcctggaaccaatcccctatgtaaaccaagggataactactacattttaacctacttctgtttgaacatatggtatggttattgcttttgcctcgttttcctaacagtttgaagtttaaaaaaacctaacccacctttcttacccagtcttctataatgtgcctaccaaaaagcctagtcctagcccatctgcctcaactcctctcccttttaggttgtagggaagaggccggagtgtagagtatattatatcttctgtcccccttatgccaacaagatggccttcccctctgaaacaaagtaaaactgcaacactgtgacttcttaaatgagggatatgtgaaaaggctatgaaaaatacaaaggctttcctaggaaatgtgttataatgcagcgggaagctaattcttgaaatatgcacattatagttactcagtctcacatactctagttactggcaaagaagttactgagaatatgtcattcaaaggcataggggcctttgaatggaacaaatgctttcacatcatttaaagtaaaaaaaaacctccaacaactgtgaatttatagtttaagagtgatttacactgaatttcaaataaaaggactataaaacgtgttatttttctgtaagggctataacatacatgtcaatatcactgtttttaaataaaatatacttttatacagaagaaatcattcgatgtattaattccattggttatctatcctcttatgctgttgaagtcataagttaccccttcccaacccccacttgctctttctttcactagagaacagtattttttcaggtatgcaaaaatattatctaatgaaagtacaagtgggggttggaatttttaagttttaattatttacaaaataatacttacttattttgtaaataaaacaacattttggttcataggaaaaacttgtaatctgagtgccagcatgactatccccctaaatataccccccagacatgatacatgtagtaagtggataaacacctccacgatggtgctattagctgaaaatataaacaaaccagcagatcctcactttaagtagcacaatgactcttgaaggcgtcataaaactatgacagtaaacgtagtaaaagaattgtgtataacattttacatgtaacattacctcacatcattctcccattatttctattgtaatttaaaagagtactttggtttcagagaataaaaatcatgcttaatgattttgactgtttaaggaaagattttaaaaaggttattaacagagctgagtgcatcacattttctcccgaaggactacagtgaaaattttcctcaataaaatattgactagctgtggtcaattggcattactgtggttcttccggatcttttgtgaatactgattgtggtggctgacccagataaagatcatcagataagcttatattatctactgccatttgataactgacataccctgttagatttcaaaatgaatgtcaaagcattaagatacaaatactacgactgaagtctaacacaaagttggccatactatattataaggagaaaacctataaaccagatccttcaatcatgaccccacccacaaaaacaagaaaagctttaaactcctaaattaaaaagactaaagaaagatgttttttgttttgttttatagtgaacatttcaaatgtgtgatattcagaatttaaatagattcttggcttccttattctgtctttgtcttccattccatcaatcaatactgagaaagttcaaaatatcttttaagtctataagataggcttagaatcccagctaatattcagggcagactggccagctatgctagaactagaaccaaaaacccatctcatactctccaggagttgttccaggattctgtggagttccattaccttacttttgggagtaggtgagggacatacacagcacagcagacccacccttgctgtacaaaatgcttattagggaacaaacttgctgctggcatggacaatctgggacagggtcatcaaggggatttttgtcacacttggtaaacagagggattgaagagtccacaggtttaaggaaaaccctgcattcacccagactactgtatgtttgctgctgacattagtgatctagatgataaagaaaacagttaaggtaaaatatgccaaagctaagcacatattcaaaatagcttcttgtggattaaattgtccttgagacagttgggatatttggtttgacttttaaagaacattagtgcaatgttctattttaaaaatcacactacaattagaatctagcaattaccaagacatttattagttgtcaaaaagctttacaatcagtttcatgatcagaaaatagagcaaaatttcaatattgttttctttataaaattgatgaatttctgaaaagataaaggatcatttgatttttaaaaatgtcagcttcatcacatgatgttccagagatctgaccccaaaagcttctcaagttttactatccatagtgtccttatttgtaactgagacccatccgttattttccatctgaagctggaaagagttaagacaattagtatctggtttcactctgaaaaaaaaattacaaaattaagtagtaactattttcttttaaaccattttttaaagtatgagtctaaaatagaaaaactacctcaccttcttcagcagtttataacaaagtgaaagaagttggactaagagagccatcatggatcttgtcttcgtaatacacttgtcaacctacaatgacaaaaagcatgcaaatgatattctaaaagtagtacttaaaagaccttaccatttatttagttttaacatgataaaatttctccatatggaaatctaagggatcttgaaagagatatggatttaggcacatgagctgactcaaagccccaggacacaggtgcaggggtagctgcctagatttcatgtctatctcatggaaccccagcagaaagagtgggtggaaaattaatcattctactgcaggctgtttaggggcttctcaaaacactccaaatagtggaattaaatcccatcctttgcaattccttgcactctattttgtgggcacaaacccatattctctcagacaaattatgggagaccagactcggaggcacctgtgtcctagttgcagaggtaatgacttcagaattgaagggcagctgttcagtgctatggaattaatgatgtccaaaaaactactttatttggtgaatctgctactctctggggtcagttatgagagtagataataaatgattcttgtagacaaggcatgaaaaaaggaaataaattgcccttctgtgggtactaacagtttatttgaagaaaaaggggctttaaccagataaagatagatgtgtgaaagtttttcatatgtctcttttacctttagaaatactttattctgcaaagaagtcttagttactgtctggagctggtggcatagaggaattagcttgtttatttccaggagaagcataagcttgtcatcgtctttcagctgaaatgtaatttaacaagttataacagcccgcaacaaaactccatctttaataccttaaacacatttatacattgatattatacccccaaagtaggttatacataataccaccaccagctccaggtaggtagacatgtgttacctgttttgaaaaagcttgaacactggaagtaagctttaaaccctctgcagcaaaaacctggtagaaagagaaaacaccactattttagactgatgtctatggatagttggtaagaaatatacttactaataatttttacgtagaattttaaaaataaagcctagatataaaaagtctgtcaggaactcctaaactttttccagtaccaggaatgcacaagggtttaactgttttcagaaggagtttccacagaccagatgcagaatccatccctggagaggcttctctacaccagacctccaattattctggagggtcacacagacctgtgatattcagccacacaaattatgtctagattacgcaagggacctagagctcatctcaaatatgctcaattataaaaggatgatgaattttcaagcatgaggtcaaaagggttaggaccttcccaattccatctaggcaagacaaaatttgtcacccatacatattccataaccagacatttgagagaaccaatccaggtggttggtttttgttgccactttttttcagattaattttcactattcaccatgtaccatgaattctataatttaatgagatgaacaggatgatggagaagtagagtgaaaaagaaggttgtacaggtaagacagaagtatttagcatattatgttaaaatggtttgcagactattttagagtgagatgccaggggagtaaagggaggaaggcttagttttaggtggcgtcagtaataatggagagaacagggaaaatctgagagtggtttgtgaatgaaaataataggtcttcataataaattaaagaatactaagaaggaggaggcaataattccagggttaatttttaccctctattcaaaaggcttaacaccttgctatcactggataaaatgatctcaaggtcaaatcgtactttgcaaccttccctttaaaagggaaaccagtaagctttacatctagactccaaccaaatgaaatgattcacttccccaagtgttccttatcacttcatgttaccactttctattctgcaaattttctctttccttctagcctgcaaaccccttggggacaaaatccatgtctgtctcatacagtatgatggttttaaaactacctgaaagctggtaactcccaggtctctctctccactcctgaactatcctgacatcagtcttgtacagtcatccctcagtatccatgggagattggttcccagacctccccaaggataccaaaatctgtagatgcttaagtcccttaaataaaacagtgtagtatttgcatataacctacacacatcatcccataaactttaaatcatctcatctctaaattataatatctaagttaatgtaaatgctaagtaaatcgcagttatactgtattgttttccctcccttggaactctaaccttttaaaatgtattttgtttttttttactgttgttatattttattggttttcttccttttttttttttttttgagacagggtctcactctgttgtccagagtgaagtgaagtggtgtgatcacagctcactacagccttgacctcccaggctcaagcgatcctcctgcctcagctgcctgagtagctaggattacaggtgtgtgccaccatgccccgctagttttttttttttttgttttgtttttttgtagagacaaggtctcactatgttgccccagctggtctcaaactcctggactcaagtgatcctcccagcttggtctcccaaagtgctagggttacaggagtgagccattgtgcccagactgtttttactgttttgaatattttcaatccatagttggttgaatctgcagatgcaaaacctgcagatagggagggccaagtgtatatcctatctgacctttgtacttaacatgtgcaaaacaaaatgctcgatttccaccctctaaatctagtgttctccctcagtgttccctgtctcagaaaatggcactaccactcactctgttggccaagccaaaaaccttacttaaaacataataggatcagctgggcatagtggctcaggcctgtaatcccagcactttgggaggctgaggcgggcgaatcacaaggtcaagagatcgagaccatcctggccaacatggtgaaaccctgtctctactaaaaatacaaaaattagctgggcgtggtagcgcacacctgtagtcccagctactcgggaggctgaggcagaagaatcacttgaacccgggaggcggaggctgtagtgagccgagatcgtgccactgcactccagcctgacaacagagcgagactaagtctcaaaaaaaaaaaaaaaaaagtccttcccatggcctacagagacatcatattttacccctttccttctggctcacttcactcccatcaataattgcctccttactcttctgatacacccagccctacccctgcacctcggggctttgcacttgttttggctatctaaaatcctctacccacatttatccatccaactctcacttcattactgtctctattcaaacactggctccttagagaggtcttttctgaccacccctctatcacctctgtattctagtcgtacgtgattttatctccaagtacttacatatgtgcactgaatgcttaaattcttattgtctatattctgccattagaacataagctctatgggggcaggagctttgctttgttcacttttctccacagagctctgttctcccagatctgacatatagcacaagttcaataaatatttgttgaatgaagtatgcaattttatgttcatcacagtttggagacaattcattgaacattgatttaatgactaagctcacataggaagaaggtaagtagtggatcttttgtagtaaaacacccctacagggcggtatgacagaatggacttgggccaaactgaaaaaaaaaataaattcagaatttcaactatcttaagggaaatagctcatttatagtctgctttacagaaaaatccagaagacacattttctataatacttctgattatgttgacaatcatcctcttaagctgaaatccctttcccacagaatgccaaataaaactatatgagtgataaagtgatagaaatttctttcttttttttttttttttgagatggagtcttgctctgtcacccagactggagtgcagtggcgtgatctcagctcactgcaagctccgcctcccgggttcacgccactctcctgcctcagcctcccaagtagctgggactacaggtgcccgccaccacacccagcgaattttgtgtatttttagtggagacagggttccaccgtgttagccaagatggtctcgatctcctgacctcgtgatccacccaccttggcctcccaaagtgctgggattacaggcgtgagccaccgcgcctggcctaaagtgatagaaatttcaaatctcagatgtacatgggaatgccaaaggagactatatgagtgataaagtgacagaaatttcaaatttacacacaagaatgctcttggttctagagaggcaaacaggctaacatggggatcagggaaaacataaaaggaattttgcaacccacttgccaatctaaagcctctaactagagggagtagaattacagatgggcctatgtggagtcctgttaagacacatggcacaagagtggatgttagcatatctgtctctcctttaatgccctaaatcatcatgaatactgaaggaaagaaggaaactaagatgtacttaataccctctaatagtcttaagcattttaacagatactctctcatgtgttatctcatttaatcaatatattttatccaattcaataatgaagaggccaaaaatctttctagaactctggatttgcatctgcttacaggatattttcacctacttaggtaaacctaaagcttattattgcatctattgactaccaacaaagcccattctactttatgctcataatatttaagtttctttccaatgaggtcaggatagttttgcaaaatgtcattgcaagccatctacctttctacttttctactgctctctgtaatacacaggtaggtacagatgtaagcatatacacatgatataataaatcatctggaaaacatttattacccacttttagcccgaaattaaagtactagcataaaacggaaacaaggcatacctctagttgatgaattaaatcctgggaagttttcagtggcccctctcctctaaaataaaattaattgttaagaaggtaacaaaaagttattacctgaaaattgactttataatattaaaattttagagcatttgtgtattaacaaatcctaaattttgaagaataatatgaatagactgataatattgtaactttatgcttaaagcaactttaatatttgacaattatttattaagatatttttccccaagtaaaccttatgttaatttcataatataaaaaattttaaacaagtaatatttaagttccatttctctttttaacctttttcattttacttcataaattaaatatgtgagatttgataatgtcttgaccgaaagcctttgttacgtaatggaaagaggatcaaaccaaaactcaggacatttcacttctaattcttatttcaattctggtagtaactcagttatctaaccttgatgaggcatatcactgaacattctattttgagtgaataaagcaatcataataatacttgtgctaccactctcatcagaagattgaggaacagcagattaaaaactaccaagaagaattaagaactctaaaaaatgaaaagtaaattacaataagaataaccaaatgcattaagaagagcaatggactagggataagtcagaaaatctggaatctagtagcaaccagttctgccacttaggagatgtgaacatatcattcctgttctccagtaaaccgtcatgaaaatcaaatgaaatgatgaagcaaaaaccacattaaaaacaataaggtactagtatgtttgaaatattgaaaaactataaggcactagaaaaccttaaatatctaaattattaagaaatatgaatgattacatgtaaatcattaagaaatcatataaattattaagacaaccttaaacagtaacctgaagaagggctataaatctgcccaggaaaactgctacaaggtatttatctattacagaaaaatccattttctattctggaatgtcatcactactatccaataactatattctaggaagaagtcctattccacagagcttcccctcgtagtgcaacccctcatgtttcccagtgtccatgggatactctacaattctgacactgaaacaaaaaatactgagcatgccatcctgaaatattctgaaataaaactaatcaaaggagatgctataatctttttttaaaaagttggccaagcgcggtggctcatgtctgtaatcccagcactttgggaggccaaggtgggcagatcacttgaggtcaggagtttgagaccatcctggctaacacagcgaaacgctatctctactaaaaatacaaaaattaggccaggtgtggtggctaacgcctgtaatcccagcactttgggaggctgaggcgggcagatcacttgaagtcaggaatttgagaccagcctggccaaaatggtgaaatcccatctctactaaaactacaaaaattagccgggcgtggtggcacacaactgtaatcccagctacttgggaggctgaggcaggagaatcacctgaacccgggagatggaaattgcagtgagccgagattgcaccactgcactccagcctgggtgacagagcaagactccgtctcaaaaaaaataaaaaataaagaaatacaaaaattagccaggcgtcatgatgtgtgcctgtaatcccagctactcgggaggctaaggcatgagaattgcttgaactcaggaggcggaggttgcagtgagccgagatcatgccactgcactccagcctgggtgacagagcaaggctacatctcaaaaaaaaaaaaaaaaaaaccaggcaagtctattgatgaacccttcatttgggaatattttacatatcaaactatattcattaataatatattcccccaagtcttattagtcaaaaacattttttaaaagcatgattttcatcaccatggaaataactagcttgattccagccaaaagctgagatttttgttatttcagttagtctgtgcaaatttattgtgggtaaacacaggagttccattttgcattcttttagaggcctgggccatcagattttaaaaaggtatgaacttaaaaaggtcaaaattcatgttgggaagactcaatcacaggataagcttgctaacaacagttaagaacaatggaaggaaaccaccaaaggaatggtctccaatgatggaaaatatgataaggtactgacaaatgacagctaaacagcagcaaaatttctaactcctatcatttctgccttctttttccagagaattatctatctagaaaaggtagaagacgtcatcaagaggaaaatgatgcctctaagcttgggactgcatcttccccactcttaatcctccttctataggaaggaatcttcacgagcacaggatccctcacttctgtctgctgcctcacctatcccatcccataaaaggaggtggatgctcatcttttcagtctttctggtgactttgcaaaaataaattgaacacattaaccctttcttttctcctttttctcttggaagtgaagctgcctttgagatataactggtcttccatgtgttttatagagatacattgtgtccctatgaggtaagactttgtaattctagggatcatttttcaaaacttaattgcctatggacataaagtactttctccaatatcagctttatcaatataaatgttaccagctcccatctacctattcttttgcttatttttcattttgttcaaaacttgggtgggaatagggggtgctatttatttatttatttatttttgagatggagtctcaccctgtcacccaggctggagtgcaagtggcgcgatctcagctcactccaagctccacctcccggtttcacgccattctcctgcctcagcctcccgagtagctgggattacaggcgcccgccaccacgcccggctaactttttttttttttttttaagtagacaccgggtttcagtgtgttaaccaggatggtctcgatctcctgacctcgtgatccgcccacctcggcctcccaaagtgctgggattacaggcgtgagccaccatgcccggcagggggtgctatttattgagtcccaaatcccacacagttgtagagatccttcactactttaattgagcttcagtctctagaatactgaagcaacctgcaggtgtgtcccacggtggataacctttccaaaatcagaatgagtaggacaggagccagaaaactggagatatcaagtatttcccaggtttccaaaaatgaaaaagatagatttcagaaactgagtgaaaagcttgaagttattccttgagaaaattctagaagggatttttgagcagataactgattttaactaagcagaattactataccttatgtataaattactaaaatggaagactgaaatatgactaacattgacatcaacaaggcatttgatcaagagtcttgtaatatgatcaagacagagaatataggtcagataacattaaagttaggggaattctctacataatgaatggtgactcacagagatttggcacgctattgacatagtcctcatagctctattctttgatctgtgtctaatcaatcttcatctgtatctagtcaatcactgtataaaggcataaaagacatgttttcttaacgtactgatgctggctgggagaggcattaacaatgcaggataacaaaaaagcaggatgtaaaattatttcaatgatggaaagagtgggcagaaacctagcagaagatcccttctaaatctaaatcctaattaaatacatgtgtcttgttgttgcattcacttacgtaaattgtcatagtaactacttttagtctttttaccatatatttgataccgactttaacctgtcaatgatttaacatggaacttttttctttacaccagatatcattatactgatttaaaaaataaaaatacaactacatttacctagtaaataaatacagagaataggccatactggacatgttccgtccatattgaacaatctcattctcctgatcttcccacttctcaatttcgcagtcagcgtcagaggtgagcaaacccagcttaagtccaagctttgctatcttggcttgctcctatgaaacagacgttttaatcacaacgactttatcactattcatgttaaaggaagattagatgtaggaattggtcttacctcagagtcaggcttgtctggctttaatgatttcaggtttgcattattcttctgtgacaataaaaagattaagattatcttaaaaagcagtacattaaactgtaaggaaatacaatagtaatacaaagcataacaaagtacttgtaacaaaagtttaaaatattcagtatgtaatgactgaatattttaccaattgcaagtactctactagtaagtgagttcagctttgaataggttgttagtttgaaatctggagccagagaaagcaagtcagtgccttccctgctctgtggcctctgtgcttacagctgctctcctcttttcacaagggcttccagggactcaagacaacttctgcagtattcctggagtccaattattatgtcccccaaacctccctggcttctctgttcaacaagattcttataatgcttgaattattcttatgaaatgatatattaaaattagccactatatgtagttttctatacattccttatgttatgactccagaattcaattcctttaactaatttgctcttggaaggctaaatttcaactctctagcttcatagatatcacaactgctaatctcatatcccaagttataaagagattatacttaggattctgaatttaatatgtgaaccaatgttcaatggttccctatttttgaaagagaaagtttgttttcatgtaaactatctggaactcagagtgtattttccctagaaggggagaaaatattccatcctagttagaccaggctagtccactgatgcctgtatacttgaagaatagagtaccaggacaaatcacaccaccaccaatagcaacatttctttgaaaaatatattccgaagttctctggagatgatagcccacagaggggattcctccaactctgagatctggtgaaagctcccatggtagaggcaggagtcccagaacagctagggtttgtagagaaaagggggccaactttttacaatggaaacatatatttaagtcatacacactcacaaacacacattgggtatggattcacatacctgcacacacagtataaattacaataaaacaaaacactcatgtgtacacttagcttaggaaggaaaatcatcactaatactttaaggaaaaagatcttctcatacatatatttttatttcccttattaccatgactttttacttctgaccaactattctgtcaccagtttcaccacagaacaaaacagcctcgtggagtttagatctgctcatggaacatagcccttttgagattttctaatgatgtttactattaaagaaacaggtgaagttgaaggacagaaaataaaaataaaggaactcttgttacacacacatgcacacacacagagagaaagagacaaagacagagagagagagaataaacaaatatgaccaatgatctctctggctcctccttgaatggtcacatcatctttatctccatccttggtctagttgactataaggcaactgataaaacatttaagaaagtaaggaacaccctcaaggtttttaggtttagttttattcagaattttatactttatattattcttttaaatatagttgcattttcatgatttttatttttacttttactaatgatgatgattattaaagtttaatgacgactgaaatggaattgcctgaaaaggtaaataaaccatcttaataatgtaaccaagcttgccatctagtggacactattttggaatgcagtcagattcattcgtttcagttatataaagctaaaagacgtcagtcccctaaatataaatagcaccagactccaacttcacttcctaaaagagagaactataattttctaggaatataattagctatgctatccctcaactaagaaaatggttcatgactctgaaatgatttgttactaaagataaaaaatactattcagttgaataaaatctttgttccattcaacctgttaaaagctttgtgatgccttttctaattctcaaaaaattattttgtagtagccctaaattatagcacttacaaaaacagtgagtctatccttacttgcttaaacccagtaggatattagctataaaaccatctgttagggttatcttaaaataacaaaaatagacaaattgctatttgtactttcaaactgttctgacaatagcttaaggcacaaaaactgttttttttaagtcacagaattaatttgcagtatcatgatcgcttttacaccagctacattcagttcctaatgttgtatttcagtattaaatgccagtcccttttcaaaaagtacactaattaagtttggaccattttttgatttggggatttgatttatcatttgttcttcccctacaccatcaagcattcccactatcatttctaaaattccagacttaagactttaatatctctcttcattgcaagttctctcttctgatactcaccatctgttgttcttcaccacactgttactattgataatcatcagtaattttattttttttttttttgagacagtcttactctgttggccaggctggagtgcagtggcacgatcttggctcactgcaacctccatctcccaggctcaagcaattctcctgactcaccctcccgagtagctgggattacaggcctctgccaccacgcctggctaattttttttgttgttgttgttttgtttttgtatttttagtagagacacggtttcaccatgttggccaggctggtctcaaactcttgacctcaggtaatccacccacctcggcctcccaaagtgctgggattacaggcataagacaccgtgcccagcccacaatttccaatatttttgtcccccaaaagggatcttgggaccactacttggttaatataccactctgtatctctttcccataagtatgacatgtgacatgttttcatctaggtagaaagcatatgaaagtccttagtttgctgaaagtgattccaacatgacttctcaaagtagatccaagattggaagaacaaaacaacttctgacttcagatatggcttatttatttatttttatgatgctattactgggatatggctttttattaatcacaaattatgttacctattctctcaaacccccaaacctaaaacaaatattcagagtgtaagccacaactagattgctacccagaataacaactctgaagtcaacattaatatcctaacttttttctgtcatgtcaattatttgtggtagaggggagcagcaacaggcaacaagagcataatttgaattctgaataaaaacattctgcaatgtacataattcttctacttaccattggctttggaagtgaaaggtagccatacttctctcctacaaataacacatataacttaaaaaattttttctattaatatatttttctattattcatagttaacttttaaagtattaattaaacaaacaggaatgttagtacattagttttgataacagtctattcattacataaaattcagaaataaaattgtaatttggctggtgaacatgaagactttcaacagctgcatgtctaaggtacctatgctggtcaatctccacctctcccaacattaagggagaaaggcaaatgtcccactgacatttactgccacttgcaatcagcttcattcacagagtgctccttttacagcagtttgcctctaatgaaacctgattcctcttttatcagtaccagtatcagcgcttcttccatttctgcaagtaccagaccaaataatttacaactaacctcataatgtattctctcagtcagggaagaagaaaaccctctgtacaagataggaagatgaaataaagcaaataacaggaggttttttgactgtgaattgacacgtcacatgaagcatgataacgaggaaaggaaggagacgggcaatgcccacatcatccctgccccatctatcatctttacaacttccaggtcatgtatacagtcagattacaatgaataatagactttttataaatgctggtttgtgacatctgaggtaaaaattcaagacctaagcagtaattgcttcttgaagaaaaatttcttcttcaaggaaaacaagtatattcagctataatagaatagtttgaaccatatgaaattgctggtattcaaccattttgaaatttcatatggtccaaactaataaaagtaaacataatataagagcactaaatcataccttttctcatagaatgactattacaggaaatgggcaaacctgtttgtctcagaatggcttatacaaatatttaaaatttcatctagaactgtactattaaatatgaaacctactagccacatgtgactacttagcacttgaaatgtggctagtctgtactgagatgtgtacatctagtctgtactgagatgtgctagtctgtactgagatgtgtaagtgtattaaacacttacaagtgtttaatacataacagattttgaagatgtagtacaaagggagaaaaaatatataaaatatattaatttaaaatattgattatatactaaaatattgattatatgtttacatggtattttggatatttgggttaaaaattattaaaacaaatttcatgtttctttttaatttttcttgtgcctgttagaattttttttttttttttttttgagacagggtcttgctctgtcacccaggctggagtgtagtggtggagatcacaggcttactgcagcctcaacctcctgggctccggtggtcctcccaccttccacctcctgagtagctgggaccacaggcatgtgacaccagctaatttatttgtattttttttaagagatgaggtctcactgtgttgcccaggatggtctcaaactccttgggctcaagtgatcttcccgccttggcctgccaaagtgctgaaattacaggcatgagccactgtgcctagcctaggaaatttcaaattatatatgtgtgtcacgttctgtttctcttggacagtgctgatctagaagaagaactgttactaagagtgagttaatggtacttgggaatagctttatgattcaaatcatttccttgtaatgtcaaaattgtaagggaattttattaattaatggctttctgatttcagaatggtgaggggaaaaaacttaaaaaggaagaggctattttcatgccttggctctaagctctgatgtgaaaagtgctcgatttagttgcaatattaacagaagatagtcttccggtcactcagaatttcaaaattcaccatctatcttaattcaaagtctgaatcctgtccataatatcctttaaaaagtgctcttagcatattataaagggcacattaaacagaagtaggaacccgggcatggtggctcatgcctgtaatcttggcactttgggaggctaaggcaagtggatcacccaaggtcaggaattcaagaccagcctggccaaaatggtgacaccccatctctactaaaaatacaaaaattagccaggcgtagtggtgcatgcctgtagtctgttcttttttctgttttttgttttgttttgtttcagcctgggtgatagagcaagactgtctcaaaaaaaaaaaaaaaaaaaaacaaagtgggaaagtactaaaaataaataaataataaagaaaaaagaattttgaattttgaaagggcactatcattacttaaatgtcatcagctacaggagtaatcttgtattatctaacttagtaatcatctatagtgcccatggccctaaaatgttcatatttactctccacaagttggggcaaaaccaactgtttcggtatctcttatatctctaagataccacagagttaaagcaagtagaatgtataaataaatgcattgagaaataaatccaatgaaaagaaagcttttatgtaacctgatttgctactattttcatccacctagtagtatttatcacttgatagttctaatccctctggtcctcttacagatactttgttttgcttcctattcccatcctttagttagactctgcatgatttatacgaatttgaggataattgcaaaattgatcattttttcagataggcctcctccacatactatgcaggtaagattcttcctctttcccccagttccaacagaaaccaaacaagttgacaataacacaagaaaaagcaatctaatactaacaagagatctaaattatagttaattatagatgttatttcccaatttttttatagatgttatttcccacttcttttttttttgagacagagtctcactctgtcacccaggctaaagtgcagtggtgcaatctcggctcactgcaacctccacctcctgggttcaagcgattctcgtgcctcagcctcctgagtagctgagtagctgggactacaggtgcacaccaccacgctcggctaattatagatgttatttccatgtgaatctaattattgccgttgattctaagcagaaaaaaaaaaaaaaagaataaactggctcagccaggcacggtggctcatgttcataatcccagcactttgggaggccaatgcgggagggttacttgaggccaggagttgaagaccagcctgagtaggctgggcatggtggctcatgcctgtaatcccagctctttgggaggctgaggcaggcagattatgaggtcaggagatcgagaccatcctggctaacacggtgaaaccctgtctctactaaaaatacaaaaaaaaaaaattagccgggtgtggtggtgggcgcctgtagtcccagttacttgggaggctgaggcaggagaatggcatgaacccgggaggcagagcttgcagtgagctgagatcacgccactgcactccagcctgggtgacagagcgagactccatatcaaaaaaaaaaaaaaaaaaaaaaagaccagcctgggtatcacagcgagactcccatctctgggggaaaaaaattaaaaaatctgggcatggtggccagcacctgtagttctagatatgtgggaggatcccttgaacccaggagtttgaggctgcagtaagctatgatcacaccactgcacaccagcctgggtgacaaagtgagaccctgtctccaaaatataataataataataaaataaactggctaaattatgtttagctgttatatcaaagaagtagcataaacaaaactctatcatattataaacattaaaaatagttggaaaaacaggactatttggagaaaatatacttagtacagatctgatatatagaattgtcttcaaagcactgtcctcaacgaggtattgtatgtttaatactccctaaatcctgtttagtcaacactacaattgtgccatcttctgagtttataccttcagataaattaagttcacaattaagtttaaaggccctctcatcttaagggagcactaaaattatttcttatgaaaacctaattgagaaatgttctcagttacaatatatagagcctttctgtatatctacaaaataaatcgaattccccaagaatggaaaagccttatcatttcactgaaaatgtgctaaattatccctgattcacatttcttataattagctatctttagttctggaggcactctatatggtatgatcaatcaaaaaattaatgtccccagacccacttaaaatgaatccctgaccactaaagcataggcagcttatcagctaaactcaggagcaggaatgaggtattctaatctaaacccagctatcatcctccaactcctccctctccctcacctctatattcaattgaccaataaaccctaccaatattagtttttaaattcttcttagtccccttatcttcatcttgactatcatcaccctagtatagaccatcgtctcttctctggatagatcactcccttgttgcaggctcctaccatccccaaacaaactcatctttacccacgaacatgtttatcttcctgtacccccatttttagtggcatccaatctgccaaacgataatgtaaatgcagggctatgaaatagggctgccaggaaaatgagaaaagtagttacagaactgaaaaccaaattaagattcttggcacgattgtgatcataactgccctacatagtttagttagagctgcatctctataaactgaagcgtagtcatatttactctgaaatgattgaaatagaacaaagggaattcagcttccttaaaggaaggatagagaccgcaagctctgagataaggcttttttctgacacttattatccaaaataatctcaaattctaaactgacacatattcaccactaaggaaaagtggagtcttttaggtgtggtcccttctaatacaaggaccacagcctccctggaggtttgggtgagaaggcagaatgggatgaaagcagaagacaggaagacaagtattgatttttaccttcttgaaacaatcccaggaggtcctagtgtgaaatttcagtgtctggggttaaggtggacaatgacctaggtctcagactaacttttagcatgtgaacactaaagcctccctcctattgcttagcgtgatgtttaccacttagttggatggttgaatgatacttacaagtatgcctggtagtttgccaatcacaggaggcaagttatgcagagcagaactaaggtggctagaatacagcaaaggcttttcaacaatagtcataacaggagtcataacagcagcaaagagaaatcaggacctgaagaatacacctttgtatggaaagcagtgggcaggtgcaaggtaatgagcaggtttgtcacatcaaccatgcataacaggaagaacaacactgtggcactggattcagttcagtcagaatggttaacccagagatggacttctttgaggaaaaagctatgctcatgaggttcatgataaaaatcaggacaaataaaggcagtacacacaatcaaccaactccatctcagtgaaacctacataaacccttcctgaacagagaggcactttcccagtgaaacaataagtgtctcattgactgaaggctgaggcgtttcccacgtaagaaggaatttctgttcagtccttaggaagtttgggtaatgctgattttttttaacataagttaactgaacctaaagaagagattatttacataatatccagcttgaaagtaaaagaaaccacagtgctcacatagtctgaaaacaggcataggatgtgcaagcagtattacacattatttcatttacatccattgaaataaagaaacaaactcaaaagggcaggtaatgtgcccaggattccattactaacagattgttttacctcttctgtaatttagctggccccatcctcagccaataagtggaccaaccaaaacaagaatacagtcattacttgttccttgccctgtacttcctgggatctctcagtcatttctgaaatagctttgggagggaaaaaagcagaactcagagctgcagttgtgagcatttttcacagaattggttcattctcattagaaaactttaggattggagtggagtttaactgcttgagtaatagagtatgggtagttaataaaatttcatctttggcatcattcaaacctcagtaagggtcccagctcctatagtttactcactgtgggatacttcgagcctcagtttcatcattcataaaatgtggaaataatacctgtctccagggttactgagaggattaaatgagaaaatggacatccagcacttatgaaagtacctggaacccagtacattctcaagagatggcagctactattatttttatggttataatagtcacgggcctctgaaggatcatgtttacaattttacccacaaagaccctagtagcctgtggcttttacttttccttaaacttccctagctattttttttaaagagcctaactttggtagaagaaaggcaaatctcagagacagaaaaggagaacactgaattaatgttgcattagatgtccggtgagaggaatctttcagagggtgtcagttcaccattggagaagggatgagcttcatttgtacaaagaagcaaggagtttacctttgcttctgcagatctagaggttttctacggtggggccagactggctagtcctccctagagtaggagaaaggacatagggagagatggatgccagaaagtaggagagattgagattaagtaagagaaattggacctaatgttttctcataaactatttagttttaccacaaggtaacagtggtcatgatgctgatgctgatagaggtaacacttgttgagaatttactgtgaattaacttattttatttaatcttcacacttaccatattaggtagttttgtcatcattatccccattttgcagatgtaaaacttgaagcatagagagattaagttaggaaatagcagaggcaggattggaacctaggcagtccacttcagaacctgtatttcaacttctacccaattctatccctaacatgagattagcactcagatctcagaggaaggaagagaccccttgatggaaaatgcaacttgggtttgttttctgttttaaggaaaaaaattacttatatttatagaaagaaaacccccttgccaagcttatcaacctctaattgctaccgtaattgctactcagaacatcgcctgggattaaggcagagaataactgttaaatgactgctatctttcttgagaggggggaaaagcctgttataactcctcttcttatggaaataaaagagagaagaaaatagaccaaaatgctggtagaacagcccgatttagaaactgcgagcatctcaaacacaaagaggaagggggctcaggcccttggtcaagaaaactagaaccatatccatttcagatgatgatgaactcactggcctagggacatggaagaagtacaagtaatgaaaactcagccatagcccatgtttacaagaatgaaaacacaaacctcttcagcactgaaaacactataggagatacctgtactaagctcaatggtgttctggtaaagaggagaatcagctggccaggattgatgccatattctttccagaatggctgcagctattagtaaagcttctcacagtgcacgtggaacacgtttacaagtacataaagtcagtcacatgccagaaaaatagccatcctgtggcactcctccagcctccctactgggctgatgtcatgggctgatgacaactgataaagccagaagacaatattcctctggcctttaaagagagccagccaggataaagacacagtgcagggtatattcatgcccagaagtcgaaagtacactaacttcaggtagtgctcacaaaagacttttagagctgacaggtcactgagatcactgagcctaagactttcattattgagtcaaggacacttgggcccggagcagggaaaagcttgcctaacaccagtttgagaaagacctgggccttacagatactccaggataacccacaccaggtatcttatcacaacagcaagccacttctcttcatttcccaacagtccctaaggctaagtgaccactcttctttttaaaagtggatcaattatatcatttaccttttaatatccaaaatttggctcatatgaaaatctatgtaactataaatacaaagcatcaaaatgatttgccattcagactatcacagaaatttttaaatgtggaagcatggtaaacatttatcatactttacaaatgatgttatagctataattctattatgccctgatttttaagcaaattaacatttatcctaaatgagtatttttaaaatatgaaatgtttaaatgggcatactcaataaaaaatatgtaatttgatataattgtaaatgacattttatttaaaaaaataagcaagctttgacactacagaagccatttgaagagaaaaaatataaacatgtaaatataaataacaggacacacagtacaatggaaaataaacaaaacttccactcggtattaaaataaagaataaaaatgatgccttcctatacattgtatggcactattctacatgttgtagaaataccaatgaacttacccaccacaggcaatattccaagattatgtagtcatcaaggaaagagattccatccaagtggaaggaaagcaattcaaaaatcaaataactacattcatttcattatgaagttagtagaattaaaacatagaattactgcattatagaagagctgttgtattataattaaaaaacaattcagaagaaatttaaaaatgactatttcaataggaaaactaggatgttaatattaattcagagatctactatgctgtttgttttatttatttatttatttatttatttatttattttttgagacagagtcttgctctgtcgcccaggctggactgcagtggcgccatctcagctcactgcaacctccgcctcccgggttcaagtgattctcgtgcctcagccgtagtatctgggattacaggcgcacatcaacacattcggctaatttttgtatttttagtagagacagggtttcaccatgttggccaggttgggctcgaactcctggcttcaaagtgatccacctgccttggcctcccaaagcgctgggattacaggtgtgagccgccacacctggcctactacactgttgtacaacaaactttactgcttggatactaaaataaaggaggataaaataatatttttgtaatttttttgtgaacaatattttactacaaaaataacccagctgggttacgacaagaattcatttgcagttgaggtttggcattaaaaaactaacaagagttacattaaaataataacatatttcattatgtggacagtttctcacctcgtcttccttcaaacacgtcattgatttctctcagcagtgttgacatgtcactaatttgggattcccaagcttcacaaaatacatctaggttttctttagcaattttactagatggatgcaatgtcaatgtttcagcagcagaaattatctaaagaaacacaatatacacctgtgtgaatttcaaaatcttagccctcagaatcactttgaagaccaaaggtaagtaagtctgctgttcaattcaactcaataaacaactatgaagtaatttctatacacaagctccatgttgggcaatatgaagatgcacagtaggacaaaatttgctgtttcttataatctgacctgcagacaaatagtatgcattattatatacaaacctgcattcagggagcaattctcttcactcaagtaaaactctgtttgaacaaagttgttcccatagaataattcaaacagttatactcagaccacaaaaagtgtactgtatacagagtagcaaaggtagcagtaatagtggtggtggtagtagcagtggtaatagtaggaatggtagtgataataataagtaacatatatacacacccatgagtacttggtagatacatgcttgagatactgtttggtgtttgagatacattaatacattaatatcccccaaaatatacaaataaaatactactttttccaaataagcattattccatttttcagctggaaaagttgaagctccgagatacccagtaacttgtgccagaccctattacgagtatacacagagttgatatctaaactcagatctacctgatccaagttcaggctctttccatcacatcacactgccactcacaaaacacttgtaaagagggcagaaatcatcctggtacttttacgtaccaccacatgggctaaataaatgtgttgaataaataaataaattgttgcagagactgctatgttttcatcaaaatctgtttgtcttccctctggatacataggaagattacatttcccagcctccctggtggagacatatggccacgagactgagttctgtccccacttgaatgtgggtcaccacttccatcctaactgatccaaacctccctcgtgcccctcagtgctctctcccttccacatctgatggttcaatgcacaggctccagtagggactttgaggtcctgagggctagcgaggcacaaaatgaaaggggaccggattgccaagagggagaaagacataccattaatcaggacttaatacaagtgagaaataaactgctattatattaagcctgagattttggcatttggggttttatttagtgttagctactacatgaatgaattaatgaataactaacattttatctttcatataataatcactctctaacacaaaggacttgatggatgctaattgtaatataggcagaaaatggatggctgggttgagtcttcacacacctcctgacctgacattcagtagaaattacactttagcttctacctcaaaatagaagccatcgaccagacccaacctactgaaatttcctgatggcccattacataaaacacacacacacaaagatccaggagctaggaattcagagttcagtcttgatatgttcacagcagatcctttcccttctaccactttcaccttctattcatgacaacaggcactgattctgtctaccttcttgtttcacagactggggatattatatcaaatactcatctagtaagtagtattttagagaatccactatgtgaaaaaatcatgctaggtgctggggataaggtgataaaaaaagaagataaaagccctctattatgaagcttatactctagtggagatttggaactataaacaagcacacaattaaaatactataaattatgataactgctatgagggaaattaataggataatgtgatagagatgcccattactaacaagtgatgttgttgttccatggagttgattatatgggattattcacacacacatgtatacaactaacatgactattcattcacccactacatactagtaggcactgtgcccacgttccaggtgctggggaaacagctgtgaatgaaacagataaatgtccctggcttcatgggactcacattataacaagcagtgggagagacacaattaaaataaattataaaatattttagaagggaataaaaatatgtatcaaaataaagggtgagaatgatggaggggattaggtggtcacagtattttaagttagagagtcactgaaaaggtgagggagctacaggaaaatcgaggggaagtcatttgggatggggcagaaacacttctggagtgttcaaggaacagcaagtaagccagaggaacagactgacatgagcaagaggaaggtggccagtggccatgtaatggagaagcatagatggtaaggactggattttcttctgagtgagaaagtcattggggaacttacagaagattaatatgatcagggccatgttagctaatatattaatagttggtacctttgaatgaattacagggccatgttagctaatatattaatagttggtacctttgaatgaattacagctagctgttcctccctctggggtgggcatagtgtcacaggcacagcacttgccaagcagatggcagtgttataagaacaaggttcccctcttcagggaaagcaggcacataacttgccatggactacaggctagattttggcattgctctcctctcaactagtgtacaaactgttcaactgttccctcagtatgtctaacattttaaaggaagtataaaaataacattgccaaagcagagatatccagaaataaattatcccagaggcatgctcaatgtccttaaattatccttttgtgaggcagatggcaaagactaggagtggaagctaaggctttgggaacagaaaaagcttctcaagttatgcaggttattaacaacatgctctgccactatcctggggaagaaaatatggctattcctaatatctctgctgcaataaaacaataaaccaaaaattgcaaccagatggcaagcagggcctgaggataggagcaacaactgattgcatatggcaggagagtcaagccctccagttctattggaatacttttgcagccaaggcaagaaaagtgactcccatgccaatattgaagacacagtttctcccagtaaacagatcccttggttgtaataaagtgttcagcagataatcattgtggaggttcattcatatagttcctgctttcatgataagcctttgacactgttctctacaggagagcatgagatcatccctccaacatccaacatgattctcctagagggcacacaccatcgttgagtctaggtcacttgcactgttctcagctataaatcaaagatgcagggactcaacctctactgcccaatattgcaagttaggaggaatccttttggctgacagtaaataaatgaatataaataaagtataaattaaaatataaataatatttaaaaaaataaacaaaagaacaactgcaaaacgttattttagagcttagactctaagaaagaaggaaacagctgggtgcagtggctcacgcctgtaatcccagcactttgggaggccgaggcggggggatcatgaggtcaggggtttcagaccagcctgaccaacatggtgaaaccctgtctctactaaaaataaaaaaattagccagacgtggtggcatatgcctgtaatcccagctactcaggagggtgaggcaggagaatcgcttgaacctaggaggcggaggttgcagtgagccaagatcgcgccactgcactccagcctgggcgacagagctagactccgtctcaaaaaaaaaaaaaggaggaagctctgtctttaaccattttccttagattaatttgacaggaacagtattaaatgagataatcagttttaaaaaggcttttgaaaattataaggacaaatgaatacctctactatagaaaatccagaaaaaaaccctagctaaacaaggatattgtcatataggtattttcatatgtatatattctctatacatatgaaattatgggaataatttgtatacatacaaatctgtaccctacttttttcatttaacattgaacagaacattctttcagtggttgctaattctggttatcataattattattttaacactataatgtactatttgcctaatttaagatagttattttgcttctgattggatctttttttcccccagatatagactcttgctctgtcacccagcctggtgtacagtgacacaatcatagctcactacagcttcaaactcctggactaaagctatccccctgcctcagcctcctgagtagctaggactataggtaagcaccactgtacatgggtaatttttgtttgtttgtttttattttttattttttgtagacagagggtcttgctgtgttgcccaggctagtctcaaactcctgtactcaaacgatcctcctacatcagcctcagaaagtgctgggttacaggtgttagccaccatgcctggtcccaattgaatcttgtaagtaatgtcataacattgttttgtttgtgttttagtctcatgtcctaattattagcatgaaatgtatttgaatcttaggttgaaatgtgaatattacataacatatggcttcttatgtcatgataacttaatctccaaacatgttataacaagtgcattgtaaacagcttcctttaaaatagatataaactagagtattaattaaatgaaccagtctccaatttggcagatgaccagctccaatggaaggttagccatgttctggcacactaccaacagaaattccattatctttctttctctatgtatatttggactctagttatgaaaaaccatttataccttccatccacacaacttgttataacactcagataggacacaatacagaaggagcaatctgctattatcatacctgttggccagtcacctgaaatgtctcctctgcatgtatacaggttatttccagaggttctgtcccagatatgtgtcgtaacaatcgacaggtctacaagacaatatgtctacagtttaactttcacatcctcatcctccacaatacatagtatcattttataattaaaaagaaaattttacaaataaaatttcttaaaacctattaaaataaacttaaacattactgagaagattattataatattatattggtcaccaacagattctctgggaacaaagcagatatcaataaaggtataacattgtttctacttcctatccaatcatggcaaggtggttacagaatattaaaacagaaagaacctttggaaagacctagtagtgcccacatattttatatataaagaaatttgggaaaaaaaaaagaaatttggctcagagaagtaacttgcccaaggtctcacagctaaactatgtcagagttactacaagctacatgttctatcaacactgtcttccaatggagctaacattggattaggcagactggtataataaggacagaccctatatcagaggaaattactgaaaatcttgacgcttaaaacagaaaatcagagaacattttttttttcaatgttaaaaagatttgctgcaagattcctaaaataagcagtttccctatagttataatatttggtttataaacatagcagcatcaaatttattaaatgaagaagctatatctacagtcattttaagaatgttcccccagaagttttttggctcctatgtaaacaagtaaagaagaggaagccagttcaattagtctaaaggttccttctaaccattagtctttgagatttggtgaacagggtatgttagattatgtgaagatagctagatggttcatatctgtgcatttatacacatgttggctagcaaatacctcatacatacaagctatacatgggttccgttttttgtttggttgttgatatggtttggctgtgtccctacccaaatctcaccttgaattggtaataatccccgcatgtcaaaggcgggaccaggtggaagtaactgaatcatgggggcagtttcctccatactgttcttgtgatattgaataagtctcatgggatctgatgatttcataaatgggagttccccccctgtacatactttcttgcctactgccatgtaagatgtgcctttgctcctcctttgccttctgctttcattatgaggcctcctctgccatgtggaactgtgagttcattaaacctctttttctttataaattacccagtcttgggtatgtctttatcagcagagtgagaacagactaatacagttgggttttttttctagtagatatctgacattttcaataggcagaaggctcagaatatcaattaataagcctaactggaattataacacaagtatcaggtgaagcatcagtaactcataattaagatttggaatcatgtgccagatgtcttctcattgtccctccttaactgctctcctcccttctcacatctgccttttgccctgggagactgacttatattgtctacacctatgtttggattattaggattatcctaatgggatatccaatgggaagccccatccacagatgagcaggactgaggagagaatgggccttgactcccatgctcctcccgggagggtcaccttgggctgtctctgggcctagtcctaaaatcacaaacctctcaaggcagttctctgaaaggcttccccattccacattcccctgctgatgtgggcctggggtggtaccagccttgctaccactcgccccaattactgctctctcatgtatggtttcccccatgccctgtctatgcaattgtaaacagcttctttattaaactctcttcaaattgtcctaatttgagtgtgtcatctcctccctgctgagaccctgacagattcaaacagaaacaaggtcatacgacgtacctccatggctctactccaaggtctaacttctctgagaggataaggaaaagaagattaagaagttcatttgtgggtcttagcattttttttgttttgttttagaggccagactgttgcaggaacagaacagatacatggtatgcttttaagatgccaaaggagagagaaaatgctcagataaattaacccaaaactgtatttgtgttaacattcccacatagtttaataaagccattattaaactacaatttctttagcaccttgtttactcacctcaacaagctgctctttctgttcagagagtttacaggcatattcagccaaagcttctaaatttccttctactccagtaagttttaatgcttttagaaccacatgatcagcatggtattttaatagatctgctgccagctgtgtcgctgtactatgaagctgcagatgtgtgtgtgggtgggggggtgggagggtggagaaggagaagggtgatgaaggaaagaaaacaaacaataacattttgtgaccaagcaccacatcagcactttaaaaactattaataaagagaagccgcaaagcagttccatgggttccactgaggggagggtgtaaagttccctgtgtaacagtaggagttgtgtagcactggtgagcttacagtttctctcaagggcaggagtgatatctaattcatcctttaaccccctggtgccagtggtaatgctgtttctagaagatgaactgggtattcaatggctgaatacccttgtccctttttcattctgttatcaaccagctctttcccatgtagcttttcccttaggtgaaaaatgcttctgctaatcttaaagttggtgaggaatgaaacagtattaagagtattaagagtgcaatatttagagtactaagaaaattggcactttgtgatcattaataagttctttagcatacttttgaaaaagtaccaatgtgagattcaataaatttaataaattttattaaatacctatatcatggcaagcactgtagcactgtactagaggctgggcatacatgacaagtaggacacaacccctgccctcagggaggttagaatctgtctatagttgccatccagatcttgtactctctgcctctatgaacaaattgggtcccaggagaaacaatagattaaagggtaacacgaaccccatggttttattgactttgtgtggaatgcctggctcactcttactggatatctttggacactattaactccaaaatcttttcttcttatcttgcctttttttttttttttaatgatgtgacaggttattttggggttgtccagaaatagatcatttttaataacattgttctcagaaaaatctgactttgaattaaatctatttgaatgaagtgatttcttttttcctggaagtaatccaatctcaattcaaattagaggattgtctccaaaattaacaataggataccctctgcattcatgcaactaagtgagaataattacagttagaaacaaagaaactaaaattcactttccgtggaaactaaatgccacataagaacttaaaaagattttgtttcaccagcaggaccttagagaatatctaatgccagtcatttattttacagactacgaaacagctccacagagactgtgtcttgccaaggtcatgtaactcttgtcacgtgtaagagagggaggcaggacaaacgcaaagttcctgctctatgcaacgtcctgacagcagccttatatacattatctcccttaatccttacaagaattctatgaggttgacatggatatacccatataagaggtaatgaaaatgaagcctgtggaaagccactcagtttatcacaaggagatcatcttctactgacagtcaggattttaacaatactttggttaaaactgaatagtctggaatgaaatgggtaggcttttttctttcttttttgttttgttttgtttttttccttgtgtcaagggcagcaggctttttataaagcatagaaaaccatgtctttctatgtttaacaggatgtttaaatggagatttcaatagacatatcagtgccaagtaagatgtgaaacagatcaccacgtataaaatttatataagaaacatccaaaaaccaatttcagccaggcatgatggcttacacctgtaatcccagccctttcggaggccaaggcagaaacactgcttgagcccaggagttcaagaccagcctgagcttataatagtgagaccctatctctacaaaaaattagccagacatggtggcatgcacctgtggcccagctacatgggaggatgaggcaggaggatcacttgagaccagaaggtcaaggctgcagtgagccatgttcacaccattgtctgggcaagaaagtgagaccccatctcaaaaataagaaaatttttttaaaattctaatttcattgtcttgagcccttgaccgtcttcaagaatataaaggaattaagcctgggtgcagtggctcactttgggaggccagggcaggtggatcgtttgaggtcaggagtttgagaccagcctggccaacatggtgaaaccccatctctactaaaaatacaaaaattagctgggcgtggtggcgtgcatctgtaatcccagctactcgggaggctgaggcatgagaatcgcttgaacccctgaggtagaggtggcagtgagccaagatcacgccactgcactccagcttgggcaacagagtgagactctatctcaaaaaaataaataaataaaaataaaagaattaagaaagcacagctaagggaaatgagaggtctgtgtgaggagggtctgtctggagagctgctgggtgcccactgtgactccctcctccaggcatgcctcaaagcgcagggagcaacaggataaaggggttgaggggcaggggtgggggtagggggggcaacaggaaagcctctgaagaaccactaaggtatccatgagagtgagagtccactgtaaatgtctaccaagcccaaagccatttgataagggtgctggtcactaaaaaccttctgcctctcaactttctctcttctctctctatgccacaacctgacaaaaatcaacaacagctacgtaacggagggtgaggaaagtgaaaaagggagaagagaccacatcttcccagctctatctagttggagctgggaaaacagggaacaggggagaagctctacaactaaatgaagatttaaataatgattaacattctaattttcaactgagattatgttttgtgacttaaagcaggaattggtaaactttttctgtgaagggccagagagtaaatattttaggccctattgtgactatccaactctgctgttgtagtgagaaaacagtagacagtaggtccacagatgggcagcattgtgtccccatacactctactgacgaaaacggtccagttgtagtttgtgaacacctgacttaaagtgaccataggactttcaataacctgagagtggccaactaagtcatgagatgaccaattttttattcagggaacagggaaaccctctcaaccaaaggaatatcttttaaaatttatttcagtgagatagaattgatataaaacaaaatgtacccattttaaagatactgttcagtgagttttgatgaacatatacagccatgtaatcacaacaactaattttgaacatttccatcatgccaaaaagtcctcccatgcccttttgcagtaaatataccccaacctctgacccaagatagccactgatctgatttatgtcattataaattagttttgccttttctagaattgtttttttctaaatggaattttatacatataatcatttgtgcctggcttcttttgcttagtatgtcttagtgattcatccatattgttgcatgtatcaatactgttctcttttattactgaatagtatttggtagaattattccaaaattcatttatcaattcctctgttgatggaattctaggttattagttttttattattatgaataaagtgatgaaaattcatgtgcaagctttgagaatgatggcattaataaaatcatggcttcaaaataactatgtcaaaggaaaacttttttttttttctttttttgagacacagtctcactctggcacccaggctgaagtgcagtagcgcgatcatggctcactgcagccttgagccctggggatcaggtgattctcccacttcagcctcccgagtagctgggactacaggtgctaaccaccacacctggctaatcttttgtgttttttgtagagatggggttttgccatgttgcccaggctaatctcaaactcctaggctcaagtgatcctcccaccttggcctccccacagtgctggaattacgggcatgagccaccatgcctggcctcaaaggaaaacttttaaaaccattttctaggcacagagacatactaataatactaatgtatttcatacacccatacaacatgaaaatcacaaagaattagaagaggctaaatttcaaactatacttacttctttcttaagttcattaagactgtgactgattttcaaaatactgagttccagttcttcagcgatgctttttgttttcttgctttgctaaaaattttaaaaagtatacatgtaatgttaccgcatctctttaatctgttaattacaattttgtttggactgtaaattgtaataaattttaatactattctgtgaactataaaagtagattttcaaaatttacctgtttaagttacagtggaaaataaaatttcagtttagttatatttttcaatgctaactacaaatagatgaacttctgtttttttatttatttatttttctgtgaacctatggattatattgaaaggtgaacttttaaaatctaattttctttaataaactcaagtctaaaattaatctcttttattttctgcctagaatgtccatgctttcactcctaacctagttaaaaattaaaatcctactcatctttaagatcttacataaatgtctttttctcagaaaggctttctcagatcactcaatctaaatcagaccctcttcttactcactgtaatctttttgctccataatcgtcccagtttgcaattacatatttattttttcagtccaaaccatctggaattttttattttttgtttgtttaaagtctatcttccccactaggccacgaaagctgggttcacatctattttgcacaccactaaatccacagtacctggcatagcaaatggtaggtcgtagatattcaattctttgcatgataaataaaaattaaatatcactacttcatgaagacttcttgagccccctccctaaatataaatttgtcctccttcaaaccctctcaatgcatagtctacactttctcttaggatacttacaaagctatttgtacttgtctcaccccttcccgcaaatttctatattgtaaaattcttgcagacaaagattttagcttattcatctttagatttatggtgcttggcatataaaaggcaccagtaacaactgctgaaaaaaatgaatgaatgaaaaatacacctagaatgcaggatcagagatctgagtgcttgtgaaatatgcacgggtaaatttgctaaatttgtgacatttgctaattgcaaatttgagtattgatagaatcacattcccaacagagtatttcatcacaagcaactctttatagtgagtgttggacttaaaactgaacactgaagcaatctacacttcagattgtgtatcacacagataattcaaactaaacacaaaacattgctcaagtctctcacacgactatactctagggcaagattccctgttaataagaacatgtgcactactgtgatgccaagaaaacatcagagaaatctgtgattcatatctactttcattcataaattaatctacttacaaggaaatcaactgctccttctttcttcagtctcagccatatccaccctccttcatcatctttactgccaaagctttgttcatgacttccagatttgtactatcactgctgtatattgtaagccatgttaaatacttttctgacagagcctgggcctaagaaataaataatgctagagacatgtcccagggctctctgtctctccactttgcaatccacctgctataagagattgtgtacacacacttcctgtctgtcccacttctgtcagtcttggccattcttgcccaaataagctcctctgtttgaagcacaccaacagcccatttaaggctcacagagtggccacccaccaattttagaccaggaatttgtgcaagggtgaaaagcttttacttgccagctggatctacccttgttttcattgaatctacaccccaataagttttctaaatcattgtctctgtaaatcagctgtcctcagaggtaagaattgtgtacatgtgaatggctccagcagtcaggctcaggtcccaagaacctctaggagggggtctactcctctgttcttcactctgaagaagtattttggggaggaattttccagaggtgagtttggtggaagagtagggacaacagtgtgaactagtgatagtgacagaggcatataattgagactggctagaatgagagtcaacaggcctggaaataaatgtcaagtattgtaagtgctagatgggaaggatattttggccaactaggagggaaagaagggatgagatatcctgtcccattctggaacaaattcatactcctggtgattatgtaacttccatatcttgcaaaactttatgggaaagccattatataagatttactttgattttaaaaaaagttcttacagcttgaatccacacagaaattaactgctgcagttccattctcgcctgagttgacagttccaagatgcgttctctgtgctcatggctggtgtaggcagaatcagtaaagtcctccatacgctccaagatgacttccaatgtcacagaaaggttctctttggactgaaaataaagattctcccgaagagcttcaatattcatctgagaacaaaaaggacatctatccatccatgtgagtcaatattcccacctgaccaaaatgggctgtaatttctaacagtgcccaggaaaacactagcatttccttttcccaagctgaggggaaatacagccaccaatgatatctatattcgccactaacccagaaggatacattgctcaaaagccttcaatatccatgcaaagcaccattcctagagtaattaatacaatgacattgctatgagatcagtgaatactaaggcagaaagagcatcatcctctagcaactggcaggaaaaatgaaccagcctccaggtaaaagatttgcatctgagaaaatgcctaggcaaagtcctggaagataagttacacccaaatatgaaatgtgctgagcccagggggaaggatggtgtggaagatgtggggtgtgagaagcactggggaagacatccatttttcctttgttaattcagcaaagactctcctagtcacctaactggtctccctacattttgtttaaagtccccaacagcaccttactgacccaaacatcctctaccagagggtctgtataatctaaaatgtaaaccatctgatactgccacctccctctaatagttcctcgccatctatagagaatcaagcccaaacgtctatgtagtatagcacaaaatcctctatggcctgtctttatatacttctctaacagtctatctcaccccctgaaccccctaacaacctttcacttcagccatcctgtttggagttccttgactatgtgatgaacacatgctcatgtgtgcagtctttctctctcagctttctacgatgcatcatgccatttcaaccctgtaaaacactacagtccatgaaatatgtcacacagacaacttgggccaagaggcaacaagcggtaatgatcatgattatggtcacaatgaatgtgataataaggataccttacatttgtttaacacttcaaagtcctttcacaaatgttattttaattaatccttatgtgtgacccattttaacatcatccatgaaaatatcaaagtttgggaaagtcaagatgccataggagagtccttgcttcccctcctgctcttggcccaagttgtgtcaggtgatcactccatcctaggtagacagaaacttgtatttaagctaggaaagaatacagataatagtaaggtatggaatttacaatggggatcttctcagagaattaaatttattttattaatttaagagaattaaatttgagaatttaaacagaattaaaacataaaaatcagttatattggtctcataccatttatgttaaggttttttattttccctttagagagaaaatatacatgtttttagacagcaacttagtggagttttgtggggtttttttaaagaggctatttactgatatggtttcataacatttgtccatatattcatggtaccaaatacagcaaagtacccagtttccctccatagattatactctccatcagaaaaaaagcaagatgccaaagagataatcatggacagtgagactgagcctatttataacagctctgcctccagcatgcctgatggcgagagggcagcagccagagctgtcggcagcagccacaggcagagcactgcccctccttcacctgcactagaaatgcagcagcaggtggtgaaagatgtctctcacttgacttacttgtttccctaattatcctttgacaacacatctcctccttcagcatttataaaaagggaagattagaaaaataatctctaagatctctttcagcaataaaatttctaagagaaggtttggtctgtacagtttctttcccctcaggaagactcagtggtaggactggcatcatataaacaaacccagaggtgtaaagtgaaaggtcatggactttgggattagagaatcctgggcctaaagaagggttctaccacttactagctctcctcctcaaaaaaaaaagacaaaaaacaaaaaaaaaaaaaacagtatataattatatccacctaaagggcaggtagggattaaataaaatatttattaagagcaaaaagagatattctttccattactgtcttttcaccccatgttcctacttagaccttcacacaattagaaatcaaagtccagggccaggcgtggtggttcacgcctgtaatcccagcactttgggaggccaaggtgggcggatcacctgaggtccggagttcgagaccagcctggccaacatggcaaaaccccatctctattaaaagtacaaaaattagccggctgtggtggtgggtgcctgtaatccaagctactcaggaggctgaggcaggacaattgcttgaacccaggaggtggaggttgcagtgagccaagatcgtgccaccacactccagcccgagaaacaagagtgagactccatctcaaaaataaataaataaaataaatcaaagtgcagtaaaatggaaagaatgccattctcatcatagccctgtctgttagagaggtgggaacctttagcatttggataacttctcagggccttagttttctgatctgttaaaggagggcattgtactagatgacttcttagggccctcccaactcagacactgctcttacccagaaagcatcttcaccatgtctatgacttctgatgagaagtcagacttcctggagtcacactgcctagtttcaaatcccaactctggtacttagtagccagcaagttaatatcctttctgtttctcaagctcctcaacagtgtaatggaaataatagcaatagttctttgaggattatataagttcatatatttaaagcactcagaaaagggctggcacagaataaggactcaataactgttagtgtgtattactgttgatttttaaattttaattattactaatactattactatagtctcaaagtaccaaccctctaacacagagaaaagcaggaattctagcagaaatgatttgctgctcaccatcatcctatggatggtactgctcaaaaagatatggcactgctcaaaaaacaggaagggaacattcttttgaacaggaggctacagctaaaccatacagctaaacagagccagagtagctactataaccaaagaccagtgttctttgtaaatacacctttaatgtaaatattactgagcaacaagtttgtacagagtggcattgctttaaatagatacatttgcttttgtgaagcactgttctaaaacattacacaaaaatatggatactatacataatgatgctcctttaaaatggaaagaaaagactgagtgcagtggctcatgcctgtgatcccagcactttgggaggcccaggcgggtagatcacctgaagtcaggagtttgagaccagcctggccaacatggtgaaaccccgtctctaccaaaaatataaaaattagccaggcatggtagcacatgcctgtagtaccagctacttgggaggatgaagcacaagaatcgcttgaacccaggaggtggaggttgcagtgagccgagatcacaccactgcactccagcctgggcaacagagcgagactccatctcaaaaaattaaaataaaataaaataaaataagaagagaaaaataaaaatatactctctttattcttaccttgaattccttaattccagtaaaaatactgatagatgaaatgtcagtctctccattcggtttacagtcagtcacaatttcaatgaccttatccaatgccactttcatacggtcaaatactccttctttgtttttatgggctgattcgcagttaggatgcctcagacatgtcttcaaaacaattgaaaatttttattttaatatttgatttatgtcataatgcacaaaaatcttacagagaacatgtcatgctaagaaaaatggttctttaccaaaatctcctgggtccctggctcactcagctgcttctcctcactaaagtggaagcaggatgagtaaaaagcgatagcaaggttaaataaaaaatgcagagtgcaaaactatacctttatacttcaacagtaagtttacttaaaaattttttaggaaaaaatctcttttcatcatgattaaaactattttaaatgttgccttacacatgccagaaatgaaaaagaatgaagaaaaatgagatgatatatgatcatggatgcatcttgacttttaaaaaatgatgtaaatgaaaaactcaagggcctagacaaaatagagtcttctgagtgggttccacgaagtctgtttttgtggcttcactgattctagcatggggtaaatactctcagaagaaaaggttattccaaacaaactgctaaagagacattttactcattcattctagaattgcaccaatttgctggccaactgctgtttggaaatactcttgattgataattttgttaaaagtggaaacaggaattaaagggtgaatttacagaataaactaagtgctgacttcttactccactgtatttaacagatcttaacttgtctagctttttctagagcatatgtgctggctcctcaatgagactggaaaaaccctgcaggcagctaccatgtgtgacaggccttaattcatagcacctaatacaccatgttctgctgagctgttcaatcaaagctgactcataaattagttattatttggagttggggaagaaagttagcattcttataaataataactgagatttaactattcaggcctatgttctaagtaatcactttgatcttttttaaaatgtaaattatgtaagttaaatgcatttagtcgggtgttctaattattaatttattacacagtaaaaccaaaattgtcttacctttgaagctgtgagaagcatcattgtacacttttcaagaactgccctagctgctgccatttttgcctttttcttttcatctttcaaatcctaaatatgaaataaaatcacggaggagtctaagaccatgtgaacaacccaatttcttaaaaaagtatttattcaacactaatactcaagaattcactaacattgttaagtgaaaaaaaaaaaaaaaccaggataaagttttacaaactgtcactgcttcaatataaacacatcaacacaatatgagtagaaagaaaaagctactcttagtaagggctagagagccagaaactgagacacaggtagaggctgcacatggctgacattctggtgttctgtcatacctgacattctcacgtcaaatgcacacactgcgtcctaaccagaaacacccagcctatgtcttacctaattaaaagtaaattgtctactgagcatctattgactattatttccttcaaaacagacacttaaaagtcgattctttaaggagcctcgtctaattaatcccatctaactgctatgcatctcaaattggggttcgtttgtcttaatcttaatcaatatgctgctctgaaatattcttaagatgtttcttgggtagataattttccccaacaagattgaaaaggaacacctaagaaagcactgtgtattgaatttgttttggtggggggtgacttctcctcacagagccctcaatagaatgtgtgctattcacatgaggtagccaaagtttgctgatcaaatctacaacaaaatactctgttaataatttggttattatatctaaatcagaggtgggcaatactttcaattaaagcccagataaacatttgaggccttctgagctatatggtctccatcacagctactcaattctgtcattgtagtgtgaaagcaaacagagacaatacacaaataaataagaacagctgtgttccaagaaaactttatgtatggacattgaaatttgaattacataaaatttttccctgtcacgttagccttttttatttgtaagttaggttaaaggccccttcttacaaataagtaaaacctaaagtttgagaatgatttgcctttgaaagtaaatttgcttgaataaattagaatggattcagaagttagtcctacacaataatatcactctcactcacttgcatcccaatatagatttaataaaagatagagatggaattacaaatagtgtacgacaaagtgcatataaccccaaagctaatgcagatcacatcccaaagaactgtgtcctatatgtgagtatcatccatcatgggtacctatcagataaaggctgaggttgcttataaaatttccacccattcctcttgtctttaacattttggacaggactcctttcaaaaccacctgtgggtctagctgacaatgcatcaagtgtgtatgccatacctgacacttacaagccacatatgacaccataggctgtatggtgataacaagcgacagaaaaagatggcatctcaacctggaaagggctggtccacaggacaaaacagaggcgtccataaaacccagatggtccatgaagcactaagcgaagcatcccaatacctccagaagtattttcccagacttgggtaaggctgtcactactgccactttctttttttttttaattattattatactttaagttttagggtacatgtgcacaatgtgcatgttagttacatatgtatacatgtgccatgctggtgtgctgcacccattaactcgtcatttagcattaggtatatctcctaatgctatccctcccccctccccgcaccccacaacagtccccagagtgtgatattccccttcctgtgtccatgtgttctcattgttcaattcccatctatgagtgagaacatgcagtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttacagcagcatgatttatagtcgtttgggtatatacccagtaatgggatggctgggtcaaatggtatttctagttctagatccctgaggaatcgccacactgacttccacaatggttgaactagtttacagtcccaccaacagtgtaaaagtgctcctatttctccacatcctctccagcacctgttgtttcctgactttttaatgattgccattctaactggtgtgagatggtatctcattgtggttttgatttgcatttctctgatggccagtgatgataagcattttttcatgtgtcttttggctgcataaatgtcttcttttgagaagtgtctgttcatatcctttgcccactttttgatggggttgtttgtttttttcttgtaaatttgtttgagttcattgtagattctgtatattagccctttgtcagatgagtaggttgcgaaaattttctcccaatttgtaggttgcctgttcactgtgatggtagtttcttttgctgtgcagaagctctttagtttaattagatcccatttgtcaatgttggcttttgttgccattgcttttggtgttttagacatgaagtccttgcccatgcctatgtcctgaacggtaatgcctaggttttcttctagggtttttatggttttaggtctaacgtttaagtctttaatccgtcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagcattatttctgagggctctgttctgttccattgatctatatctctgttttggcaccagtaccatactgttttggttactgtagccttgtagtatagtttgaagtcaggtattgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcaagatattgattcttcctacccatgagcatggaatgttcttccatttgtttgtatcctcttttatttcattgagcagtggtttgtagttctccttgaagaggtccttcacgtcccttgtagttggattcctaagtattttattctctttgaagcaattgtgaatgggagttcactcatgatttggctctctgtttgtctgttattggtgtataagaatgcttgtgatttttgcacattgattttgtatcctgaggctttgctgaagttgcttatcagcttaaggagattttgggctgagacagtggggttttctagatatacaatcatgtcatctgcaaacagggacaatttgacttcctcttttcctaattgaacaccctttatttccttctcctgcctaattgccctggccagaacttccaacactatgttgaataggagtcaccactgccactttcttttccttttgagacagtctccctcccttgcccaggctggagcgcagtggcgtgatctcagctcactgcagcctctgcttcccaggttcaagtaattcttgtgcctcagcctcctgagtagctgggattacaggcacatgccaccacactcagctaatttctgtatttttagaagagatggggtttcatcatgttggccaggctggtctcaaactcctgacctcaggtgatccacccacctcagcctcccaaagtgctgggattacaggcatgagccaccatgcccagcctcaccactgccactttctaccaccttggtccaggtcaccatcatctctcaatagattactgtaatagcctcttgagtggtctccctgcctctgcccttgtctccatgcaaactattctcaacatggcagctagagtgatactgttaaaatgtaagtcagaaaacgtcattctcctactcaaaacctccaatggctccccattttacttaaagccaaagtccttacacagtttggcctgcccactacctctctgatttcatcttattacccttcccgtttgctcactttgatccatccattggccttcgtgttctttgaacacaccatgcatgtttctgttttattgtctatctcctcccacccctactaaaacataagctccatgagtgcagaggtttttgtcacttttatttactgttgaatcctcaacacctagtgtagtatttggttaacagtaagcagctgatgaatatttgctgagaaaactgagaatgcacctgacctatagctctttgcaggatattttgactattctaaaggagaaagcatttgaaccctggatgcatattccaaaaaagtgacccaggagtagcacttatcaaacacagatgataaaaaggctgccagtaagtttcaggggtcccacatttaatgagctaaattgctaaaaatagataccacttcagccagaagtttttaaatgttggatcacaatattacaagaattgagaaaaataaaatgttctccatgccaaatttctaactacaaatcaaaatgatggtgaaagtttttcagttatgtccagaagctgaagaggatcctgtaggaagtgtaactgaaggatggtagctttagaacctatgactcatgccacgcttgctcaagtgatcaagaaaatgctagattataagctactattattataaaaatactcaggctaataattatcattggggagaatgaggagaagaaggaagattaagagaaagagaaggaaaagaaagaaaatttgttttataaagaacaataatggcagacagaaaatgaaacaataaagtacctgcctatagaaacaccattggtattacaaaccaatgccattatttagcctgccacttgccagaccaatacccatttttcaactccagctgcaattgggaaagttcatatcaaaaactgagagactagcctatgggactacacccagaaccatcccaagaaatggtcaattattatatatatttaacctgccaacaagacagactcctacacaaataccccaacaaggaaaagtcaatcctagacataatatgatcttccatctcccaaaactgaggagcttactgtctgaattggggaacagacccataaggaactaatattggctgggcacggtgattcacgcctgtaatcccagcactttgggaggctgaggcgggcggatcacctgagattaggagttcgagaccagcctggccaacatggtgaaaccctgtctctactaaaaatacaaaaagttagctgggcgtggtggtgcatgcctgtagtcccagctactcgggaggctgaggcatgagaatcacttgaacccaggaggtggaggttgcagtgagccgtgatcacgacactgcactccagcctgggtgacagagagagactccatctcagaaaaaataaaataaaataaaataaaaaacaaatatcatgttgtagtttgagaactacagactttagaatcagatataactgagttcgatctgctagcacagtgaccttgggaaagtttatccttgtctcaggttcagtttccctatatgtaaaacagtagttaacaatacctacctcatagggatgttttgaaaattaaatgagatcatgtatattaagtacctaacacataggcagtgcaaataaataatggcttgggttattactattaatctaatacggtaagaataacaaatatctaacaagatactataagaatacatatgatgactcaattttatgtgcctgagccctagtagaggaatcaaatggaaagcttcataaaagagaaagtaaccaaataaaaggaagaagtacttgagttgagccctgatagcaagtatgacctttcccagtgtgtgaggtgggaacaaaattaactgttataaatgtacaaaaaaagacatatagatctacttactttatcctggcttatctatgaaaggctttcaagaccaaggctatagacttaataagcaaagaaaccagtccaaacaatcctaacgatcatacctccatccaaactaaaaagtatgtatttatctgaagattgtaaaatgtgatgaatacatacattttgtctatctccactcagatgtgcaaactccaccatttcatttccaaattgactgaatatttggacaaactcttgaaagctattcactttctctagtctttccatagttgcgagaacctgcaaaacagataataattcattatttggtgagagctactcaagagactgagattgtcaaggctgagtagagagaagaaaaggaaaattctgaattctaggtgaaagctgaggaggaggagccagatagaagacacacaaggggatgctcagagaagtagaagtagattcaaggcacagaattattaggggaatgatttgtttatatgatgagattttgagttacttgaaaaggaaaaggaaaaagaataaaagaaatgactacatatacaaaggaagggatcatttatgtagccaagtctaaaaggtgggaatgggcaggaccacagtaatcaaatcttcagagaactgggaaggggtgaggatgaaagtcagcacacacaagctttaaggttcagtgaaccaggatgataggaaccctaacattctcaggaaagcagaaggaacctcatcatcttcagagtatagagtcgaaagggaagtgtgggactttaagggtgggaaaattagtctggctcagtcaggaatgggccatcaggggtgaataaagagtgtgtgaatctggtagagccagtgactaaaatgttatgtgttttcttgatgtaagaaacaaagtaaatagatgtgaaacatattttcaaatacttttctttaaaataacattattagattgttttagtcgcaacaagataagttaaaaaaaaacacagatatcctctgtttacttatttttcctgagaatatgatgaatatttggcatgttaatctgccctggcagctcaggaagttcaggcgactaacactgataaggcacgttgccaccactgtgagaacctccatctttcaaagaggggaaggttgtttgtatttctccagcgctgccagatccacctctccaatttctgattcattcaacacttatcaagtggttttatcctcaaatcctctaggacaactccttccctggccaactgctctcctctttgcctagggaattatccaaagcaagaagtgatcgtacataccctggattcccagatgatcatggagcatgaccatcatctgagagattaacttctggactggaagagtttaaatctgttctgtaagttttgagattattcagtaacatttagggactctgagtacagaaattttgtagttgtggataattatcatttccactgatttaactgtgtcttaagttatatattgttagtctctgatttgggagggaaaaaaagtacagaagaattcagtatttttatcaactaggtttctgctacatacattatcatagtgctcaccttttctttccaaatgttgtacacatttaaagcttttaccaataagccttaacaagtggataatgattctctaagaggagacattacttgcattcaaaagtttaggcacagcatacccatcatttaagaattgcacatatagaagaaacactacttttaaactacagacagagttataaacaattataatagacaagcattgccaaattacttacaattaacctaaaaagaacttttctttttttttttttttaagcaacgctcagacatgcatagccccgggaggaacccagggccacaagtgcattcaacgtacagatgatcagtgtgtcaatgtatcctgcattgcacattaattcccacagctagctgcattcttcatcgacacacaagccaagcaatccaccactaagagtcataaaaagcactttgaacaacacagaaagacaaaaatacagcaacatcagaaaggtaagtaccttatttcttgatgttattatctgtttaatgactactcggtctgccagcaacaacacttttgtcactgaagaaagaagtaatcttgcagcctttatcactcctgttttgtctgtaaaaattgtgatctgcccatcagattccagatggttcaagttggttatgtctgtaagtgctgcaattgtttctcctaacaagaaagacgaggggagaaagttaaacaggcatacaaattaaaatctagacttctctctaaccttgaaggtaaggcacaatgaggagaaactcagctttggagtcttacttcaggaacaagaaacggtttcaccttgacgattgtagggattatcatacgaagctttctaaccagaaaataatagcacactcttaagaactgtgacaaattttgccctcacccagtttgaaaaacatcataatttttgtttccagtggtaatgcaaactacacaatctaaaagcctcctgccctacaagacagtaagagaaatcccatgagtcaaaaaccaaagaataccctaaaacccgagcagtaagcaggtgccaaggcttgggctggggcgaggccggggagaagtcaggggtcactgccaatctccacaagctgaacggccttgggttttcacccttgggttttcacggatcctcagagagagaaaaaagacagggctttaggccccaagggatgacatcttcaatataatgggggcccggaaagaactgtcaataggcaaaaagaaacaataaggaagtttgtctgtcagtcagcctggactttgggtggggaaagtaaacaaaacaaaagcctccctcctgagaattcaaaccacaggctggccctcatttaggctacagtttgaatttatataaacttcttatgatgcccagcataaaccattctattaattgaactcccaaccctctagaaaaattatcttcttcactgttgctatcaaaacttttgatttctgtaatggtaattatctactaataaaacaatccaagtattcttgtattataatacaaggctacaatattcttcaaacctccatactgttaaaaagatttttaaaataataaacctttaaccaacttatagtgttcaagatcattttttaaagtcctaaatatacctgtgtgcctaatggattgattttcttacaaaagccctcctgtcaattctattacatacacacaataatgtgtcagctcataggctaaggatcttgagtaaaaagtactggaatcttaatggagaggccacagggtgaagtataagtcaaggtttggaaagatcagtctggcaggcacagtggctcacacctgtaatcctagcactttaggaggccgaggcgggtggatcacctgaggtcaggagttcaagacaagcctggccaacatggcgaaactcggtctctactaaaaaaatacaaaaattagccaggtgtggtggcaggggcctgtaatcccagctactcaggaggctgaggcagagaatcgcttggacctgggaagcggaggttgcagtcagctgagatggcgccactgcacttcagcctgggtgacagagtgagacttggtctcaaaaaaaaaaaagaaagatcagtctagtaggagtacataaaatagaatggaaaggaaagacttagagccaggctattgtatcaattgtgggtgtgaaatagtagggaccttactagtatagtagccataggaacattaagaagatgatttgggaaacattaagaaaacacaaaattagtacctgaccaatgataagaaggaaagaacgagtaaaaaaatggcctcaaagttgtaaacctaagttgcttaaagaaaatcgaagggcattggaagagagatgataattttactgtcagacaacaggagtttgaaataacacaggaatacaccaaagataagtcgcaagacatggactggtaatgcagacttggatgtcttgtgtataatgacaatagctgaagctctacagatagaggaattctgtggtagccagccttcaagatcgctccccatgatccccacctactgttattgacaaccttgtgctgtctgtcccctcccacatcataccagggttggtatggtggaagtggtggtatgtcactcccaagcttaggttctaaaataactgaggcagctgtctgggttgctctctctctctgagagaagccagttgccatgtcataagcagcccttactacacagataactacgtggagaggaagtgaggcctccagccaacagccagcaaggaagtgaagcctgccaacaaccatgagagggaggctggaagcagacctgcagtgcactcaagcttccaggtaacagaggcctggtcaacacactgaccgctacctcatgagacacactgaccctgagccacccagtgaagccactccctgattggtgccctctcaaaaactgacatagtaaatgtttgtggttttaagttgctaagtttgggttaatttgttacacagaaataggtagctaatacagagttttcatagcaaagaacagagaacaaaagtgcttagaattaaccttaaggcatacagaaagggcaggaggaaaagtatcagtttgcatcctatcattaatagctaaaaggataaaaatgtttcctctgatcctctggaaaatgttaatttttttctacacctctcaaccacaaaggatacgacatataagcctgcacatatggcattattcaacctttcctttttctgactagaccccaggcatttaactcataagtacgtgggacagtaacatttggttggctccaccaacatgggcaaatgctttcttaacattataaagttgttcaaagtgtaaactgttcagaaatcagttccctaaaaaagtaacaaagctgtcttacagcttcacaggtatcatttttaatttattatatgtcattactagtgctgtgccttaataggaaaacccaaggtcaatcaaacacaaatatttgttgaacttccatataaaacataaatataaaccttgcctggtagccaagtaaaaagcaacaatacaatgtaagagttcaacacagggaagtaagaataaaaattaattataataataacaactaatatttattgagcacttactatgtgtgaaatgatagatgcattatatcaaaacacctctataaaccctaacagtctcattttatagatgagaacactgaggtttagaaatgtttaatagattgcccaatataccctgcttgcaagtagaagcactaggattaaagtctaggcaatctgaccctaagactttagtgtttttttttttgagacagggtctctctctgtcatctcccaggctggagtgcagtggcaccatcactgctcactgcaacctcaacctccttgggctcaaaaaatcctcccatctcagcctcccaagtagctgggactggaggcacgcaccaccacacctggctatttttttttcttatgttttgtagagacagggactcattatgttgcccaggttggtctcaaacacagctcaagcgatccacccgccttggcctccaagtgttgggattacaggtgtgagcaactgcacccagccagctccagttttttatctactactttatattagttccctcaaatgaacactgttgacaaacaaagaaaatgattcgtaggggttgagtgggctagaaacattacaggagtgatttaatgaagtcttaaatttgtatgtgttaagagaaaaaaaggcttctatattttacaactccagaaggcatcattctcatactcttacctgagtgacactaggaggaagatgacatgtggagcccatgaaacctgacagcttccaaaatactccgtttatggagctgcctgggcgtatggtactcatgtcagtgtaccacgtcctcctctctcaccttacactgggcacaatgacatgctacaaagccaacaaggagcacaggactcaggttgtccttttgtttaaaaatactgtactcctgctttaatcaacggttgttagaagaaacagtcatttttttatttctttttttttttaaccacaaagctttcttgcaaaatgaaacagtaatatgaagaccatctctacattttctgttgaattgtccattatgtaatgtctgtttcataagcacccacacaataatttagtgtcaggaaaaaaagtctctcctcttacaagctggtttgcttcctttcaacaaacaatgagattatataaccctttgtttcccacattttgtcttgccttccaggaagtacaaagataaatttcatgcttaattaaaataataatgtttgccaaagtttctggtttatttattttcacatcctattttaataagtttattgaacatgtcttttattgtaagtgctttcacatccttttctaaagtaggaaaaatataaattatgaatagaataaggatatccccccctgcttcccacataaaacctattctctgtcccagtgaatggctagaaatccaaaagtcaacccagggtcttccctttcctttagttaacaatctacttttacctattcaaccaccttaatgagtattttgtgcactcttcctgctctttacagccctattacactgacttggcctagctggttttaccacaaaagcttccctattaatctccctgccttcagtctcaaccttctctcaggctgtcctcattcgttcacttcctccacaccatcagaaagacttctatctaacataaaagatctgtgaaatgttcttgttttgaaaaaacaaaacaaaacaaaataacacaaaacaatatgtctttcatctggctcaaaatttctcaatgactcctagtatggaataatagttgaaatcatccacataacatacaggaccgtgtatgatcttgtccacccctctacatttacttggttttatcgcaatcactctcctcctgctgatgacctgctcctccctcagagttcctcatctcagtagatggcaccaccatttgcctagctgttcatatcccaaatcttggagttatccctggctcttctatcacatccaaaccatcagccaatcctatcagctccaccctggcaatatattgaaacaaagccacctttcaccacctcaaatgctatggtctagtctaagtcaccatcatctatcacctggaccactgtgacaacctcctaactggtttctctgaattcatcctcacaccccctaaaatgtattttctatacaggagccaccagttacccttttaaaaatacaaatgagaacatgtcactgcccagcacaaaatctcccactaatccctcattccacttagaacatagtccaaaattcccccaagtatccacatagctcaggccttcattccattgcagtctctgctgtaatgttccttccttagcaggtcttcctaattccctatcccaggagttctcaactgggggccatttttacccctcacgggacatttggcaatgtctagagctatttctggttgtcccatggaaggagaggggaccttccagcatctagtaggtagaagctagtgatgctgataaacatcctacaatgtacaggtcaacctcccacaacagagaagtatccaacccaagatgtcagtagcaccaaagttaaaaaaccctgccctctctaaaacagcaccttcattgttctcctaactcttaccttgcttttttttttttttacatggtaacgatcaccacctgacattacatatatattcatttatgatctgtctccctcagcagaatgcaaggcccaagatggcagattttggactgatttgtccatgcctatctccctatggcctaaaagaatgcctggtatatcaccagcattcagtgaatatttattgaaaaaattaatggataaatgatacttcaacaaagctgcagtcctcaaaacactctaggttctcaaaggcttctgtgctaccatctatagagaactgtgaaccatcatgaagtttgaagtcactatgatttgtttgctgtagaatactaatggatactaatgcttatttccatttcctatgtcatggaaagtagactaatatgttcttagagaatagaggccacagctcccacttctctatctctctcacatctcaatggctgatgaggatggccgatcactaactctgaccagtgaaggagtcctatgtttcagatttaggacttgatccaagccaagtgcagtattcgcggaagctaatccaggcctttaatgtctgaggcagacataatcaaagagctgtatatctttattccaaataaatcaataatttttcatcataaccaaagcaataaaagtggtatgaatagtcttcaaaatcaatatccacctacctgcttgtttagcttcaatacaagcaatatttatttcttctttcaaatcccagttttcattggctatagcttctcctactttaacaaatcttccaactgccaagttgacagcttgtcctacacgctgaattgcttgcagagttttatcagactttttggtattatctttatgattaataagcgtggtgatctaaaaataaaagataaaagcaacttttatctcaataccttttcttttttaagctgtatcacaaagtcaaagaaaatgaagcctggcatactgtatagctcaatagactaaatcaatagttagagatgcttcaacagagacaaccagcaaagtatcctgcatcattccttaagacaatgtttccattaattacaactccaagttcacctgagggcagttatctggggcatgcagtttatctggggcatacagttccagaggccctccagatctttcaacaaatcttaaggagaaaagtagaagcggatagatcattacattcagaaagccaaagtacttcaggtctagtttcctctactacgacttcagatgctatgagagtagaaacagctcttcttcctctccattccactccgttgcctaccatggagcacaggctgtacaaaatagtacttgtgccatacatgtttaccaaattaactagatactttagaatgagcattgtaatctatatttcacattttgctaagttttgttgcatccgactcaaaataaacgaaataccgagagttttaacacttgatcccaggccctgaaataaaatacaaaaggtgacaacttcagctcactgaaacaaacataattcttcaaaatatcttagggaactagtacatgaactatgctgacatctaagaatatttattaaagaaatgttgtatgaaaaacatagattcccaactattgctcaatgtacatgtactagtattaaaagaaggggaagagaattacaagaaggggaagagaatcacttctactctttgtacaactactatgtgccaagcactttatatgtatgtttaggtattaatattttagaattaatagacctaggtttaagtcttggctcggcgattacttgctaagtggtctagggaaatttaatatctaaatttcctcaactacaatattgcttttcatcaaattttgaatatctactatatgccagttcctaaggatgtatcagtgaatgagactaagacaatcccaccaccattaggtttacagtatggtagaatagcaataattcagttacacaaaatatatttgttgcacactatcatatcccaaataaaattctaggcaaacctgaaataacaatcaacaagaaagaaaagcccacgttcccatggggcttacattctagtgaaggagtgggggagaactaataatcacataaataggtaaacaaaaaataaactttaatataactgttatgtacaaaatgttaggatagtgtgatataaagtatctgtgtagctacctgaaattgactggtcttccttctaagacaaagcgatatttaagctgagatctaaatgatagcaaagcagtcagaccagcaaacatcaaaggataaagagcattctaggagaagaaacagtggaggaaaaaaaaaaaaaaagcccttaggaatgagcctctcctgttcaaggaatgaggtgaagtcggaagtggctaaaggatagtgggtcgggggcaagttaaaaccaatatccaagagatgggatgggcagggaccagcgtggaatatagggttctggaattggaatgaagaatttatattggctgggtgcggtggctcatgcctgtaatcccagcactttgggaggcagaggcaggcggatcacaaggtcaggagttcaagaccagcctggccaacatagtgaaaccccatctgtactaaaaatacaaaaaaaaaaaaaaaattagccgggtgtggtggcacatgcctgtaatcccagctacttgggaggctgaggcaggagaattgcttgaacccaggaggtgggtgttgcagtgagccgagattgcaccactgcactccagcccgggtgacagtatgagactccatctccaaaaaaaaaaaaaaaaaaaaagaacttatattttattctatgtattacaggaagatacttaagggtctttaaactagaaaatactataaactctgtagtaatttgaagccattgaagggttttttaaacaggaaagtgatataatctccgcagtggtttgaaatcactgaaggttttttaagcaggaaagtgatataatctctgtagtggttttaaaacatgtccacaaattctcccctcaagagggagagcctcatttctctccacatgagtgtggactggacttggtgactcacttctaataaatggaataaagtgaaaataatggagtgcttctaagagtaggtcatagaacacatagtgactttcatcttactcactcactcactctctgcaggatcaatcacagtgggagcaagccaactgccacataatggaaggcactcaagcaaccctatggagagtcccacaaggtaactgaaggttctggccaaaagatagtgaagaactgaggcttcatgtcaacagctgagtgagtgaacttgagagcagattctccagccccagtcaagcctttggattactgcaggcttggtcaatcatctttattttgattttatgagagacctcactcctgaaccaccaggtaagccactctagaattaacccacagaaaccataagataatgtttgttgttttaatgcactaaatttcagttaaattgttctgcatcaatagataactaatacagattttggtgcctggatctggggtgaggctgtaacaaaacttaaaatgtgagagtggctgtaaaatcgggcagtgaaaattgaaagaacttcgagcgaataaaaactagaaacgtcaaagaaactttgcaaaagcatgatgacctttgaggaagctgtcttagttagggctcctataacaaaataccttaaactgagtaatttataaataacagaaatgtcctgcttacagttctggaggctgggaagtccaggatcaaggcaccaacagatttggtgtctactaaggacccattcctcacaagtggtgtcttctgtgtcctcacaaggctccctgaagcctcttttataagaacactgatcccattcatgaaggctcccttgtgacctaatcacctcccaaaggccccaactcttaataccatcattatgaggattaagttccaacatataaattttgggggaatgccaacaatcaggccatagcagaagcgacgggtaaaagcttaaggaaaagtgagaaaaatcttaccggaaactggagaaaaggggttccttgttatgtggtgacagaaagtcaccctcattaacatgaaagggagaatatataccgatgaactgggagatctaactaaggagacgtcaaagcagattttgaaggtgctacctggtttctttttgctgcttacagtaaaatgtaagagaagagaaaaattaaaagaaacacggataaataaaaacaagccagaacttgctggttttaaaaattccttctccatgccgtgcatggtggcttacgcctataatcatcagcactttgggaggccgaggcaggcagatcacctgaggttgggagttcgagaccagcctgaccaacatggagaaaccccatctccactaaaaaaaaaaaaaagaaaaaagttagccaggtatggtggtgcatggctgtaatcccagcttctcgagaggctgaggcaagagaatcgcttgaatctgggaggtagagattgcagtaagccaagatcgtgccattgcactccagcctgggcaacaagagcaaaactccatctcaaaaaaaaaaatcttctccagatggcacatcatactaaaattaacaatggcttccaggcaaaaataaaatctagggctgtgtcaagaaagcatctaaagatgaagctaagggtacgactataaaatcttaagatctcagaaaggtccaaggtgttgcttcagacaaccattcaggtaaacaacagatctcccaagaagcctaaagatattattcctcagcagtcccaggagaagcccaagttaaagaagagcatatatcaaagagacttgtgggtgtgggcttttgtctagtagaatgaattcaatatgactcacaggagaccaacaaaatttttaagataatcgtattggcagaaacactatcagcttggactaaaagggaatacatctttgtatgaaaagaagctttcataccagcccctgctccaaacttccataagcagggaacaggctgagaaatctacgcagctgcaaacatgagctacaattcatgtaaaataatgacttagagggcagaatcaagagccatgaactattcccaggacttgagtcttaatcaaggaactggcaacatttgcccaggaggagttcagaataccataaaccagtggctcctattttttttccatttttgaacaggactgtatagcagttattctatactttctattttctcattttttgaacagaagagtctatagtagtcatcctaaagctgaaagacgttacacttaaggaactactacatacaagaagtctctcctggatcatatttgtaatagatgccaacatcatggatttccagctgatgttgtgactttggagaggatatggatgggaagaggttacttgcaggtgagaataaggtaaacaatttgtgtgcagaggttagactgtaggtagttctaaaatatgtccacaaattatttgctattcctcccttaaataggtgaagtctcattcccctctccttgagtacaggctgaacttagctacttatttctaactaatagaataaaacagtagtgacagtatgctacttttgagggcaagtcataaagtcactgtggttttcatctttctttctctcggttcaccctagggaaagacaattcccatgtcatgaagacacttcaccggccaagtgggaaggctcacatcatgagcctaaggaaactgatgctcaaaggtgcttatttaaggtcacacagctaataagtgctagagttaggattcagagtcagacatttcaattctagagaccgtactcctaaacattaccctataatgtcgtacaacaatccagtgaaataggttaatattaatcatcctcatttccccaaattggaaaatgggggtaataatcatccctattttacaaatgaggaagttggacatcaagaagtatgggagagttaggatttaaatccagatattctgactgcagagactagcctcttagccacttagccatattgccttctctgacttataatgttagtaagaagagttggctgggcgcagtggctcacacttgtaatcccagcactttgggaggccaaggtgggcggatcacgaggtcaggaatttgagaccagcttggccaacatggtgaaatcccatctctactagaagtacaaaaattagccgggcatggtggtgtgcacctataatcccagctactcaggaggctgaggcaggagaattgcttgaacctgggaggcagaggttgcagtgagctgaaatcatggcattgcactccagcccgggtgacagagcgagactctgtcttgaaaaaaataaataaataaataaataaataagaagagttaataaaataatgaaagcattatgtttaacatagtaccataaacagtttattgtaagtgttcaaagacatactataattagctatcttacttaatcctcaggtattattaaagattaaaaaactgaggctgagtaaaattgcatacttggctcatacaactaataagtagcctagtttagaatttgaacccaggtttaaactgacaccaaatcccacctaatagtccttcttttactggaggtttacaatctttcctattttttttaattgaaatgttacctaaaagctcattacataatcatgtgaaagagtcacgataattttaatttggagaatgactgtgggccatgctgctgggaagcacagaacaaatcctactggcaccagcttaatccttttccacacctgacagactctagggaattgttactatcacatgaaaaaaaaaagagaacttgctcagcattgactattccaagctaccatcttggaagagactgcagtggaaaggagtttaagttcttgctatagattgaatgtttgtgtcccattccccctcccactccccctccacaaatccttatgttaaaatcctaacccccaatgtgatggtattaggaggtggggcctttgggagacgattagttcatgggggaggagctctcatgaatgggattaatgccttttaaaagaggcctcagaaagctctctcactcatttccaccctgagagaacagtgagaagacagctgtccatgaaccagaatgtggaccctcactggatactgaatctgcctgaaccctgatcctagactacccagcctacataactgtgaggcataaatttctgttgtttaaggcacccagtctattttttatagcaatccgaacagattaaggtgattctgtttattaaatatttcatttacataaagttttaaaatttcaattacaaagaaaagatcctgcaattaagccaaaatatgaactattgttccgttccaaaagacacattttgctttcactagaagcgccttccccagtgcataattaggtgtggctgccttcctttcactggaaagcagtctaggaaatgttcaatccaaatatagtatgcctttaaaattttatttagaggaactaagtcaatatgtaacattctttatttaaggtctacttatattctaaaattagtttcaaatgttttaaaaggtaggttcaaaagttatacatgtttattgtttataaacagaaatggaaaatataggagagcctcaagaaataaaaattacccataatcctactaacctctgagaattctggcataattctttccagtcttgttttgtacatatagatacttaaatacacagttttacaaaattgagattaaacttcactttccttatcatataaaaaataagactagctaacatttgttaagcacaacagtaccaggcactagcctatgtgttttacatgtatcaattcttttaatgcttgcttctccagcatctaataggtacatactattattaccctaattttacagatacaaaatctgaaatttgaagaagttaagtatttgcccgaggtcacaaagccaggggagctacctacactcttaatcactacaccgtctctcttaccttccaggattatgttaaggatcaaggaaaagacaactagcaagagtgctttgtaaatcataatatgccaaatacaatcttaactatagttctgcaaaaataggaatgatattaaattgagagtcataacttggagttgccctgacaccagagtctagagaacacctaaatgaaccagagaagagggcagaaaaggcatcccttggggaagaaagaagatctggtgtactaaagaactctgctgtggaataaaagaataagaattagggtttacttgatagcttctaacaaagggtgtcaagaagtgcaaaacaccaaagaatatcccagcagttaagggcatggacatcattctgcctggttttgaattctggctctgccatgtgaccatgtggcaagctatctgacctttctgtgactctgtgttctcacctgtgaaaatggaaataataattgtacccatcagccaggcgtggcagatcacacctgtaatcccagcactttgggaggccaaggctggtggatcacctgaggtcaggagttcaagaccagcctggccaacatggtgaaactccatctctacaaaaaaacaaacaaacaaaaaattagccgggcttgatgtaaggtgcctgggtgcctgtaatcccaactacttgggaggcagaggtgggggaattgcttgaacccaggaggtggaggttgcagtgagccgagatcccgccattgcactccagcctgggtgacagagcgagactccatcacaaaaaagaaaaaaaagaaaaaaaaacacgcatgtattcacatacacaaatcagcaaagagcagagagggcgccttatctactctcttcatcgacaacataactgcaacaagaatcctgaaaagcttccagaacaatgcagagagtaatgggaaaatgaggtaggctaccttagaaatttaaggggtctgtacaaatagtgaataaaggaaatctatcatagacaggaaaagactagtgggcagtagaataatattccacaccagggtggagttctgtggcagatatccttcttcccttccttggataaaagcattataagacttggagtgggagttctgacaggaagaataaagtgattattaaaggaggtggggaggtactctacataaaatatgcttggttcttagcccagggcttttcaagaaaatgtctgaattataaaatataaaacatatgagtatatataacatatatgtgtggagtttaaagaaatgaaagaaagacctgtgcagccaccaccaagcttaagagaacaatgtcagtatctctgacagcccatgtactatctggctactccttgtccatatcactctcttgtcccaaaagaaaccattgtcccaattttgtgttcaccactcctttattataactattgtacatacagtataccctaaatgatatctggtttagttttatctggtattgaacctttattttttttcactcaacattatgtttttgagattcatccccattgataattatagctgtggtttattcatttcagtgacagagtatatcattatatgaacatagcacaatttatgtaaacatactactgttaaaagacatttgggaagtttccagttttgggccatcagaagtaaaaatgctatccacattccaatccatctttcttttttttttttttttttttttttgagacagagtctcactctgttaccaggctggagtgcagtggcacaatctcggctcactgcaacctctgactcccaggttcaagcaattcttctgccccagcctcccaagtagctggaattacaggcatgcaccaccacgccagctaacttttgtatttttagtagagacggggttggtcaggcaggtctcaaactcccgacctcaggtgatccacccacctcagcctcccaaagtgctgggattacaggcgtgagccaccacgcccagccccaatccacttttctaataggtgtgtaggagtttctctaggggtactgacttaggagtggaattgctgggccacaggtaatgcccaccttcaattataatagattacaacaaaccattttcaaaatggttgtaacacggatattgctaccatctccacgttcctcaccaacacttattctcactgtggattttttagcttgtagttcattgagttctaatgaagttgaatatcttttcctatatcttttagctgtttcctcttctgtgaaattattttttgaccaatttttaatggctaatctttttattttttattcattggagtattttatttattctaggtactacaaatcatttgttggttatttgtgttggaatcatattctcccacttaatgacttacgttttccttttgatgaacagaggttctttttttttttttttttttttttttttttgagacagggtctcattctgtcactctgtcacccaggctgagtgaagtgttgtgatcacagctcacagcaggcttaacctccccagctcaagcaatcctcccacctcagcctctagagtacctgggaccacaggtgcatgccatcacacccgactaattttttgtattttttgtagagacggggtttcaccatgttgcccaggctggtctcaaaatcctggactcaaatgatctacctacctcagcctcccaaagagctgggactacaggtgtgagccactgcgcctggcctaggttcttcattttaaagaagtcgaatttatccatttttttcttaaggtttatacttgtggtatactaacaaatcctttcccagcataaggtaatgaagatactgccctatttttttttttctaaaagtgttgtgagcttttactttcatattgtctttaatccatctgaagttgactttttactggtatgagacagagatccaatttcataatttctatttagatatccaattgtcccagcttaattttttttaagttcttcctttccccactgaccagcaatgccaattgtcatttaccgagtttccatatatgtgtggatctgttctagggttttctattctgtatcacaggtctatgtttttcaaccctgttctgatacccacattgtcttaattactatagttttataatgagtcttgaaatctggcagagcaagtccatccaccttgtttctcttctgcctaatcttggccctttgtgctttcatataaacttcagaattacttttatcaagttctactgaaaaatcttgctgaaattttcatggaaattgcattaaattgaccaatagggataactgatatgtctataatatgtcaacctaggcttgaacacagtacttttctcccatttatttagatccatgttggcttttgataaaatttttaaattttctccatgaagtttgaccacttttgctgtgtatacatagagatagagctctttctctttatatacatagcaaaagcaacatattcttaggaagctcatattttgctgttactgttaatataactggatttttttaataattactttttctatttttttttattattttttaaagacagggtccttgttggccaggctggagcacagtggcgtgatcacagctaactgcagccctcagctgctgggctcaagccatcctcccattttttagcctcctgaatagctgagactagagtagctgggattacaggcaccagccagtgcgcctgtgccttgtttgttatcaatgtagaaaaatgcaattgattttagtatcctacactcagtgaacttgccaacactcctaatttttataatttacttgtagactgttttgagttttctgcataggttattatatcacactgagacttttggtttttcctttcctatatttattccttttatttcttctccttgtcatattacactggctagaatttccagtgcagtgctgagtagaagcatagcaggcaccccactctggtttctggctttaaaggaaatgtttattttaaatttgactgttgctatgatgttaagtaaaagttttctgtagatactctatcaggttaaggacactttttcctaacactagttccctaagtgcttcttatcattattagaagctgaatttagttgaatgctttttctgcatcattgttaggaaaatacatcttttataatctgtgaatgcaaaaaaaactatacacatttttctaatattgataaaatcttgcattcttagaataaggccagtaacccaggacttttcacttggagagtcagaagaagctagatgataccagaatagaaactgtctactttaaaccgtatagtgccagtcctacttgtttacctcaaaaccctgcctcctccatgacatcactgctgactcatccatgccttctctgagcttttagagtatgtaccattgatgatgttcatttgacactttgcatgtgctgttctatacatgacctatctaccaactagaatataagcccctcaaaaaacagcaacaaataagcacacaataaatccttgcttaaaatgcttaaaatatccttgtggatgagatggtgaaacatgagttgggtaataatacagcattctcagaaaatgagacttgtggacatatgagttttctggagaactgctgttttaatctcctaacactgaaactttaaaatcattctaaattgtacttccctgctttgttaaccgagtattctggccatgcttaatacacttcttgattttaactttttcttgttaaggacagtcaattatgaggaatatcagttatggtgttgtggtagagatgtagctgtagatacacaatgtgtgggatgcaaaacctcagctgtgaccctgaacaaggctttaactggaaaaagaaaaaaaaaaaaaggcaggcattcttcccctttggcattgacctctaactctcagcagtgatttatacttttcttcctctgctctcctacccttctctggcttcttttaccccagagttacacaatgcagagctgtaagactgatacatttttagcagtggatactgtgaaaagttgccatttctccagattatgactttctagcttgtttttccactatgtaccatctttttctctagatctcattactgcttctaatctctagagaggacacagcatagtgtagcaaagagaaccttctggagccagggtacctggattcaaatcccagtttggcacttattgaaagccctaacaacaaattatttaacctcagtattcctcagtttcctctcccataccacgagaatatataccaacttcacatgattgttatgagaattaatgagttaatatttacaaagtgcttagaacctggcctaccacatagtaagcattacataggtgttatttaaaaaatggataaaatactatcaacttgaactccatcactctcttatctctctgcctcttaaaactgctccagtgtttctcgttttggttgtgttgtgctagtggagataggcgaggagcggagggtctgacattactgagggatcccagtgccccttcccactggtcagagcctcaatgagacacaggaaaagggaaggagagtgtcagatatattcatcactgctccgttagccatgcgaaggtgaagaaaatagggatgtttatttaaccagcataacaggaatccagggacatgtgtaactgctgttttcaaatatgcgcagggctgggcaggagaagagataatagcatttagaattctatgcaacagctacaggctccccttcactgaacatgtttaagcagggtactggtggccaggtgtcaaggatgctaaagaaagaatttttagtcagataatctttaagatttcttctacctctaaaatcttggtaatcctagtatgagtcacgaagtggttacaacctagatgtgagtcacacatcgccaacgcgctcccgaaggcacagaattcactccccacagtgcttggcatcttaccacagacctaagtgaggaattctagccctgaagctgcatataacccagctcagagaaacaaaaactttcctaaaactcagggcgtcggttagctgattggcaaatacagtaacgcacacatcccaaacgggacttggcaaaacggtgtgcatctggattaactgtcatacagtctccacgtcactcttccacgaggccggacagaagcgggcagaagtgagcagcagcaggttcaggggaaggggtagggtggccgggatgaatgggaggccagcgaactgacctacggcggggagggacaaaggatcagggagcgcacgctgggcggggaggccgggaggaataccccaggcggaggagccgggctcgggaccaggctgcgaactggtgacaaagtcggttatcgtggagggccctaagtaccagcgaggggccccgcgggggtcctctctgcctcgggagctgggctcaaccactcgccccgcggagggggcatcgcccggccgggggcacccgggagccgcagacccgaggcaggtactgggggcaaaggcccaggccggcacccccgccccgcagcctcccctgctgccgagtccactcaaccctgccgccggagtttggattatccagtctctcgccgcccgggccgaggcccgtcccggagccccacacaggcggtccgacaagaacgccgcagtgccggcgcggaaagtggggcagcggctgcctcccgtccggtcgtgcgagcggcggccgccatcgcgggccgcggcgggaaggagaagaggggccgcgccaggcgccactttacctgagaaaccagcgggagtagcgtctgctccaccgagcgagttttgatctccagtcccgagtcgagggcgaagcccgaagagccggagccgtagactgctccggcgccgccaacgccggcgggtccgggagaggcggccatggccctcggtctatcccgcagccgggactccgcgccgcggcgagcctgccgccagtcagcccacccgcccgaggcggcggcgacaggacactcgcgccaaccgagaccccgcccccaggggcccgcccccccagggctccgccgccaaccctgcgtccccgacgcccgtcaccgtatgtccccgcccacccccggcctctgccccgcccgcgcagtccagcctggtgtgggctccctgcaaccccaccccctaagccgggtcccgcccccacatggccccgcccttatctcttctcagaccccttccatgggttccaggcaccttctcgccagggtggcgaggagaaacaaaacacatctgtcacacagccacatggcctcctcttacttggacagacaagcgtccccagcaaagcttcccgtcctctcgataggtgactcgtcctaaatcagctctgaattcccgcaaagacttctggaagctgtgctggggttgaaactggtagaccaaaaccagaatcaagtctgttgggaggggcctttcccctgggacgggaattccagtggtaatgtcttcctggggcttctccggaaggtccaatttccactccaccctgctcattctttcaccatgtatttctcacaaacactttgagctggattgaaggggaaacatttgataatgcaatcattaatggagtatctgggtattcggcaggaagtcagtatatctttcacactactgtttagacttattcaaaagaaatttaaaagaaacatgaaaaagcctcatctactgttcaacactacttcttaaaactatttttcgaagttttttcctagtgccaggcacagagcagtttcttcataactgttcattgcatgaaaacaccaagtgtgtatttctgacaactcacttgaggggaagggtaagaatcagttctgtaagcacaactctgagctcgcacagagccccacgatgggggcggggagctgaagactcctattctaaggtctccaggagcaaggccaaaaggaggttgtcagcagtatgcacgccgtgaaggaattccagacttaagcaacagactgagaagcatgaaaaaatgttttgtcaactaccatatctgccagtgagaacctgtcagagtaaaaaagaatctgaggctggccagtccacccggacaccttggcctggatcatttcttcttccataacaccagattgatgagctgggtacatcaacctgaggcataagaaagctctttcccaagcaccgttgaaaggcgcttcacagtgcttcaacctgtagcttcagcttcatcaatctaccagtgctgcacagctgtctttggtattgaagatagccaagcttcagcttctttttcttcattcaaaaaggacaggtcctcaatccaactttttcttccaattcttctcagccaaccatctcaccacttccttacctatcacaaggccaccttcccctgtgcactgagggcccttgacctctttaaggcgcccagtgtccacttcctggacacaccttcccttacgaagttgacagtatctcctaagaattcagtgtacacaatggtgccggaggaaatggcataacagaaggcctaagagacggatggattcatgaaactttggcttcacaaaagatcaagtttttcaacacacaggagattaagtttaccacatgattcattcaacactagtaattttatttcaaaatataaatatttcacattaataaagaagttacatcagtaggttgtcaaagcaagttagctaagaaacagcatttgtgtgagaacagagggtatttattgtattcgaatattcttttttacttttgaattgcctccttcacctgagaacccagggatgatacattttcaaagagttatgtaagcaattacaactctatatcaaatcttagttcaaaatcaaattgtactggaaatacacttcagttacctaaataagtggcactgcaaagggcaaagaagggttttctttgggatggctacaatgagagttacatctgctgggtctctgcaataaaaaataaatgatatttgataataagccaaaattatcaggatttgcttccatacttttcactgtaaaataaaaagctagcaaaaagctagtaagaaaccagatgtctagtaaagaactctggacttggagtcagaagttctgcaactaaattctggctccatcattttgtggtataaacttaggggaatatcaccaaaaacttttcagagcctccagagcccccccatctgtacaataaggataatattgtctgtctcacagggctgttacaaaaggtgtctgaaaactataaagtgccatacaaaagcattattaaaatgtaatatcaatatatcaccactgtatttgcacattagttgatccttgaaaaacctgcaaaattaaacacaatactgattttacacaccacaggtggaaaagaatctctataccttaagtatagctctaaacagcaaatatacttgctttctggacttcaagatttattacacactacatggtaccacagtaatagatctgccattcagtatttccattagggatgtcttctcaaagagttgtaaacttgatcaagggccatgtttctcaaaggaccctgtagtcctttgagatgctctgaggaataaagaaggggagtgcagtctaaggtcaaacagtgtttgtccccttttataaattcacaatgtgtaatagcatgttcaaaactcttagaagtcctacagtaaggaaacaaactcagcattccttcattttaattgaccatgcaatcccccacccccaacacacacacactttttttcttacatctattaacatctcttggaactactgctatatggaacacattttgccaaaagctgctcaaccatgaagaaaaggaaagagaagtagaacaacggactgacagaaaaaaaagaactctattctattctgaattctgttactaactggctgtatgtgtatgtcagacaagccacttaaacctatgaatttgggtctttctctagaaagtgacaggaccacctaattttagaagtcccattctagcacagaatttctgactctagtagacagaacaacttgatttataattctcttaaactatcaaaaataaccaaacagtggctgcagacagcatgtgtgtttttttttttttttttttttgcaggttcccaataatcggtaagttaataaaatgaatatattttgatggcagaatgttgaaagacaagaaactaataaaaagtacttgtttttagctggaactagcatttggaagtaatgctagccagaggctatttccactgtgaaatgcacactcaaagtcctattgtaatattattttaagggtcttaggaggcccctcagaggagactgcaaggtcagggctagagtatgagaagtcctaagggtttttgtattttgtttttttttcctataaaccctgaggttgaaagctctggatagctcacctaaattactttcctctaatctaacccctcacagcctgaatttctgagtattgcttgaccagtagtgacacattcctgaggcactaatataacccaaatggaaactacaggtcctaggaaatccagataggtcacaatgggttcatgtgaagatcaaggtgagccagaagatctcatctgcaagccatttagcagccctttaactgtaaaaagcagttccactttcaaaggctacagagtttgtttacatacaaggtctccatgtaacatgttggatttcttcccactgtcatgggccaacccacactagactcagaagtcaagggaaagctctgccagctaaacacttcttatcaaagagggtgtgaagaaaccttgcaattttaacaataactaagaccagcatgtaaggtggtcttacagagatcacttgcaggaacagatattgataggaacttcagaactcaaacagcactcacataacatggaatttatgctgaaaatcccatgccttctctctcagaaaagagaggagcatacctgtgtggagagcttgtattttctcccctcccatccattcggtttacaactgaatagcgaatgtgaacttgaaactaatctttaataaatctataaaatgcaagatattatgaccaagttctgtactccgtttttactgaaatgacttctacttcatcaacgtacggtctgttcctgaagaaacttcctctttctgggtcaaattctgactgagaatgtaaaggtaggttatctttgagacttgagcttaaaactcctaccttttcataccacttgatctctgttgccctgtgaaaattctgtaaaccttcctcattgcatctgaggaatcatgctggaatgcttctttctggctcggagggttccaagacctccccagctagtggaccttcctagtccttatgccgttgctgtagcaatggggcaggtcaagtttcctgatcatagctgtgaagcactctggggcacctctgctcctggtatttcagggtgatattacatcactgctgctaattttggtagctctaaagtattctcttaaagacctctaagaacctgatatttatgctaataattacccagcaagaaacattagctgtagttttttgcaatatcactttatacagctaaaatcactttgtatatgtatagtaactcattgtatatatttgtctcttatgaatatgtgctaattacatctataaatcaaccagtatataattaacaaaaacaaatgattttttagccttttaatgcaaaaaatttaaatttagtattacatatgatctggctaagagcaagaggccttcttatgagtgatctccatcaccctgtacagtgcctggcacagaatctagagtttagccaactctcaacaaatgttttagtgaatgaatgaatgattgactaaagaaaaacatgagttacttagtgaccaaatctaatactcagtggaatagctgattataatcgctaaaatattcataatagaaataaagagatctgtatgcagtctactccatatagtcaaaagatctcatggtagccttttctaaatgaaatttttcttaagtagtgtaagaataaatttaaactaattataattatcagtgacttcttagggagatgttttaggaaaaattattaatatttctacctttaaatactttccaaaaaggaaatcttcaacgcttaagaactaccccccaacacttttttttttccttgggacagtgtctcactctctcacccaggctggagtgcagtggcgccatcttggctcactgcagcctcgacctcctggactcaggtgatcctcatacatcagcctcctgagtagctcagactatagccacaccaccgtgcccagctaatttttttttttttttttttttttttgtagagatggggttttgccatgttgcctaggctgatctcaaatccctgggctcaagcaatccacccacctcagccttccaaagtgctgggattacagatgtgagccaccacctacagcctggccaagaacccttttctctcccacattcccctgggagcagaggataggcctgatgattgttttaaacagtagaaagggttcagctaagaactacagtccactctcagccctgtcatgtactataggacaagtcttcattcacaacaaatggatagcaacaccaatctcgtaacactgggaaaactgcatacaatatttagaaggaacactaatacagcagaatctgcacacaacggagtcaaagatctgaggccaaatcctactacactttacgactttgagttggtcacttttctgaaccttagcttctccatcagtgtaaaactgatgtaaaataatataaagctatatgaaagctgatgtgatgtacttgtgaaatagtatgtgcaaaaggactttgtaaaatgtaaagcactatgctggttattgtgatatctgagatatttttaaagttgcaattcaattcaacaagcattcatttagagtcatgtgcaaggcactgtgctaagagatgggaaaatactacataaatacaaaattctgctgaaaactaacttattggcagagttccaaataatgaaacggatacatttaacaaatcagagtattgctacacctgagatttttcacttcaaccacctggaaggagaaaacctaataacagcatgaattttatcatactgttaccattcatagcagcttaataagtatttcacttcaacgtggtcagccaagttttataatttggcaatagtgtaaagaagcgtgaagagaaaaggaagaggaggaagagcttcagtctttgtatctcccagggttataatataaaactgaacatcaaataagccaccccacccttatacttatgatttattatttcttaaagagcgtataatacattgtgggagaagggtagaagattcatttttcctgctcactcaactacacactcaaaagtgaaagccctcttccttgaaaagtgactgtcttagaaaagtttaacaatacatttcttaaaccaggaaaaaattacaccatctattcttttaacagcaggtagtttagagttcttaaaataactttataaatatataatatagtaacatagataaccaaagtggaaaaatttcaagccagggtaccagtgtataaaatgaaacttttcaagccatcttaacaacagttaagtgagcaaaccaccaactctgaactctcaagctgtgttttaaaatacaaagcagcccgcagcaagttctctcttgtccaggcattctgtatgtaaggccaggaggcttctgcttctttcctgggttttgcttgctaggcacagctggaagggcagagggccacagctgagctgaactcgctgtcaaatttgaacttcctagaaaaatcactgcagaggaaaccacatcaacctactgaagatttcagatcttcagaaatgtcacggaaagtcctaaaagaaaaaaagacggaatgattagttgattaccataaaacagtatcctatttttacaatcttttggagccctaatgagattatatagtcactattttttcttaagattttcattgagtattgtttcaaagtctgctagttgttgctcattctcattaacaagaactccatctttttgctggatctatccaaaggactgtttccccagactcccctgaaactacacatgaccacgtgactacgctttggttaatgagatttaagtagaagtgttgtgcaacttctgggcagttccttaaaagagaagagcaatcttcttcagctcttccaccttgttactggctggaagtggatatgatgattgatgttaaagaggaaaaaccactaagagaccaaagattaaatgctaagtggatacattttattacaaaatagaaatcgtaatccaacagagagtccaagctctaagggatgtggttcagtgcaggaaaaatgggttaggtcttttcatcaagtgaccttgtacttgaactgtttctgacccacattaaacaagctaagcgaacaatgttattggcgggtaatatctgggctggatgaaggtggctgagcaccgtgcctgactgctgcatacatgaagtgtctatctcagtactgtagtagctagcttgcttttgctacataatttacatgtctgagctgagataaatcacctggctaaatttacatctgtgctggcagccaaatggccaggtcagaatttatcaatgaacatgagctcaagcacccatattagacaaaaatgcctcacaccaaggctggcagtacatcaggatggagagaggctgggaccagatgtttatgcaacagtgatacagatataaagcacagtctattaccattcttttagatagaagttatattgctcctttacaataagtccacatattagaaatacagaaaaatatttgactttacagttggttttttgtttgtttgtttgttttgttttgttttgttttttgagacaaggtctcactctgttgcccaggctggagtatactggtgctatctcagctcactgcaacctctgcctcccaggctcaagccatcctcccacctcagcctcctgagtagctgggactacagggaacatgacaccacatccggctaatttttatacttttgggaggctaaggtgggaggatcacctgagcccaagaggttgaggctgcagtgagcctaggtcatgccactccaggccagcctgggcaacaaaatgagaccctgcaccaccaccaccacccccccaaaaaaagcaaggaagggagggaggaagggaaggaggaataaattgaagtacaatataaagtaagtgttccaaaacctaaggaacagctcacagtagtagaaactaaagataacaaaaagcttttattaggtacaatcacctaaaaactcataaaataaacaatctgaacttcaaatgtaattccacaatcatgccccctcccttactccttttctctcctctcaattcatataaatatttaggaggcccataggcaaggcagagatcaattaaagactaaccttgcagcactcaatgaggaaagtacttcagtgtcaagaggggaacaggtaaaatgtcacagaaaagaaattacctttaaggatgttcagttatctcaaggctctttcaaggatggtgccctaagcctctggatctctgaagcacgcctctactagcacagctctactttgaaaaactgttagtctcctggctatggctcctgaggctttgagagggtttatgtgtgacatgaatacaccaaccatttttaaagatgctggctgatctaataattgaaatgaattttctttccttaaagacttttatgttctgaaaacaagtccaaaggtgaagatttgtatacgcacatgtatgtttatatgcattatctatctatctatctatctatctatctatctatctatctcaaatcagtgtttctcaatcttgaaatttttctgcattataagatgttttgcagcatccccggcctctattcaactagaatgccaatcaaaatgactccagacatgagaaattgtctggggagaaaaaaatcacccccacactcctgtcagaactaaagctctagatagctatttttcacagtctcacccaagtttgtgtttttacatttgtctacaggccaagctggctgctgtctcagacaatatgaatttcaggtagcacttaattctgaaaagccctggaaaatctttgcaagcaatagtcaaaaactggctaatactacaaagcattttctaatacccaacggggttccctgacatcttttcaaatttctcagatacctgtaattttatatctattaactattcatttcctctaaattatgaatgaagatttcagcctcagggcaaagacacattaaataagattaaggctatggttagcctagtcactgctctctgttgacaagtgagcttagctgtaaccttgaaattcctaactactattcaattttgtctccaggccaagaaagtctccaaaaggactcaggaaaacaaacaaacaaaacaaagaaaaccaacaacctgaagcaagcttagagatcagttactaagagtctttcatctcaatgttctctctaggtatgtagggtgttagggtgattgatggagggggaggtgtgtgtatctacagaactctactgaagtaacactgatcttgaacaaacctctaattatctccaggaaaacaatatctatagtctagagatgcagaaattatttggtttttggcttattccagaggcatagctctaactaataagtaaagctcataaaactataactctctacgttagaaacaaatactgtattgacactattttctgaaaatgtttaacatcctacttaaaccatctaaatacagtattctttctc

SEQ ID NO: 338 - DNA, 62265 bp, Homo sapiens
ctcctatcctttaaaagtcacattctgatttctgtagacatattgatcaaactcagcagcagtagcatgcatttccccaggctgtggaagcttgctgtgtgactgacttctctgggccttgtttgtgcagttgtgtccgtgatggcagcagatactcttgggaaacgttggggaaaaaaggaatagcaaaaacaatagaaggtttccttaggctggggtcttgatgcagctcttaatccttacatttttggtagcttcttaaattaatattgaaaacaacagtaatgtattaaacccaggtactgtgctaaatgcttctatatgcatttttggttgaggttgtcagaatctttactgaacaagtggagaaaaagtctcagattaaccaattttcctagggtcacatagctagtaagtgcatagtcaggacttgtaccctgatggtgtgtctgactccagagcaactctcctgccctcaaagctctagttctccatacacaaaagtctagtgtttgcatgtttaagttcatacatcaggtggagacagattctgtgtttgtctttgctcatttctacctgctttgcctcagagagctcctcaacgctgacccagttccatgaatattcattacaaggtggcagggaactaacaagtattgaaggctcctaaattccaagcaccacaccaggttttttacaacaaacattgttaaataagttaatgttttgtaacttttttaaacagcctctggcacctagcaggtgctacaaaagtatggaatgaacaaagactaagactctttaacagcaacttataagggatctaatgacagattgctattattgatatcctggttctgtcacttaacagttgtgtgacttcagcaagtcatataatgtctatgagcttttttattttttaaatgaggataacacttgtacctacatcagtgagcagttttgaggattaaatgagacaagtgcttagaacaactcttggcatgtagtaagtgctcagtgtatgtttgctattgtcgatagtcttcaccaaatccctgtgagatagtaatttaaatatttcatagttttatagatatgcctcatatctcttaattggtaaaggtaggatttgaatctagacctctgagactcatcagtgctttttccattaaaccatcttcagcaggcagctttccataaaccttcctgcccttgccccatggcacacacacatacttggaaaaatatctcctctaactaggcatttataaccattcattcaaccttatggataaaaacatacctttgtttcttatttattgcagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagctttatggaaacttggtatagcagctaaaagagtttagtttgtttatatggcatgtataagttttcaataaatgcctaaagttcaagcatagtatggggatgtccacagattgtttctttgtgtcattgagtttatgtgcataggtgcggtacaaggtgctcattccatgtagcacccctattacgtggtatatactgctaaggaaaccaagaggagtgattactcagaaaaccagccgattatgcaatttgtcaaagttgtaatgtctgtgaagcaaatttctttaaactgttttcttattgacaactcttaaaaaattgaaggacaatgatagctgaactgagaaatctggcaagtccaccaggcagtggagtggaagattcttttagtttttttaaccagccctggaaaccccttccattccacgtttaggaatcctccttcccttcagaacatgactgcagtgccacccttcaccagtaggtgcctccatcacaccatctctccctctaggaactggaaacttgaaattcagtaaaagccgttttaatcaactctcaaactgataacaatctgtgttggaaaggacatggggcataggcacccaattccaaaactactagaaatattaactgccctccagaaaagatgaatctggcatacagtatgtatcatacccaaaaacctcgtaaattgctctgtacactgagaccctgcaattctacagcattatcctaggatactaggatagctacacaaaaacatgtaatgaaggagctatcagagggttattacaatggagttctaggtagccagttctaatgtgtgtgtgagagagagtaaataaaatcttcggtgaaagagatcttcaagaagaggcagtagacctctggatccagaatgcttgactttgaatcccagctttttaaattattgtgtgaacttgaataaattgcttaacatttctgtgcttgggataataatggtatgtatccgagaggattacagattagtgagattatacattcacagtactgtatattatttgttgtatgaagtctggagggatacagaatagcatgtagtttgagtacacttttgtaggagaaaatatacaaagctatacataggcttctaacaaaacctgcaaggctatatgccaaaacgttaatagtatttatctatggctagtgccattgacaaatcaggttttaacaaatgcttttctgttgtagactcgattttttttaacattcaacatatattgcttttataattggaaaataattcttaccacctgctgtcaggagaagaaaagaagagaaagataattctacttaaaattaactcttagggttgggcagttggagcagtgtttaatcttataaatgtagcttcataagatctggtcctatatgaaagtttaaatgtagcttctgtaagatctggccctatgtggaaccagaactgaagagcttgacttgggatcagacaccgcaacttgattcaagtcccttcatcaggaggaaagttccctaggtgaattgccaacttccgctgcaaggccctgagaacaacttgaaactgacagtgttgttgggttccttcctgcccagctgagctccaaagctgtgagagcttagctgctgtttacctcttgaggctcaagtcctgagagataaattaagtgtctgcctcggatatgaagaggcctgggttggagcttcacctcccacacacacctgagtattttggggcaagtcacttaacctcatttgaggctatttccacagctgtataaaataaggaaataactattttgattattgagacatttgtggaaaataacacagtaatgcactatgtgtgaattaatttccctctctgggcctgtttcctcacctttaaaataggggaaattagtacttcataaggttatgaggattaaactaggaaaagtcaagattgagtgctgaataaatgacatactattttactagggatcatctccctgtaccaagagcactccacttgctctcaagaatagccaaggccatctttttcttaggaaaaagggtaggggtggaggtttccccagggatccaactccagaactctgcagagatgggcctgcactacaaggcctctgagacttcagtctgcacactctgttctttagcctgatgctccaccttttggaagccaaagctgccaacttggcctcttgcaaaacacacattccattcataagtgcgtttgtgcatttttcctcccacacccttctaggcagccagcgcagagctgccaaggcagctgctggagaagcagcttcttatgggggaaaagcaactccaagggcttttacagaactcatggtttaggctttgaacacattactcccattttctggtctccttgaccatagggggggttgttcatttctttttgcccccctttttgtaaataacctcttccctattaaaaggaaacctattaatgaaaatttgaaaaatacagaaaaatttaaatcacaactgatcccaccatcaacagtcaatgactgccaatattttataatcgatcaactttttccatgatgatagaaattctattattcaaaagcagagttttaatagctgtgtaatattctagcattgatgtatgccataatttctaaaacagtcccttttgttgaccttggaagttgttcccaaatgatgctgccagtgatatccttgcacatacatccttgggagatatttcttttaggaaaagtgcctaagtgaaattattgggttaaagagtacgaacacatgcttttaactccagaaaggattttactgtttactagcatagatttctttcaaatttttgccatttaaaatttttcattgtatatttaatgtctgcttatttgaataccctttagattggcatcctgctttttttcccagaagctttttggtaaattatttttcctaagtgagttgttcatatcctttgccatttttctattgggaagccagatccttttccatactgaatttttaagagcgccttatggattcactatatatagtgtccatttacaaactattacaaaattttagtttgctttttaaggtatatcattttatgtttagtcttttgtgatttcctctatttgcttttatgcttagaaagccctgactgatctctggatccaatgacaagtttatatatttctaatgatttaatgtctatacttcatagccttatttttcttggaatttatcttggcatgtaataactttctcccaaatatttagataattttacccaattatctagctttacttacccaataaaggaggatgctcctttatcatttaagtccatgtgtatactagggccagtattcatgttttcttctgtcttgtcatgtagtagtaccacactattgtgtagctctatgatgtactagcagttttagcagcatcaccccagataaacacagggcccatggagagtctccatcagcatggattacagaacactgtagagttaagatgcttcgctgctgactgcactggtgctgctacattccaccaggactttttcagcacccctgagtcaagagacgggacaagggtcagaacactgaacagaagaatgttaaactcaggtaggagccttatgtttttaagacagggcatcctcacaagtcaacgtaaaggaaaggaaatggagaggttaggcaagctccctaatcttatcaggcagactaaccctttttgacctacgtcaaaactcagagctagaaggatgacttccagagccaatccagccatgtgcttcagcaactgatttgaaaggagggaagaagccagtgttgcaactcttccgtactcctcagatcctcagcactaccttcagtgcacctttcttgctagaaagcattccacgtgcagttaagctcatctggtaactaagtgaagttgtttgtccatcatctaattgaaaattagattttagctgtatataatctatacagcctgtgacagcactttgaatagcccaggctctatacaagcccccaaatcagtatccttccactttattccccaaacctatttgtaaggctctggctgggctccataactcagaagtgccaaagcacagaagaaacaagcccaaaagagccaactggggaatgttttagaggcatactttttaagtgaggaaaacatcatcccttaagatttccttcctgcccccacctggtcctgtccttagtaatgaggaagagaaaaagagttgcagttcattgaggaaatctcagaaacctctccctaatcagagaatgtagacatgacttccagagcctttgcaacagaaaagaaaaagtacacctactcccaccaccatacttacttatttttacaagataccaacatgaggctgggaatctttggggaggccatcagggtctccatgaaagaaatgtgtaagatggccagtcaagagctttcctgaatgtaaacaataactagacagaaaatacaatggaaggaagctaagggtcgtaagtggtctaatcatcatacatctagagtgttaagaggcagatgggaatcccagggatcacgttagtctgagcttcttcccccatccccaatttggcacagagggaaattaagcccctaagaggggctgtgacttgtgaaaggtcatgtatgaccatgccaaccccctctcttattctctggtttccctgcattactcacctagcattcctttggagaaccttaaaagagcttgtaatgtttgagcacttatgtgtcattgggactttatcaagacttttaaatcctagcactctgatggaaccaagagtcttttaattttgcagatgagtaaaaggaaacttagaggttcactaacttgccgaaggtcacatagcagtggcatttgacagttaaagccagatacagcttgtttcctttgccttaatgcactgccatactgttaaatctaggggtcatgcatttaacatactgctcaacttcactttttattcctcatgagaattcacatcagttgcaaaggtaagactatttaggcagtggccctgtgaagacttatttgctctttgcctctaagcactgagacccccaaaagccaccctactaagcttggtatgtgggaggtcaacacccatgtttggagtctgaggatcctgtacttatctggattgtttttcaaagaataaaaattgttactcaatatcatgttggtagaagctcccagtgggtaaattttgccccagaataaagtcactgtttttttttttttgtagaaatatcaatattcaagtaaacaaatttattaaatccaacagcaggtaaccttccaaataaaaaacattaaaggaaaaaatgtagacatcaaagacaaaaatgtgtgtaacaagtcaataaaaatactcaaggggccatttggagagtgcaacagtgcagaaaatacaaacaaaagtattaacttttgtcaagtttgtacaacctcaacaaacagacacactggtcacaaaccaagagggatccacaaaggtggagggtcacatgagcagtggactcatcacctcagcggcttaaggcagggtatatctgtgggaccaattcatccaagccccatgtgcctattgcttcacattccccctttaaaacctagtcatattcattagtgcaacaggtaagagcaattaagcacagacggagctggggaccagggtcagagggaagacacttctcccagagcaaatgtatgcatgtcagggggatgaaaaaccccagcagctgctgaatggcttcctttggcaatatccaagatttgtgttgaaaggagcagggaggttggatgggtggcggaagtaggtatttatgagataggctgggtttccaagaagagaagaatagggaggacatgatgcccagcacctgaatcagaagcagaacccaatggttatgcaaagctatttgaactattttggcttctgcaaccagtgctcaagaatctatttcatctttcgaaaagggggaaaacccctgccgatcctcaccaacatgcagtcccagtccagtttaaactggatatgcaattacagcttaccaggggaataaactctgagggggatggatggttcggaaccttctttatatgatcagaaaacacactgtggaataagaggaggatcaatgtcgcatttcctcaatgagtcccaattaacacaattcaacaaccttaatagtcctttcagtcgtttaaacaagatactgctggagtcctccaagaagacctgtcatttaccaagatgttcaagtcccccaaggaagacctttgtcagttaccaagatgctcaagtcatagctaaccaaacatgagagacaagaaaaacagcagagcagtcaagtaaaatgcaacaaaaacctagcagcagctttcttctacgccttaaccttataattgcataactgagtctacaccttttgggctttgctgcactgaagacctcatttggaatctggcaaaccaaacattcttaaatacataggttggtgtaaaagtaattgtggtttttgccatacttaatggcaatacattaagtatggcaaaaacttacttttgcaccaacctaacagatctgttttggtttgtaaacttttagacaagttcttatcccagtaactccccaccactgtttaatacaatttggcacagtatatagtacatgaggccatcgagtgtaactactatgggactccattttggcaccagcccctagagaccagtactgcttcaaagactaatactgtgtggcttaatcctttctccctttccaaaaagactagtttgtgctttccttggggaagtttaatattgaaaacactgccttgtacattttcaattgttattttcctgggcccaggggtttggttaaaatttagatcttcacccagctctagattcatcttcccttatcagaagggcagacatggtttcctggacccaactcacacaggtgggcagcacttcagctgctgagacaaccagctgaagcatagcaaagccccttacaggaggtggggttaagaacgatacattgagatttggcaaagatgggggaaagagcaattcaatgaagcagcacgtcatctcataccatctttccaataaactgctaaagaaacatcacaaaagctgacaaagccagttgtcaaaactgagttatttcttatttcccaacacacttgtttgttgttgccctcagatgttgccgatttccaaagtggcgtccacatcctgcccctctccacatcaccctgatgttctgttgctaagcaaggagtgtactggcttatctgaggggcatgcattcagcctcttacacagacttactgctcactcattaagtggcaaacctatttctaggttgaaaggaacaagacttttcacttcccagaagtataacttcaaaccctacacacacctcaccttggatccctttgcagaaaaactgcatttcttgtggtcatgaaagagtcaagcattggcccagagctactgcagaagcttgaaatctttgctgagcatcaagtactcaaacttgaaaggaacttgtaagtccctccctgactgctcccttttctggcttctcatttgcaaatggatcaatataaccaaaaaataactaaatggcttttttggtgggggatgaggaggctaaatagttaatttaaaaaacaacaaaatacatccactctagtacatctaatgcacggaatgtcttcttaaagggtggggaaggaacctagtttctccagagtactcagggtcctgggctgcctgcctcttttgtgcagctttctctgatacactctgatctgggatggaaagggccttatctggccaagagcagcctggcttttccctcagtcaaccactacccaatccagaaccggggaaaatgagttgcaaactggcttaatgaaaaagcagtctttttaaaacctcagtctgggtacccagctacaactgatcccacagaacctgctgggacccctggagacttattcaagagtcttatttagctagaacagaagccaggcatctggcccaagacccccttcagctttctagcagtactataccgtgggtgatcttaaagtttcccatttgcccctctgaaggaggaactgtcaggtttaggatttaaaaaaaaaaacaaattccaagtatgttccctatggtcaatatcagttttagaaaaataccaactgccaaaactctttaataatccttaagatgggagcccagagctgtaaggctgctcacaatggaactcaaaacatgcaattcctgcccaggctgagaaacatacctgggacgcagcggggtattaggttaagggagaaacctccaaatgtttaacagacaaagtctcattacctcaagagtataaatatttttatacgtttttatttaaaagattccctttttaatctgttccaaagtgttggaagctgaactatacaagttcctgccacccatccttccagtacagttttctgaggacatactttttaaatggaaaaataacaggaggaccctctaactgaaaccaggtaggcccagagtgagctcctcaggcccctgtggcagcctggccaaagctggcctttatggagccagcgcgtggagaagtctggggaaccggggccctccctcttgtgaggaaagggctgagcaaactcatgttctctttagtgaaatggtccaaattcagatccaaaagcctccattatggcattccctggcactcttcttatactttatacattgaaggcagctccctcttttatggccagtataagcaggcaaagaaacaaaggaatatagatacatatatgtgtatatatatatattttatataggtaaaatatatacatattttatatatgtatatatacatatttgggggtagggaaaggagaggagggtcatgtaaacctaaacagtcatcacattaccccaaatgagcctgactttaacaaaaagataataaataactcctgggggttaagtgacaacatgggtgcagcaagaagggaaagggcacaaatttaactattaaatacactttgatatttgtttggcagagttcaggccaaccccaggcttctgcccttgccagacaagtaagctgatgatattcaaagaaaaaaataaaaatattaaaaaaaaaaaaattcaagcagagctccataccacagttttccttcaagtcagttggccggcaggcagtttcccgaccaccaggaacagaaactttggctccaaggcaaatgaaacaaacaaacaaaaaaaagtatttccacttacaacatgaaaatacagaaacttcatcaaagaaagaaaactatcaaagaagtctacttccagcaaaactgaggtagcactgctttctccgcattcaatgcttaagtggttctcagtacaatgtgttcttaaaaaatgctcacttgactgacaggtgcagcatgttgatggaaaaactcaacatgaaatgcaataggtcaaagaaggaatgagcaagaagtgagggaaatcagggttctggataaattagcttaaaagggggttgtcaccagactacaaatgctcttggctggccttggctctccaagagctctaaatcgcctgggaattaatgcaatgtggttaacagttaacactgctattcaaatctgtgtaaatctttaaaaataattattacaacctaaattcatctatgtaaacagcactacacacagtacagacctgccctgaaaaacaatatgcgaaactgagatctggcactgtatcattttgtaatgttaattcaacctaacagtcccatccccccgccctgctctatgccctcccctaccaaaaaaaaaaaaaaaaaaacaaaaaaaaacaaaaaaaaaacctaaatttgtgcaagaaatggcaggcttattctatctgaaggcttcaaaaaaagatacacaacatgtaaccaggttcaaatattctgggagatccccccaaaaaggaaataaccaaaataaccaaaaaaatgaagaaagtgcctaaaacatgatacagcattttagagccctttcagatacaaggcagagaaaggtgtaaagtagaaaatatccggatcttcagtaatttccaaaatggtccaattcctcagttggctgcagggcagctggcagatccttgctgctgctcctgggacagagccactaagtctgctcctcgggacacaagccctcaggccctgagctgagtgcacctctcccttccccttctcttttccttcgctccatttcccactccacaaaggtgtcaaagagacttggccaggcctcatcttcactgtagttgctgaggtcagggccaatcacctgagtgaagttaaggaacatgttccaagtgtcccgggagatgcccttgatccccgaggggttctctgttaggaagtttagccattggtccaataccggaggattgttctgggtaaagactagtttccacagggcaatggctatttcccgatgcagtgaccgctgcccttcttcagagtccaggccaaactgaaatgtaaaccggtagagatccttgaatttatcctcttgtttggcttctgttaagaggctagggaaccgtgcacagattccgtcaatgctgtctgcacttattgctttgcagccatcaaaaaactccttcctgcaacagaaaggaaaaggacaattaatcattataaactatactatttacaggcaatatacatagtgattaagagcaaggctttcaggccagatggtctgaatttgaattctaactcctccaactaattagtcctatttccttacttgtcaaatggtaaaaataccaccttacttcatagggttttggtgaggactaaacaaattactattctgcttctaacagtgcctggcacacggttggcagctgataatggttcatttattcattcattcatcttcccaaagctaaactcaagtctcctgctccctgccctgtttcccgctctgcaatagcgattaagctgcggattctttctccttccagaggaggaggcttcctgtttcccttctgattctctatgggttgtttgtttggggtatatttttagagattgccaagggagacttctggagccaaggattctgaacctgagtaattctaccaccagagatcaaaattctattattaaaaaacaaaaattatgtatgtatttttaacatctatacaaccctttcagcttacagcatggtctcgcattgatcgtcttctcagggactgtagtatctgctgaagaggtgaggcctctgaggtctggagggtaaccttcctggggtggggggcatgcaaactacaaattgtatggctaggcctcacagtcagttcttattcacaaccccgtgctctacaaaccacattctacagggacatatgaccagaacaatatgcacagctactgcttagtaactgaggccaactgaccttattatacacaggcctggctgagggcgggcaacatgctaagtaccagaaagggcaagtggcttcatggagggagagaggcgtatcccctccccagaggcacttactatattggtactcacagtgcaagtggcttcatggagggagagaggcgtatcccctccccagaggcacttaccatattggtactcacagtgcaagtggcttcatggagggagagaggcgtatcccctccccagaggcacttaccatattggtactcacagtgcaagtggcttcatggagggagagaggtgtatcccctccccagaggcacttactatattggtactcacagtgcctggcacatgctgggcatacaataaatatcaagtgagtgaactgacatgtaaaggagtaaaagaaaagaaaggtccaagacagcagtggggccgagcagcaacttggccacctggctcaccctggcttatttctcatttaaggcaaagatgagcagtgcccagttactcagaagctgccaaataatgctatgataggcctgaaatttgacctatgaattaggcaaaggcgttattctgcaaaaaaaaaaagaaaaagaaaaagaaaaaaaaaaccatagcgtacacattagaaccagacatgaatctctatcaaaatccaagtgcctgggccttccctgctgagattcctattcagtaggtctgctgcagagccagagagatatattttaaacccttagagtccagaggggcttctcagcatcataaccacaacttggctcaaaagattcaagctttagagaacctgatcagaaaaataaaaacttacccaaaaccctatgaagccaacccagtcctatcctagctgggcaccactgcccaatgctgttccctttcctccactgctcacctggtgacataaagtgtttgtgactaacctggtgaatttgcacatggttgcagcctggaacttccaagccaagagcagcactcgaaattctgtggggtcaacacacaggtcattgcaaaagcgctccatgccttcctccaaaattgcatcttcccgctcatccttgtagcgcctgaacagttcttccaatctttgcaaggaagactcctcggcattggacttggactccctcccagcatctcccgaggacgttggcagctggcaggcctcagtggcagcctcggccttcttggtcccgttgacgaggatatctccacctggcttgccacagggtggtacctgctcctcacggtggcctgcacccctcctgctatgtgacttgttgctgggctcacggtctccatttttgctgcccagggtcgatgagggattcttacacttggtgacacactggcccatggtgctggtggcctggcctctagagtggacccctctggattggatgccctcgctgccgctggcccatgtacctcaacatgccatcagccagaggagccagccaacctggaaggaaattagaaagccatcacctctgggtgggggaaatggggtatggaccctaccttctagggtgcacactggttcaccgctctatttccatgagccaacaacgaaccatgggagagaccctgagttcatcatccccttcacaggccagctccgtaacttcaccttggcgacgcagaggctggggcacatatggagaaccaatgagggaaattcctaaaattcttaaggtaacatagatttcaaagaggccgattcatatgtagaatgcatcaaagactgacagaaatattccagaggaaatctgtcttgccaacttgccatcacataagaaaagttatttggacctgggttaagccagaaggcacaaaggaagggttcatcttctaattcctaatgccaacattctcagattttctttttaagtaggatgagtagggagaaggggtggccatattcagaacaatagtctcataatgccctaatgatgaggttgtcaagactacaagcaggggcctaagccaagcagcaaaatgaaatttgcctctgatctctccagattcctttctgggcctatcccacacagtaggtgaaatgcccttgctttgccctactccatccacctatagaaaccatccaccaagcctatactccaaaccaagtttcccaactgaggagcttcttctcccccaggtcctcagcaaggctgtacttagaatgcaagccaagtccacaataaatgtgattgtcctatagggcctataggctgagccttccaaagaagcatgtctccactttaaaagaaggactggggccggttgcagtggctcacatctgtaatcccaacattttgggaggcaaggtgggtgggcagatagcttgagtgcagcagtttgtgactagcctgggagacatagcaagaccctgtctctacgaaaaatagaaaaaaattagttgggtgtggtgatgcacacctgtactcccagctacaagggaggctcaggtgggaggatcaactgagcccaggtcaaggctgcagtgagctgggatagcaccactccactgcaacctgggtgacaaagaccctgtgtaaaaaaattgaaaaaatcactggtacaaaaacaggcacacagaccaatggaacagaatggagagcccaaaaataaggccacacatctacaaccatctgatcttcaacaaagctgacaaaaacaagcaatggggaaaagactccctattcaataaatggtgctgggataaccggctagccatatgcagaagactgaggctggatcccttccttacaccatatacaaaaatcaactcaagatggattaaagacttaaatgtaaaaccccaaactataaaaaccttagaaggcaacctaggcaataccatcctggacatagaaccaggcaaagatttcataacaaagacaccaaaagcaatcaaaacaaaagcaaaaattgacaagtgggatccataataattaaacttaagagcttctgcacagcaaaagaaactatcgagagatagcaaatatgaaactatcaagagattcctacagaatggaagaggaaatatgcaaactatgcatctgacaaaggtctaatatccagcatctataaggaacttaaatttacaagagaaaaacaaataaccccattaaaaagtgggcaaagtacatgaatagacacttctcaaaagaagacatacatgtggccaacaagcatatgaaaaaaagctcaatatcactgatcattagagaaatgcaaatcaaaaccacaatgagataccatctcacaccagtcagaatggctattactaaaaagtcaaaaaaaaaaacaggagatggttaggttgtagagaaaagggaacacttatacacggctggtgggagtgtaaattacttcgaccaccgtggaaagcagtatggtgattcctcaaagagctaaaagcagaactacattcgaactagcaatcccattactgggcatatacccagatgaataaaaaccattctgccacaaagacacacgcatgcgaatgttcactgcagcactattcacaatagcaaagacatggaatcaacctaaatgcccatcagtgacagataagataaagaaaatgtggtccatatacaccacggaacgctatgcagccataaaaaagaacgagatcatgtcttttgtgggaacacacatggagctggaggctatgatcctcagcaaactaacgcagggacagaaaaccaaatactcacttataaagtgcgagctaaatgatgagaacttatgaatacaaagaaggaaacaacagaaactggggtctacttgagggtagagggtggagggtggtaggagggagaggagcagaaaagataattactgggctctggacttaacacctgggtgatgaaataatatgtacaacaaacccccatgacacatgtttacctgtgtaacaaaccttgacatgtacccccaaacctaaaataaaagctaaaaaaaaaaagttaccaaaaataaataaataaaaatgctcaggatattcagaaaaaaagaaaaaactgaaaaaagtgggaaaaaaatagaaaaacaaaagaaggacagatttacccaaatacaatctttaaatggtaggataattgctagatgaaaaagaaaagtttgcactgatacataacaaactcgtcatggtggtttattaattatttatataatttaaaagtggttttttaaacaaattgctagacatttctgagccagaagcgaggtgatttctctaagatgactctggctacttaggactcttattcctaccttcaactggtttgttggaaaatccatgtacaatttagtatttataaaactttgccaactgctataataatggcagccactgaaattacgttgttaatgaagtgtggaccaggagccagaagtgtagcaggaaacagacactaaacagaagtcaacgtcagtcacccgggcctccccaggtctagggagctttcatggacctctatgatccaaactaaaagatctttgaaaaccggcagtgggacagaaggtgttttttatgaaaggctggagctttaaactttgcctaaaatacttggcttcctccaaatagtgcctggataaattgggggtcgtcttcaagaggaattctctctgaggataagctctgagtatacagtaagtttaaaatgaagagcacaatcattcctgtagttattagagattagtcatatcaaggcctgtccccttctccacccgcaaagagagcaatgacaaaaatacatgtccaaacatgccctcaaagacttgtagttttacttaggcttcaaaaatacactgaagctcttataagggcttttggtatggaaaacaaccatcctaagtaagttttttaaaagactttttatgctttaagactacagctagtaagccataagtacaactcattacaatttcaaatggcaaggggttaattcttggaagaccatggtacaagggaagcaactgtgcgagctgaattatctcaaaacaaggactgtaccatgtggagggcctggtttccagatttgtgttcctaaagactagaatgctgaaagaaacaaaaggcccaaacttacacaaaccccacatgctcacagactggcaactctaattcccaggcacgctgactcaccagggtttactgctcagctcctgctgctgagtgaggcatgggcacccagcgagataagaggatttcctggcctccatctgacccacctaccccaggccactcaccccgcccccactggacagatgcttcatcctagcagcttcctccaaatcctggcgccaaggccttcaggtagggacagaacagatggggctcccaaagaggccctaatcccattgagccaaccagccctccatgtaagagtatcttttgactacctgacacagcagaaccagctgaaacctgaaagcttttaacatgaccagcagatgaaaaaaaggagaagaaaattagtttcaacagatgatcaatcagcaaatgccagaaggttggatcgttcttccactctggtctctttctttgaaatgcccccattccattgagtgttgaggcgagtggtggtctaaacccagaagaaaatatctccagatctggtaagtatggtcccccgattactctgattactgcccagtggtctaccttcttctgtgtctacccccttctctgggaaaatacttttgctctcccagagctttccccaggctccatcacagtgcccagccccatggcccaggctggcagcacttcaagtgttttaaagttgaaggtctcccgtagactcactagctgatggctaacagctaataatagcagtcatcaattattgagcacttgatacggtgccaggcactatgctaagcacttttggggacatgaactcacatatactcatcacagcctcatttaaaaacaaggaaactgaggctgaggaaagtaaattacccatgatcacacatctggctcaagataccatgacatttacccctaggctagattgctgagcccacccccagcaaagcatctagagagaacacatgacggaccggccccaagttcaggagtgacaccacagcaaccccagagcagcaaatctcaccatcagccactggagagagaacacatggtctgtgctcggtgctcaagaaggatctcctactcgctgccatgatccaggcaagcaccatgcacccaggctcagccccaccagacgtggaaacgagaattagtccagatgccctaaacgtgtgacgtttttgtccaccagcacagttaaaagctccagctctgaaaaggacgcccaactgcgccactggctaattgtttgaccctaatggaagcctgaatttcctcaatctgcaaaatgatatctgcctgatagagctcttgaaaggattcagtgaggaactgcagattaaaggtacatggcttcagagaaaacacttgatatgacagctgttactgtatcagtagtagtagtagctcagtagtatctggttagcctgttggaagccccaacttaccccatctgaacaatgggctccaggcctcagattccacaggcccagctggccaggacttcctatccctgcactgagtcactggcccagggcttgttccaaaaccgattatcttgccacagcactgatcctactcaaatacaccactacccagtaatgcttggaggatcagactctccacaacacaggatttccttgtgattgatcctgaataaaatcaagctgagtatctgctgtgcccaacggacaatgaattgctggttatgcccagtccctaacctggagcaggctttcagccagttccaaactccttcccctctccacttagtcccaactctgtagatctctgcaaaagaaaggatgtctagctttccactcagttactaatttaatggaactgccttcccagttggtcctcctccccatcactgccacctctgaagtggacagcctcagcacaatctggacatcccagcaccaaattttcaacagcaacagagcattattagtcctgaatatcatttggtatttgttaatacattaagaaagctatatataaatgtagctctgtgaagcaattacccccattttacaggaaactaaacacagacaaactgaggtcaaggagtctatttaggaatggaggaaacagaagcgcagtgatgaagaggatgagctcagacaaaccaagacaaaccattgccattgccatggcaatctcaccaaataatgggaactgtccgcatggaactttaaatcgaggcagttgtacctcaaagcactattgggtagaataaataacgcaggtaaatgctctgctcaatacctgactcacagaaagcatttggttggtgttagcctctataatagttataattattgtcacaactttggtgacagaatcgtctcccttctcctagaacagtgctcttttcaggagccagcccagatctcccatagcgattcaggtctgctcacaataagtgaccattctcctgcattagcaagggacacaaatgggttgaatggagccagagacaaggagggatgtggagaaagaaaaggcagaagaaagaaggaaaaaaaaaacccatgcactggggaaaccaacttctaggctttttttcttttctacttatagctttgagtgtttacctgaaagaccaaagacagcagctctgctcagcttctgctggaccaagatcagcctccagcttctctccctcagtctcagcccagctgctctgcctctccctccctcctctgcacatcagcctccagactctttcctcccctgtgccagcgctggccgctgttcctggggatgggcttggctggctgcctggtcctaggcctggagcggccactgctgagcccaaagggcaatcccagaggctgcagtccctgggttgctctagctccaaagagggatcaggaagttgttcccatctcctaggcagatcatgaaatgacaaccaggcaagtccctgtcttctaggggcttactctcaactgtgtcttacagaacagaaccaccacagaggacaaactcacactgagactctgtacaaatgcagacaggagaaggagagagaagtgtgaactactattacggaaagaaaggtagggagggactggggacgtgaaatcagtatctgtggagcctggggctacatgcttcatattcatcatcaccttcaagcctcccaacaacctcaagaaaatagttgttgcagctttcatagattaggaaacaggtctcttaactactaagcagtaaggctggaaaataaaaccagtctgccagactttccatgggcaagtttcagagagaaggcaggtttaattctggtccttaaatgtctataagcatgaaatggaaaggaggagggagagggttgatatggttggctcatgttattaatgtatattaataacaatattgtaaaaataattacatatatttattggcatgaattatcacatgtaatccacgactctataaggaagacaatataatcttcattttacagagggaggaagtgaatagagcttgagggaggtagcctgaggtcacacagccaatggaggagaaggattcaaatccaggcagtctgactctaaactcgccactttccatcactggtctcactactgttctctgctatgatgtgtgccaggatattcccctacccctaaggaggtcctggtgccccaagaagaaaatgtccaacatcctatcaatgcctaagtatattcctgaggaaccaagtcaataggaacagaatacgcccccaggaagcctttggttctggtgtgaaatcctcctgagcaatgtgcactctcgagcaagccacttaacctctctgagtttctgtgacactgacattaaagtgagaggtctgggttagtctttccaaggtctaatattctgggactacttcaccttttttggcattcagtgaggccaaagttctaaatgtgcaaccctcctaaggacaggcactttgcctccttggtgaacagatctcacactactccttgcccaagactatcagagtcaaagaaaaagcagaagtccaaaagcagagggaaagcagggctactccaatctgaacaacgagggataggaaacaccagttttgcagccttccctctccttaatcatcttagtttgatctctggagggtcagtaacaggtccagacatggaaaacagacccaagtaaactgctgcagctcgctgggtcaggaagcccactcagaggaatgcatgttggctactactaatggacagcctgtcacccaaggaacagacttgtgaaatgaggagctaaaaaacaggaggcaaatgctggcaccaaaagtcagtgtcagcaaagcacttgagatctgctctgaggcttccttgacagaagggaccaatccattccactcctccattctgttcccatctagaatctattcagcagcaagaaaccactgccagatgctggtgctcctacatattaacaatataaaaagcccatcttttcaactttcatctaaatagtttgtagagctagctgggtgcagctttttatttcttcctacatatgtcagatacccaaaggccagagaacataagtacatgaattcctcagacagcttttctacagctgccaggggctgaggcggttgtactggcacagccatcctccggagagtctcaaggaccacaggagccccttgatcccacctgggagcaagactctgaatgacctgagaaaaagacggaatatggctggtgtccatttgtaaactacttcctagaaagtaaatgtgcaaaaataacaaggaagactgagggaacactttaaatgcacagttgctgctgccacttccaacttaagacttcaaagatcacctttggagattaggtcttacccagagctacttgggagggaaagttgatccctctgccaaagcaaacgagacccgtctgcttctattttccagcttttaaaagactttttgtcctaaaatgtacagcagcaacaagcaacagcagttccagttagggttggggaggaacccatgactttttacatcaaccaatctcaaaagtgcaaaagaaaagagggaggaaggaagggagaaagggggtagggaggacagagaaaacttttaaaaaagaaaactggctatgtttctataaaaatcatcttaggtcacatgactaagaccagccagtttagcataaagtcatttctttttgaaagtgttctcaatgtccctcgcattgcaccctttgaattcactactaagaatatatgtccagttgaggcctcaggactgaagccagtgtgggctggctagaacaaatgcctacttgccaaatacagccaagccaacacacgcacatactataaagtttccaaataccaaataatgaaccatttttttggtctctgggcttccaaactgagctacatgtttaatcccacataactcaaaataaccaaaaaagggctatatcatttcactgacccatacttgaaatattttttgctgtcactattgatctgggcatttctaactacccacttatgtgcaagggggagcatcataaatgggcaccaaatttctaggtcattctttgttttcacaccagcttttccagtgactttccctgtttaaaaccagaaagccatcctggatttgtactgaaccttaactctaataaaaacggcatgcctgctgcactcttcatctccgttataagcttgcagcttgttttattccttaggatggagcctcagtagagcccactgaaagtaaaccactgattagcactaataccctccttccagtcagcatatggttatcagccaccctggaggtttacctgattgtagctgattagtcctcaaaacacccaattaccacatcaactgctcatttttcaatcaccttctgagaacttgggagtcagcaactcactgaaaattagtgaactggagataaggttagatttttgcatctaagtaaaaggcaagaaaggaaattatgaaatgagtccaaagacgacgaaggaacacaacatacagatgataaatgactgcatccaaatgtcttaaagggcacctggatgaccacaaatgtagatatgtggtttcgggagccaaaggcctctaagtaggcctcaggttcaccacgtggtaaccaatcaacctcttaatgtttgctaattcttaaaaaaaaaaaaaaaaatctaaatccattaagaccacatttatcagctttttccccacgatggaggttgactgctaatgcatagcagacaggaagaggaagagggacagaaaagatccacacaataaaagaattcctgctttcaaccacatcagtaacctggtcagaaaagtgaggtcactagactctctttcctgctggcaaattcaaaagtattacataattattttgtgaagtttagaaagtacagagaggcataaagaaaaaaaaagccaatcactaatttcaccacctacggttaatattttggagtatatcctttcagtcttgcttcactgcgaatcacatcaaaaaggctaaccaggctaggcgcagtggctcacgcctgcaatcccagcactttgggaggccaaggcaggtggatcacgaggtcaggagttcaagaccagcctggccaacatggtgaaaccccgtctctactaaaaatacaaaaattagctgggcatggtggcacatgcctgtaatcccagctacttgggaacctgaggcaggagaactgcttgaagtgggacctgggaggcagaggtagcagtgaggaagactgtgccactgcactccagcctgggctacagagcgagactctgtctcaaaaaaaaaaaaaaaaacaactaaccaatccaatgatccagtgattctggctccagggattttaaggaagtgtttttaaatgatgggggaatggggagaaaagcagcttaatcctaaagacatctttcacttatatctaaatttcctcaatttattctttcaaaagaagatcaacttcctcctcacactccctccaaggaaaagaagaggacaaagatgatgaccatcttaaggtctaatgagtaacagtccccttatcaaaggtttaacatcaggggtagaagggtctggcccatggattgagtgattcacattcccagggagcaagaggctcattcaaaagagaaatgtggaatgcctggaaatggtcaatgggctggatttagtgtgaagactaacatgggctgtcaagctgcagactgggtcaaaggacagatttgtagcagacgtgtctgccttcccagcatccaggctcttcatcaggtgattacccaattttcaccagcagatccttttccctcgctctcggccatatggctgggtggggttcataaagaactatgggactcagccccaccaaggcctcacatgcccctggctttaatgactggacccaggatatgcccatgacaagccagccagacagaatctcaaccctgaaaatacaggaggctggagatgctaccagaaagagctaccagagaaaataagaatgcctagggggtcactgtgaggattaaatggtccctgtttatcacatggggctcagctcaaatgcatgtagaacccaaaaatgaaatcaccaagtggaaagcagtatgaagagacaaagggaaactgaattttgaaggcattatttacaccctgaatccaactgttcctagagtcaagatcaaagcctgaacttcacaggtgtgagccaacaaactctcctttgcataagttagatatcaggttttctatcacaactgaaagagtccctaccaagacacagctatgtcactcagatctcttctattcagagagcaaagagagagaagatctaattgccagatgttctgattcatggttcagaaccaactgactaggccacaatttctagtcgaatatatcataggacccttagctgaacaacaggaccaatgatcccaagttcatgaaagctgtcaaattccattataactacgtggaccagtaggatgctatttaaaagatggtatgactaactggctacaagaatctttccaattgcaatttttacaccgttagacctccttcaagtagatatgccacagaatacttcaggagctttattctattgtgtacatatttgctgtcatcatcttgttcccaaagaggaaccccgtcccagcattcagacaccatgtgaaaggctgaaagcaaaaatctctcagaagtctttctctgtacaataacatgatcaaccttccagctgaaacaggtatttgatctaaaccatatcccatgaaactgaaagcccaaatctaacctgaacttggctaccctcttggtttcaattcctatcactgagacaatttctctttgattttacatgccgaagagcctattaagaaagtgtttaagtttcaaagactgacaggaaatgctcatgtttgcacatctttatttgaatacgttctctgcaggttgaaacttgaggccccaaggtttaggctttgatttttttttttaagttacttattttcacaaatgctcatgtagcatgaggccccagagtacattaacatgtgcaaagataagcaggtaattaaaaatggagctctatacctgttggaaggcactgtggtactgcaagctttgcaaagtaagacatctgatgattcgttcctgcccacttcccacccacatgacctgccaaaattgctgccacctaatggccaccacaatgctgtctattaaaaccctgccctagcagctatgccctattttaagaaacaacataaaaaatttataaaataaagcagcagcaccataagttctttcagtcatcaataagtctgaagactcaaagacaactatggccccagaataaactgcgtgcgctcatgcacacacacacacacacacacacacacacacacacacacacacacaaatgttgcatccaacaatagggggtccatgaaattacatgcaacttttctgaattgcgttcagtgtcttgactgttctgcaaccaacattcaattctctcactcaaaaaccagttgcacagatattgcagctccttcagctgctccagtatagtcatgtgccttccaggagggaaagtacatgcattggatgcaaaatgactaggtttgtacagcccagctctaccaactctctagctcacacttaaccatattccatctcagtcttctcagttgaaaacgggaactaaaacaaatcactgtgaactaaatgactatatgcagaagaataaaactagatcccctctctcacactatatacaaaaatcaaatcaaagtggattgaagatttaaatataagacatgaaactatgaaactactagaagaaaacactggggaaatgatctaggacactggtctgggcaaagattttttgtgtaagaccttaaaagcacaggcaaccaaagcaaaaagagacaaatggggttatatcaagctaaaaagcttctacacagcaaagtaaacaatcaacaatgtgaagagacaatccacagaatgggaaaaaaaatctgcaaactatccatctgacgagggattaacagccagaatatataaggagctcaaacaacttaatagcaaaataataataataataatctgatttttattttatttatttattttttttgagacagagtctcactctgtcacccacgctggagtgcagtggcatgatctcggctcactgcaaccaatcacctccgaggttcaagtgattctcttgccttagcctctcgagtagctgggattacaggcgcatgccaccaggcccagctcatttttgtattttcagtagagacagtgtttcaccatgttggccaggctggtctcaaactcctgacctcaggtgatccgcctgcctcagcctcccaaagtgctgggattacaggctcgagccactgtgcccgactctaatctgatttttaaatgggcaaaagatctgaatagatgtttctcaaaaggagacatgaaaatagccagcaggtatacgaaaaaatgctcaacatcactaatcatcacagaaatgtaaataaaagccacaacgaaatattatctcaccccagttaaaatggttatgaaaaaaaaaaaaaacagaataatgaatggcaaggatgtggaaaaatgggaaccctcgtatactgttggtggaaatgttaatgagtatagccactatggaaaacagtataaagggccctcaaaaaactgaaaatagaactactgtatgatccagcaattgcactactaggtatatgtgcaaaggaaagaaaatcaatatactggagagatctgcactcccatgtttattgtagcattattcacaatagccaaaatatggaatccacctgagtgcccatccatggatgaatggataaagaaaatgtggtacatatacacaatggaatattattcagccataaaaaagtatgaaaccctgtcataggcaacacggttggaactagaggtcattacgttaagtgaaataaaccaagcacagaaagacaaatagcacatgttctcactcatgtgtgagctaaaaaagtggatctcaggaagagagagacagttatcttctctaggtagttaccagaggcagggaaggggagcgggaggggagatgaaaagaagtgggttagtgggtacaaacagaagtaagacctagcgttggaaaaatcagtagggtgactccagtcaacaataatctaatgtacatttcaaaataggtggaagagaataatttaaatgatcccggcataaagaaaagataaatatttaaggtgatataatatcccaattaccctgatttgatttttacacataatgtgaatgtatcatattatcacatgtctcaaaactacatatattatttatcaattaacaaaaaaatgggactgagttctgcgatgaaaaaaaaaaggtcacggtgaagaataaatggctgcttcatatgagatgggtctcagttcacgtgctgacatgtgttccatgttcaaccaatccaaatgccacttccctctaattcagcacaacgctgttttacttcttcacggcacttacaactctgtgaaattctaatttgctgacttatttattgcctgctccctctaatagcaggcattttacctgccttattcgccactttaccctgtgcacctaggctatgtggcacatggcacattgataagtatctgtagaaggaataatagtcactgatactgagcacatgctctgtacaaggctttattgctttaaatatattaactcgtgattgaataaatgctgaatctgagatgtttagcactttctcacacacaattaatactcaataaatggtagctatttataccaattcaaattataggatgatgtcaacaaacactcaacaggaaagagtaaagggagttgagtcctaagaatgcagaactcaattcagttctcaagagctgattttttctttttagagacaggatctggctctgttgccagcccagagtgcagtggtgcaatcataactcactgttaacttcaaacttctgggcttaaacgatcctcccaccttagcctcccaaagcagctaagactacaggcacatggtgccacacccagctacttttttcatttttatttttgtacagacagggtcttgctatgttgcccaggctggtctcgaactcctgggctcaagcaatccttctgcctcagtctcccaaagcacttggtttatgggtgtgagcactgggcccagccctgattcttaaggtctattttttcttggactccccccattcgaagcacccactaccttcagagaggaaagagaggagaggattatcttattactccaattattctttaccttatgagtttctcagataatgtgatacaaacacagcttctcagccagcagtacacaggtccatctctcctcacttcacaagctaattttcacctcaaatacagcaaaagccagaatatgaagctgacatagggagatgttcaacctgtcatgtctctttttgacctgtacctcaggatcttagaaaaaattcacattaatggaaatcacttctgcctctcttttcagtcagggtgttatgtccaagggtttactgaagccacagccatgcactgcactctaggaagaccaaggggctcaccaactgggaacactccagtgaaaagcctcaggctgctggtctgaactgcatcttccccacctcaacaaataaaggcatcatatttaaggtgtctagagatgcaggagcaacagccagcagcttttttgaatactgcatactacttgctttaaatacgaattcaactgcttaaaacacaaggactcatggccagtgttacacctcttgagatgttataccactgttcacttgatgacagagtgacttttaacttggagggctgaagcacataccttatcaaagagggtaagtgatacagacaataaaggtcctccatctctttacagccaccagagacaatgaactttgtttcacatgactgcgagaaaggccaacaactaaagtcctcaacggggcccccaaagccagaggtacttgctgagaaagcaaagggcagattccacctccgctggctggcagacccacacattctgcttaaccatgtgaaacagccagctcttactctgcccgcccccaggcccagttatgatatttggggtagaaagagaatagcaacaccggtgacttttctaggaggctgttttataaaaacagagcttccaattttaggcctaaaattgaaaagaaaaatagccagaattagaagtctgttttaacacaatatattgaaaattacaagtttaaacactggtagctggagacggggtatcacactaccacatgacttctcagtgagtcataaaaaatagtaccggcttgtttaacagtgatcgtccaccagtgacagaattaagaagtccgcttgtgtcaaatgatggaaaaccaaactgatacccctcttgtgtttgtttcagcagtggcagaactgacacaaatgaattgcagcaacaatctacaagacaaacactgataaaccttttttgaggctggtcaaagaggaaatgtttgaaaccctgaatatgactcatttttcagaagtcagtttaacaggagaaaaaaaaatctctaaactattaataaatcactaactgaaatatttctggattgctaacatccaatcttgattagcatacctttgtgtcaaagcaaaagccaaatgcaggcatttaacaagtcactaccctttcagttaggagaatcgctctggtggaactagatgagaacaacaaaaattaatcttcaggcatagatggatactgtcatgataataagataataaagacctccccaaaggatttctgggtatcataaattatataacaaatccacttctgccaggcagccaagattaactcctattcacccaggttatgactcggtattgccaatgggcttattgaagtggaagtctcattatccaccactgctcagcaaaaggcacagtcatctttctcattgcaaatcaatttgctgacaccaactactcactgtaagagaagtcaacctaataatcttaaaaacaactttgacacttgtttcttccaggccaaaaacatattttaagaaccagaaaagaaaatgttccgtaatttctccctcccagtaagtccttaaaccgaattttttaagtgcctaagatgacattttattataatatactttattatgtctatcgtgcgtccaaggcttaaatgcattacacattatttattcccttgggacaaaaacattcatggctcccaagcaaatagtcaaatataaaaagtacatagaagagaaaggctgttgtcattttagtgacagcatcttagactgcaagctccaagaagacagggaatgtgtatgatgacacaaaaagggtcaacttggcataatgcgaaggctcacacctgcagacccagcactttgggagaccaaggcaggaggactgcttgagcccagtagttcgagaccagcttgggcaacatagggagacccaatttctacaaaatcacaaataaaaaaattagccagccttggtggtacatgtctgtggtcccagctacttgggagactgagataggaggatcccttgggcccagagggctgagactgcagtgagcagtgatcatgcctgggtactccagccagggtgacagagtaagaccctgtctcaaaaaaaaaaaaaaaaaaaaaaaaacagaaaaaagaaaaaagaaaagaaaatggctaactggcatctaagagatactttctaaagaatcaaatggaaaataagcacctactatgtccctagtgcactgcacaaatctacctaaatgcagagtactaccacttttacatagtaacatccacaaatagtttcccaaggtttactacgtaccaggcatcattctcaaaacatttttacacatatcaactaataaaacaatccaactctccaataataataccctaggagatagtaagcagcagagccaaaattcagactcttaaattaaggatgcttttcaaagctatttttttttaagcctgaaggtttaaattgcttctttcaaaacagcatactccgatagagtggttttttgtttgctttggtgtgctaagtctttgagtcactgagaaatgagagtttggactatacaagtagttttcaaactttaactgcaaccttcagtgagaaatatattttatatccttacccaatgcacacatataaagccatgtacaactcaaagaaaagttccatgaatatttaaccttttaaatatttacccaagcctgggcaacacagcgatactctgtctctacaaaaaaatttaaaacaattaagtgggtgtgatgatgtacacctctagtcccagctactcaggaggctgaggggagagaactgcttgagcccaggaatttgaggttacaatgaccgatgagtgtgccactgcactccagcctgggtgacagagcaagatcctgtctcaaaataaataatctactcaatatttacccttacttctatgatgcactgatttgcactatttgttttctttttttcccattttgtttttaattgttgcttataacccaccaatgagatatgacccatagcttggaaatctcaaccaagcttgataaacgttccctccatcacctttattgtgcctgaaacaacgttaggcattttacagtcatgatagcatttactctccacagctactctcggaggttcctatggctatccctattttacggatgaggaaataagctcagaactaaagcagcttatgcaagcccttagcctgtgacagagacagaggaaattcaccaaactgctcccctaatttcaaacatcctttcagttaggtggggaaatgtgtttacttttttattttttgagacagaatctcactctgtcacgcgtgctggagtgcagtggtacaattttggctcactgcaacctccgcctcccaggttcaagcgattctcctacctcagcctcccaagtagccaggattacaggcgcatggtaccacgcccagctaattcttgtatttttagttgagatggggttttgccgtgttggtcaggctggtctcaaactcctgaccttgtgatctgcccgcctcagcctcccaaagtactgggattacaggcatgagccaccgtgcccggcctagtcttatacacactgttaccactgctcagaatccctccccattcctttctctagtctttcatgccttatgctgggattttacttcccacaggactccttcctgactgagagcctctctgcccctgagcaccttcatttataacattgctatttttttttttttttttgagatagagtttcgcttttgtcacccaggctggagtgcaatggtgcaatctcagctcaccaaaacctccacctcccgggttcaagcaattctcctgcctcagcctcccgagtagctgggattacaggcatgtgccaccacactctgctaattttgtatatatatatatattttttagtagagacggggtatctccatgttggtcagactggtctcgaactcctgacctcaggtgatctgcccacctcagcctcccaaagtgctgggattataggcgtgagccaccatgcccggccagcactgctatttttacagcactggttttacaacattttctaattgtcactatcttatgttccaaccagacaataaagtccttaagagcaagatctacaataggcactaaaaattattggaacaagtagctggcaacatataaacacatttcttcttcctgaaacacgatgtgtccaatcctagagtcagtctttcagaaaaattcagaatacatacgcttcactttgaatacaaccatgaaagcattacattttggaggccaacattttttagcttacaaaactggtttttagtttcagaagtaccctatgaatggtccacattctgtctgagaatgccagtcttttgcttatagatttctaacttaaaaataacagtctggttcttcttagggagaaaatatcttgtacaggttgagtatcccttatcccaaatgcttgagaccagaagtgttctggattttgaacttcagattttagaatattaacattgtacttaccagtagagcatccctaatatgaaaatctgaaatctgaaattcttcaatgagcatttcctttgggcctcatgtcagggatcaaaagttctaaattttggagcatttcaggtttcagagtttcagtaacttcagtactttaaaagtgtgtttttgaaagttttgttctggccggatgcggtggctcacgcctgtaatcccagcactttgggaggccgaggcggacggatcacgaggtcaggagatcgagaccatcctggctaacacggtgaaaccccgtctctactaaaaatacaaaacatttagccgggcatggtggcgggcacctgtagtcccagctactagggaggctggggcaggagaatggcatgaacctgagaggcggagcttgcagtgagccgaggtcgagccactgcactccagcctgggtgacagagcgcaactccatctcaaaaaaaaaaatttttgttctgttaaactgctatcataattgaaaattcttttgcttaagctggttgtatcagaagtattaaatactggagatctttagaactttctgttgagtgaatcaattgaagtactgtatgaaaatagcaaatatgcaaatcagaaaggggaggagcttaggccaaactgttcagaaggaaagaaaaacaggtttccttccaaatggggaaaaggcaactggaaagatttttacctgttgcacaactttttattatctctttctgctaggccaatcaacgattgagagctgtgaacttggaaaagcaaatgctctgataaattaagcaactccagctctttgactaggaaagttttaaagtcagagttaaagattaagtcttcaattaaacatttttatttttttacttgaagttgccatgaatattcaagtttctaacatcctaaaagggctttattttaggagtgaaaagattctggataaactaaaaggttattctaccatgagaagaccgcgataagtggtgctggaacatgtaagaatggcttgtaaaggtactgacctctgccactatgttgtacatctttccttctgactctgttatatgttaagtttttaaatgtgtggtctcgaatgctcatacttcttatggagattatacgaccatggagataatcatttgtatgactaggaaagaacagtcttctttcatgtggctttcatctttaaaagcccaactgctcagctacccacaaaagatcttaaccaagacaaactgatccaatggcaatttcccaagaagagaagaaaacaaacagccccactctagctttgcaaaacttggtctgcagaccaagggtgaatgtcacaactcggcccctcccctttcagaatgtatccagactcatcaaccattgcctacacataatgactaacttccataccacaggaaataggctgttctagaaacctgacatctacaagtaaggtggtcttataattgtatatccaaggagttgcttggtttgaactcaaaatctgctcaaaggatgcttgctgcgtgtcatcaattagatcttagtgggaaggcagacttgtaatcctgcaaaacacagccttcagtaaaaggctttttccaccttgccaatgtgcccaatgacacaggtcacgacacctctctgagacaagacagtaagaatgacaaaatcgaaatttacaaagtatgaggaattgaagcacagatcccacctcagttggggaacatttgagagtttctcattatgaagtcatgtagaaaccttgtattaaataaatgaagttcgaggttgcagggaaccatgattaggctactgcactcagcctgggcaacagagtaagaccccatctcaaaataaataaataaaataaattaggagaataatgttgggctatatcactgccaccattttgctttttttttttttttttgagacggagtctggctctgtcaccaggctggagtacaatggcacaatcttggctctctgcaacctctgcctcctgggttcaagcaattctcctgcctcagcctcctgagtagctgggactacgggcacccgccaccatactcggctaatttttgtatttttagtagagacatggtttcaccatgttggccaggatggtctccatctctttacctcgtgattccgcccgcctcagtctcccaaaagtgctgggattacaggtgtgagccattgcacccggcattttgctctattttaacctaatcttcactagtaacacttggcacagggacctatcagacttggatccatctttatagcaattttttaaaactaaaatctgaaacactaaataacttattacaaggagctataccagatccatggccctttacagcgtgttaactcagaacaagatcacttgcaaacacagaccaatccccaactgtagataataaaagatgacagtgtaaagatacacagaaaatgtttagggactacaggtaattaaggctttaaaaaaaaaaaaacataaactacatctgaaagcagctttttcggcttctattgcttaacagagatttccattttattctgggttttactgaaaaagcaagtgcctcccacagtagtctgtatcatttctactactactcgtttcccttctcaagaccccactatgttgaattatgagcaatatgacaaagtgaaatgagattttaaatactgcctgcctcagtgtttaacatcattttagggcacatatcccactgtccctttaaagcagtcaccaggaagaagtaatctacaggtcagctcttgagatgggacagagccttgaatccatgcactggcttgggttcaagaagcaattaggctttttctcccaccccaacagaacaagtcagaccctaactttacttctaacatggggagtcccaacagcaaacaatgaggaactgaggagcaatccaggtagccgggaaactgctaaaggtgaaagagtaaacaatattattcattttttcattgaaaaaaaaaaaaaaggccaccaatactaatggctatggtattttaaattctacataacctacttgtgggtatttttgtcacaaatgcaaaaaaagaaatttgtcaatttgcttgagttagtcaagtctttatttttttgcctgagacttctgaaggcaagtctttaagtcctgaaatcgggacctgctcagcagtggccatcaccacaaagacttcattgaataaggtgtggcgctgcactagagttactgagtcttggaacctacaaacttcagccattcatatcccatctttaccatcccatctactgttcacctaatatttttcttaaaagcttctttaaaaactgcatctactgttaaataaaaatgatagaagaccatggttctggactaagctcctgcactaggctccaagagaccagactaaaaatcaaaatggagtcattcatgcccaaactaagtttgttatctgaccttcccagaaaccaggagaaagagataacatccaacttcccaaactccatgtttaaatcttcaactggcacgataatgaagttccctagttttaaaccttacacacaaacacacacaaaagtctgaagtaatctaatgttaactattcagttatttctctattgttctgtttccctgtcctgccttacaagaaaagcagctttaaaaggactgatacactctttgttctttgcttctgctttcttcagcccttctgtctataaagccaactcctgctttagctcatctaaacacttattctatattatggaatgaaacattgcccaattctagaattgcaatacagccagttgagatctggaaactaaattggttgcaattttgtctttgacatgactttagtatcatcctaagcactattgtccatgaattcataggtgtgatatgatagttatgttttcattcatacacattaaaaaacagaactagtaggctgggcgctgtggctcacacctgtaatcccagcactttgggaggccaaggagggtggatcgcctgaggtaaggagttcaagaccagcctggccaacatggtgcaaccctgttacaaaaattagcagggcgtggtggcgggtgcctgtaatcccagctactcgggaggctgaggcaggagaatcacttgaacccaggaggcagaggttgcagtgagccaagatagcgccactgcactccagcctgggagacagagcaagattccatctcaaaaagtaagtaaatacaataaaaaacagaactagtaaatgaaaagtattcatcatgtgccaccaaaaatcatcttatgcaccatcagcagtaaaaaaacacatgagtattcatttcagcaacacataaattacaagtgtaaccaaagccacactttgagaaacagtgatttagtcctaaatcctttatgtcatagttaaagaaacagactgagaggggatgtgatctgcccaaggaaaagcagcaatggtggcagagtctagactagaactaaggacttaatccaatggtagtcccactacagtagactgtcttggttcttgagctacaggaagaattagagacctggcctcagaggagttcaccaacaagtaaactctaagcagtcaggaagcccttttgcatgtggatctgggcttttctctttatctgagactctgtcaaacattatctagactggctgaaataaatctatttcttttcccaaagtctaatgtggttttgcccaactcactgaacctcaaggcatacagtcaaagataaaaatgtctcctggatcagtttcccaatttttgatccaacagtatcctagcccctgtccccactgctagacttatacaggctccatagggtttcaggaggaagattttccatctctgggttttaggccagctttggaaacatgctggaagtttccattacagagtcactagtgtatttcccagatacccagaggacaggttttattttcaaatgatacataacttgtgtctactgtgtgcctagcaatctttttatacactgtcccataaactgactataagaggaggtaaaatgatatacatgattcttgactccttgggaattagctgccattccaggtgggcatagcaatggatgccatgtagccaataatagctaatgttattaaatgtttgtttttatgcccagcactgtgccatgtccttcgaatgtactatcttattgaatcctcacaaccatttactgtgattaccctcactccatacatgaggaagctgaggcttagagagagaaatggctcatccaaggtcaagtggcaagtcggtgataaagttcagactcaaacccagactgactctagagactatgttctcttaaccaaggcactatgtacatctattttttgtttgttttgagcagggtctcactttgtcaccccgaatggagtgcagtgacacgatcacagctcactacagcctcaactttccgggctagggtgattctcctcagtctcccaagtagctgggaccacaggcgggcaccaccatgcctggctaacttttgtattttctgtagagccagggtttcaccatgttgcccaggctagtcttgaactggtgggcttaagtgatcctccctggctaggcctcttaaaatgctaggactacaggcatgagccaccatgcctggcccactatgtatatctaaatcttttaaaaagtcatattaaaaagtaacatgggccaggtgccgtggctcacacctgtaatccctgcactttgggaggccgaggcaggtggatcacttgaggtcaggagttcgagaccagcctggccaacataatgaaaccccatttcttctaaaaatacaaaaattagccagggccaggcacagtggctcacatctgtaatcccagcactttgggaggccaaggtgggtagatcacttgaggtcaggaattcgagaccagtctggccaatatagtgaaaccccatctctactaaaaacacaaaaattagccgggcgtggtggcacatgcctgtagtcccagctacttgggaggctgaggcagaactgcttgagcccaggaggcggaggttgcagtgagctgagatcgcaccactgcactccagcctaggtgacaaagtgagactccatctcaaaaaaaaaaaaaaaaaattagccaggcgtggtggcacatgcctgtaatcccaactactcgggaagctgaggtaggagaatcgcttgaacctgggagggagaggttgcagtgagctaagatcgtgccactgcactccaggctgggcaacagagtgaagaaaaaaaaaaaaggtaacatgaaatctgtattataaagtaagctggtttcttgcattagggaagtctagacctaatgcacctttgaagttcaagaatactgactattctgggaatgccatttcatactaattgaaggaggaatttgctgcttataatctaaagctaatcaacttgcagtatctggtgtgtcaagaaatgacaattgttaattatcatttaaatcaactttaggtacccttattccgttactacttacaagatacaaaactggagtactaatggagtattagaaaaatgtatttggtctttgtccctggttcctgccagagatcctaaaacccttggaattttctgtcttttattattcatgaagagccctctggaccacatgccagagtttatgctaacaaggtgatttcaccatgggcccttatagtttccagtgaagggctagccaaaccagaaagaccaagcacatgattagacctcaaagccctactttctgagctttggggaggggagggctggctagagacagagttcaatcaccaatggtcaatgatcatgcctaagtaatgaaacctcaatcagaactccgaaacaatgaggctgggagagcttccaggttggtaaaagcatttatgagctaggagtggcacaccagaaggggcatggaagctctgcacccccaactcataccttgccctatgcgtctcttccattcagctgttcctgagttataaataaatcctttgtaacaaaactgtaatcctaaatatcatgctttcctgagttctatgactcatgatagcaaattatcaaacctgggatggggagtcatgggaacctccaaatttatagtctgctgggcagaagttcaggtaacgtacaaatacccaatacctgcagctggcatctgaagtggggcaattttgaggtaatgcgtaagtaatatgtgggatctgagggtgtgggggcccacacctgtaatcccagcactttgagaggccaaggcaagaggatcgcttgaggcagtttgagaccagcctgggcaacaagcaagactccatctctacaaaaaaaaaattttttttaactagccagccatggaggtgtgtgcctctggtcctagctacttgggaggctgaggtggggagatcacttgagccccagagtttgaaatgacagtgagctatgatagcaccactgcactctagcctgggcgacagggcaagaccctgtctctataaacaaaaaatgaaataaacaggtggggtctgtgctaactccacgcagtaacagaactaaactgctggacactcaactgctgcccaagaactgttggaatgatataattaatcacctcattaagaggtccacactaaaactaaccattctgatgctcagaagccacttccctgcttgatctaatcattaaatctacacctgtcaccaattcagagcactgcttgcaggtcggcactagcaggaaatcaggtcctatggacagatcacagcacctggtcaaaatttttttttttttttttaaagaagaaagactaatttggcctgccaaagagaacatggatgttgtagaaatgtgaagtaaaaaatgattttttttttttgagatggagtctcactctatcgcccaggctgaagtgctgtggcgcgatcttggctcactgcaatctctgccaccagggttcaagcaattctcctgcctcagcctcccgaatagctacgattacaggcgcctgccaccatgcccggctaatttttgtatttttagtagagatggggtttcaccatcttggccaggctagtcttgaactcctgacctcgtgatccacccacctcggcctcccaaagtgctgggattaccggcgtgagccaccatacccggccgattttctttaattagttttttcacattacagttcccacaagagaatcattaattacctcagcaattgacatgtaactgttccgtttggatagcaaacattgttaaatgtcaagagccactatccagtgttctctaatgctctaacggatacaaataattacaatcccttctttaccaacttccgatttgtcaaaataaagccctaagagacagggatggaggccgggggaattggccagcagtctgtaaagatgactggtctccaagatgggaagttgtcagagaggaggacatgtagggtagccggccttcgagggggcacagtggtgatgggtggtgggtgtggagtggggagaaatgcccatcagtggtctagcctggaccagggataactcctgattatggctgattagtccatcttggagaacaatttggccaaaccagccactgtgtccctgtgctcatccctcttaggcagaaatatgctttccagttgggagaggacttgtgatcagagccctggccagggccagtacactgcccaactccagaggaccctgtcccctccttgtgaacggcattccctggagttgggcaatcttgtgggcctgctccttccctaccctctgtccccagtaagtgcactgttagtattttgcagcctctcccagctagaccactgatgggcttttctccccagtccacaataccaccaaccaccgtgtcctctcaaaggccagctaccctacacaagctcatctccgacaactgaacctcccatcttagtgctctgggagtctttaggcttttctctttcctaaaaagttaggaaactctcaagcagaatgctcctcaccgtgggcatgagatacaccaactgttttgagtaaatgactgaacaactgactatttcaaagaacaactaaatttctaagagaaaaagaatctgacaacattctcaaaagtagacacacagcattcactctatcactcctcactctctaattccacttactgagaaggaagaaaatgtcacaactggggaaaaacacctcctcagagggcctgagacttccagtgtgcccctagatgctgtctcataggacccacactgctagagtcccggcaccttcactgtaatggtattattcacctccccctcctgtttaaagagcacttactaggcaagtcattaagtagacataaagcaactatttaattgaaagccaatttgctttacagatattttttaaaaataaggaatgcatgtccatggtggttatttccacagagctgttcagaagctgttctgtccatggatccacctggattctcctcttcaaattccagggcaggtcacaggaaatggaagtctggtttagcattttgcactggtgttcgagaacaggcccacttgcttatctgaaaaacttacagtgcactgaccattttggggttggtttgggggggaaaaaaagaaaacttacagggataatgcctcaactcctatttgaatgtaatatggtcactttcagaactattctgaagaaaaaagcccagctttctatcaagtatccacaaccactactaaaactaagaagcctctcatcccactaccattaataacctcgcttcacatatgcttcactatagggagtcttctttgaaagatgaagagtttgtgacaaaatgtttgagtacagaacccaagaacacagagtccaaacaccaaggattcaattaaactttatcgggtgcctacaccaacttgtttgagagatgcagtgcaacagacagaacaagaattagtgcagagaaggcctgattctagccttgctgctgcctagagcttgctctgtaactttaagcatttactcatctttttttttttttttaaatgagacagggtctcactctgtcaccaaggctacagtgcagtggtgcgatctcagctcactgcagcctgaccttctgggctcaagtgatcctgctgcctcagcctcccaagcaggtgacactacaggtgcacaccaccacgcccagctcctttcccttatttcttgtaaaatgaggtctcactgtgttgcccagactggtctcaaactcctgggctcaagagattctcccgtctaagcctcccaaagtactgggattacacgcatgcagtgcattaccatgcctggcctacttatttttcttgatttctgttttcccactgaaaataaccacttttcaacctgttttcagcctcagaacattttattcaactagaatctaatagggtagcccaatataacagaatattacagtaacttttcacagactgaagtagtaacgtgaaacagaaggaaaacagcaaaaccccctcatccctgccacaagcatacttcaacaatggcggagagggctcctcaaagcccagcttgaaataaacaccagatatgctaagattctgcaagggtctgactttttcctgcttctcctaaacttcaggaaggggaattaacagcattcaaagtagtaatgctatgacttgagactcgttcagaatcaaaattaaaggacacatactaatccactttaagcaaacactgcatagagttcaaacccatcatgaatgatagagagctaaaagctgtaacccaactctgccgcttgtgtggaaacaatctgctactaaaataaaggagcaggccaggtgtggtggctcacgcctgtaaccccagcactttgggaggccgaggcaggcagatcacttgaggtgagaagtctgagaccagcctgggcaacacagcgaaaccccatctctattaaaaatacaataaattagtggtgcatggtggtgcaggcctgtagtcccagctactcaggagggctgagacaggaggatcgcttgagcctgggaggtcgaggctgccgtgagccttgatcatgccactgcattccagcctgggccactgagtccagcctgagactctgtctcaaaaaataaatgaatacataataaatcaaaaaggggcaggttttttcaacactttctcttggcccaacaggcagaaagaggggcagtggctccgagatgctaagcagtctcaaaaatgaagagtcccacactatacactgctgctatctgagattcttagtcagtcatcagacctggtatgaatctgcaggcccaagtgacagaattatttctagtcaccaggtcctgcggttgagccctccagcagagcagggcacaaaaggatcagggatgatgcttcccaacactatgcaatccaagcttctgtgtggcaattcaatcccaagcctaacaatatagtacagctcaaaggacactcttgaacaaggtcaagccctcaggaaggtagacgaagtcattgacatgtctgcctttgcatgcaaccaggctggtatccaggctctgggcacaggtgacttattttgccacaagagctaatcaccacctcaagactgatttactaagcttccctgttctgatgtatggtatttaaagaaggtctcatttgcacacatcttaaagaaaatgatttccctatctgccattctcttctttcaacatgtcacaacttcaaagaataagagtttgagccacttccaatcttttctttcattttcagtgcaattggccatctgtatcaataggttctacattggcagattcgaccaaccatgggtcaaaaatatttggaaaaaaaaaacctaataacaatacaacaataaaaaataatatgaattttttaaaatacagcatagcaactatttacataccacttacattgtatttggctgttgtttttgagatggggtcttgctctgtcacctaggctggagtgcagcagctccatcacggctactacagcctcaacttcctgggttcaagcaattctcctgccttagccaccccagtagctgggactacaggcatgcaccaccatgcctggctaagttttttaaatttttttagagacagggcctgactatcttgcgtaggctggacttgaactcctggcctccaagcaatcctcccacataataaaacaaaaagggggcaggtatttgtagtagcctcctaacgtgctgggattacaggaatgagccaccacacccaaactgtattaggcattataagtaatctggaaatgcctcctgagtagctgggactacagatgtgcatcaccgccactccctgcaccttcccatatactaccactttatgtaagtcttgatcatttgtgaatttggtaactaaggggtccaaaaccaatcccccaggataccaaggggatgtaaatatgttacgctctagtttgtaattattcactgattaaacggtcaagttctgtggtaatcccttctcaccacccaaaagaataggattcaccatcatctaggaacacagacgtaagaactagtgaaactagatttgaactgaaagacactaactcaattaaccctggtccattgtgcaaagagctccagaacagtctaaacagacacaaagagataattttaagttatcaagacccgggaaaacaggagttaccacgtcattaccattgtttcaatctaagttaccacttcttcacctcaaaacaactggcaactactgcacaattaaatgtccttacttcagcacatagacagtcccagactacttcaagtacttacacaaccattctgtttttcacttccagtattcactcaataaattacatgagatattcaatattttattataaaataggctcattagatgcatttgccaaacatgccaaacatgcaggttcttggcatgtttaaggtaggctaggctaagctatgatgttcggtaggtgaggtatattaaatgcatttttttactaacaatattttcaacttatgatggggttataaaaggtaaccccactgtaaatcaaagagcatctgtacaccaaaacagtagcaaaatctgattaccttttagtcgtgtaatgcaatgtaaaaccacttacccacaactccaatagcaagtggcatcaactggctttctaggttgcccacctttcagaagagtttgtccaaaagcctgcaaagtgtaagaaataaatccactggtaccctaaattaaaaggccagctcagctccgaaaatccaatccacttaaatttgtggattctttccccaaacacaattagtagccaatgtaggagacaatggcttctccttgtgttcaagtcccctcctacccacccgccccctttcaaaaattagaaaagagccaccagtctccaaactggctgatgaaacttcagcctacaggatattttcatatttgagttacaataaaccattgaaatgaaaatgaagtggagagcttaataacccatcagatagagcattttatgccaagcatcagcatataagttaagtccaaaacctttaacctgggccaaagccaaataattaaattaacaaatctcactaccaattctctattcctttgagatactctagtatgaagagtagaagttgcctgttcctagatgtttactttagtcatttgcttgctaactaaaagacattctgtttgcaatcaaatcagaattagtaattcagtaccaggatctacctcgtccccttcattgcccccagaactgcccagaaagctctgttcaagttttcgataatccttctacaggtgccacgagaatactagaacctaaaacaggtgacaagtcctcaatttctgattcgttttccccaaacactaaaaggttttatttagcatttctaatactgagtttactacaaatagcccaagcaacatttaagtctctcaactgcctggctcaaagagccaattcactcaaagaacacactagtcactgttgtagggttcaagagaagaaaaaagcatattctgtttcagcccagtgtgacatggctcaagagggccaaatcaaggagtcttgattgggcctctcaagtggacggtctggtcaaggtgaggctgaaaagcagcacaccattagagatgaatgccctcagcagaaggcaaaagtaggttacatcccttggttacgtgccagcccaaagatgccgacacagtggaattgagccccacaatggtcatttatctaatgtaatccactgagtgaacttttagtaccaacctacacctcagctgagtgttattagtcatcagaaggatcagacaagagtggaactattgcaacataaactgcctccctacaaaagacaacttgaaacttagatcctgatggtcatcttggtagatggataagggcatattattaacacttgcccagtccttaaattcatacagagctggaaacaaaggaggattcgtatactagaacacattcagagaacttattatgcagttttaaacagcagtatataagacaaaataaagaaagaggtgtgtcctcaattgaacatcctgctgaaaatctgaacacccagcttgaaatttatctgccagaaaagacccaggtgaccactgcctcttcctctcccactcagcagagtgactttattatgatagtccaacagtacctgcaaaaacagtaagtgataagaccctagttaaggcgacagaattaatcaacaagcagcatcattttctacttcctactccttctggcaatttgtttgcctacctattctgagccccatatccacctctctgaccttatctccaactctcccccgtgttcactaagctctggctattactcacccaacccatcctctttccactacctcccacctaccctgaccctttcttcccattccctggaacttgacaagcgcattccagccagtttctgcaccagctgttccctgaacctggaaggatcttccccttttctttggatggctggctccttctttatacttaaagctcaacttaagtgtcacttcctcagaaagatcctctttgactgcatctacagttaagacactttcaatcacatcactcttattttcttcagcgcttgatcaaaatctggtttactgggatatatattatgtctctctctgtccccagctcccactccgatgtaagctccatgaaagggtgaaccttttgcttgtgttcacctgtgtacacccagtgcctgaaacactggctagcacttaggagtcaataaatgtttgttgaattaatgaactgtgaactttttagtcaatggcaaactaggttctaaatcagttaaagtgagaacagtagtcattcttctgttgtatttttgtgaaacatctaaacacgctgttactggtataatcaagcattaaatattctgttttttagggcccgaaagccctgaataggacttcctagcatcagatcttcctagcactatgcatatcaagctcagttacagaaggacaggacttacgggcactttctaatcaaaggactccgaaaatgtaggcactatctcttaaagttcttcagaaaacagtttcagattctacaaaagatttccgaagaatgtatcaacaccaaaaggaaaatcataacacttcactctgatatctgtctgagaggctagaagagtgctccttgattttttttaaaccaacagcatatcaacaaagaggccttctttccattctttgcttcaaataattttttcacatccgttattggtttgtattcgcccttaaaccaaaactaaacagatcacactgtctcatttaggacccccatacacaaagaatcagctacgtaaagatgaaaatcagcacaagctgaacgtgtcactgatgatttgtgtgtcacacataaatggagaaaaacataaaagagctattgtccaattgtagaaacaaaaaagtaatatggggttttctgttctctgaagtgcatcatgaaaagtgggtggagagaaacacagaaatccagaattagcctagcaaatcattttgggaagagctgacaacatgtaaattcctcacacataaagtatttcgagcaagagaccttgattcctgggctatgatgccattcaggattccttgcaaaggctctggaattccagtattcataaaagaaaatgctcattataatcggagcgtaagaggtactcccaacgtgacagcctgtatgaagtattacaaagcttacagttaagatctgggatagaggctgaacaccaaattcaaaagaggtaaccaaggcactaagtgccataaaggaggaaaggggaagaaaaaaaaatccactattgccactcagccacagagaattaaagtggaaaccaggggtgtgcatgggggaggatgaggggtgagaagtgcggggggtgtggtggaggaacaaacaatacatttgtcaccccgtcccacttcctatagaggatacaggcaaagcctccagcctcattacctcggacacagatggttatcgtttatagcaaaggtgcacaaaaaggccttcaggtctgagccccttaattccagggctgttaatgattaaagagaacgatgggggtggggagggaaatgagggcggagggagctgggagattcacccaccacctccccctagggctcctacctcacagcgctcacccaggacagaggaccagagtctgcaccccctccagggcagctccaaccccatatccccaggccctgggttgaggggtgctggcggtggggaggcagggacagtaggtaagttttctgagccctgcggctgacacgccacaggctcccctcacagcctcttctttcagaggtaccactccagacaacgcgctgacttccactcctccctttccacccccctttctcgaaggtacccaacccccgccccttcatctctcaatgcccccccgccttttcctcaactccccccctccccaaaactcacagctgctccagaggttcctccagtcaaaccctttctggaaacgacggcggcccggcgggtccaaaccacctaccatccccgctcgcgtttccaggctccctacccccgccgccgccgcctcttcttccaccactgccaccgcctcctcttcatctgcggcccaccggcggcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaagtaagggcaaagacctagcaacccggagggagctgggctggaccatttttttttcttgttttacgggaatggagcggggaggataatgaaagcgtaaaggaaaaatagggggaggaggagctcagcttattgttggatgcggcgggagatgggtagagtcagtcagtcgagactcccccagacctggaactggtgctcccacagaggtgggcccggtggtttggtccggcctggcctactggaccagcctgtgctcggtcggccacggctctgctgggctcctggcgccgcctcctcccagcccgccgcgggctgcgcgcttctgtgggtgggggaaggcaggactgacgcagagtgagtgtaggggatggaggcgccgactccaggcgcgggagactggcggggaaggggttggctccccacgggcagggatggtttggaggttgggctgcggcgttgccgggagacgggcctgtgtgaccccagcttcgcgggggcggctcggtgtcatcgccaccggcctcggggacctgcctcacggaagtggctcgcgcgtccaagaggggaggcctggtgtggggacgctcaggtgccggcgtggggccccctcggaggctgtgaatcttttggacccccgaatgtaaatgggagatggtaggggccggtccgggggcgagaggtgtctggctggggaacgttgacccacaccaggtcccgtacaggaacggagactccctaggaccgtgagagccagcttcgtaattctcttgctcttcaaacctgagagtagggtgttgctccgttaccttccattcgtgtgcaggagagagttaagtaaatcaataaagaaggtatcagcaagtgagaaatgccccccaaagaccggatgaggtgacagaagatggggggagggcccctcgaaatcgggtaaggtcgttcaaaggaggccacggttttgcggggatccgagacaatgggttttctgggtggagagaagagccaatgagaaggacttttaggttggaaacagccagaaggccatgtggctgaagcaaacagagccagggccggagtgccctgtgatgtagttggggaagtggcatgactgtagcagcgccttttagcccaaggcaggggtttggctaatgtgtaccttaagggttttaagaagggaagtgacctgacctgatttacatttttaaaaatccgctctgcctgctggatagagaagggtggaagtagttagacctgttaggagactgttgcactgtaagacaaaggagaggtgaagatagtgttgaaagggccggccgggcgcggtggctcacgcctataaacccagtactttgggaggcctaggcgggcggatcacgaggtcaggagatcgagatcatcctggccaacatggtgaaaccccatctctactaaaaatacaaaaatcagctgggcgtagtggcacgcgcctgtaatctctgctactcaggagaatcgcttgaacccgggaggtggaggttgcagtgagccaagatcgcgccacttcactccagcctgggcaacggagtgagactccgtcttaagaaaaaagaaaaggccctcagtcacagtggaaatggagagaattccattcagcatatatttgggaggtagtgcttgcaggacttgctggggaattggatgtgaagtgtgtaggagagggaggaaccaaggttaactccctacgggaaaacagtttagaaaggaatatcgaaagttctcttttgaacatattaagtttgataagtctattaacaagtcaaatgaagttgtcaagaagttagatatacaagtcggggaaaaatcatagttggagataataaataaggaaggcagggaggagctcccagatcacctaagaagagcgtgtaaataaaagaggaagacccctaaatcccttgggttcttaccatttagagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcaggtaatttgtgtccgttatagaaaacctgactttttggataaattgtctgtttatatggctgtctcccccaggtactgtttcttatttgtgtcttcctggctcctggtacagagccttgtccatatggtggttgtagctgggcaggaacactgtgttcataaggtatcagccatacaatccaacagcttctcacaaaaaggggcttttgtccctgccactgctgccaagcccaccacaattacgatcagttccacaatatagtgtaaagggtatcagaagatgaataagaaggcctgggtttcaatcctggatctgccactgaccagcagagtggccatggataaagctcttctctctgagctgaagggttggcctagatttgaagttgcatactgacaagacagatattgcctgcaaacatattgttcagcccacacagtgatttaaattcttttttaaatttacttgccaacatttaaaaattggacatcaaaatccagactttgggcttcatttgaaaaatccgacaatctgacaacaccagcctgaagttcctagaggttcctacacagcaactgtcagccagagctgaagagctgtctcccgtctatgtggctcatgctcagggtttgccaaaaaggcctctcctctcctgctacctggctgacccctgtgggcatttgatttgcaattcttggtctagggctgtgctatccctgtgtagccactgaccacatgtgactatttaaataaaaattcagttcctccaacacagtatgtttcaagtgccagtagctacctgtgacaggtgtgtgtcctattggacagagcagatagaacctttccttcacagaaagttatcttggtcagcattggactggaggaactcgagggtactatgtaggctagtcattctccgcatgtgaaactcaagggacttagcctactgaggagctctggtgcctctgcagatgggaaagttgcgcattcagtagttatttgatggtggaggaagctgtcctgaaggcctggacccctgcacagaatgtggttatttatcagagagttggatcaagggtcaggtgctagaaagccccaactgtatctagtgtggcatgcaaagctctttggtcagtttcctaatccagttcctcagaaaactataacaaagcaagaacttaagtcagtgtcttgtgttctcagacttttcgatttgatatgaagggtgaaagatcctggctggggagttatgaatgaatgaatgaatgaatgaatgaatgatctttagcattggccttcaattccagcccccccaccacatctcttccactgccttctactactagtaactggtgactgctttttcaccacctctgactgacccgtaccttttctttgcctgttaaaatatgctaataaggaaacatacttccatttcttttgaattgaggggcccataacttttcatttagaacttctatccctgatgggaaaaatagctgtatatctattggttgttatcttggttacagtagcctgattggagttcccctgtacaaatataatcttgtgtgcgctccggtgctggtatgatatatttagaatgggtgtgcttgcctcctgtgatcttgtttgggatagacattttagaagtctttcagacattttttgttttggccccgtgttctaaaaacttcccatattacagggcctaaactaaattattttcccttaggtaaaataaaaatgccatccaccctctcctccctgccccctattgctgacagaccatattcttatcattttctgtgtaaaaagatgctgtttcataaaatagctgcggtatgattaagtataccacacaagcatatcctgaaatttgcaaaacagtgtgtggcatgtgaggcattacacttccctttttggattctagtaaccaaaaactgaatctgaaacaggaaataagtctgtggttgtgtgtgtgtgtgtgtgtgtgtgtgtgtgtgtgtttaattgataggaggatatgggaccagaaatgtatggagaacaatttcacttaaaggttattggattggggtaagaatatgggtgtacaccaaaaaggagggagtataacagatctaagagaaaagtgccctgagggataaacaaggagtaagagataaaggaagaaaaataggaagggaagcctggtcatgcctttggtgttggcacctgcattatatttccagtaagaagtatgcgctgtggtctgaagataagcggtgcttccaacagggttatttactcataccaaagaacaatagtcctttgctgtacagggattattaatgatcagagggaaacagctttaggaaaatccattactaccacaaagcaataaattcaccaacaggccacacatttctctcctattcagacaaagcttagcatagataaaagagacctcgttgttcttcctctgtttcctcctattcaggtaacatttgcctttgttaactctcagtgctaagtgatgttacatggattatttcatgaataatccttacgactctgaaaggggttctgctattaccccattgtacattctaagaaaccaagtctcaggcagttaataatttgcccaatggggtaaagtcaagattcaaacccagccttgtccgcccagagcccaaaataaatgttcatttattttgtattatatctgctattccttacaaatgggacagacattccctactctgctatacagggcaagaacatctggttgctctgacattagcaagagcatttcaattctgtagaggttttccaaatgatagttttaagtcacagttttctagattgattttaacccatgatcattgagtatagtggaccttattccccaaaaggattttttcaggaaaaaagtatcagaaccccattcttctatgtttggttctaaacttcatggaaatattataaggtatttcagtccagtggacaaaccctaaccagccttaagaaaacttaagagtgagggttacatcatagctgtgtctcttacgctgttctggatgaaactgatgaggattcctccccaagtaacactgagtctccagttctttatcctgacacacactgctcttgaaagcatcctagtaagggttaattagtatttaacccttcaatgctctgggatcatcagttgggaagcttgtccagataccatcgtgtgtatctcaggatgagaacatacgttatcaatgaccattctgtgtgtgtaaatttattcttctaatacatatttgtcatgttccaactatgtgccagcctaggcatgtaatgtacaagacagtcccaaatctccccctgctctccccacctcctactccctgcaacacacacatggtggaaaaagaaaggtaagtcatgcaaaattatgatagagtaggatgaacattatgacaggggtatgccagaggtgccaggagtgcacatagccgggacactgacccagccccagtgtgaaaagggcacccgtccagaagtgatggaagtcaaaaggtggaagcagcaaataggcaaagaaagggtatttcagttgtatgaagtagagaggcttcctatggcaaaaagagggacattgcacatacagaagaccatgatctcatttgggtggagtttatgattccccctccttgctaaaaaatcataaagtacttgggagagaaatttgactatactacggtcatgagttctgatgagggaaaaaattccacctaggggtaggtctttcctgaaataaatggaaaggggtgtttaacttcctggggcttgaaaatcagggtaaattcctcttgcctttgtcccatttcttatttgtactgcaacacattttctttagaaggcaaagcctcatgagagtccagcatttggaatttggacattcctgagaccagagtcatacttctataaatctcagctggggaaagggaattttcatctctgctcttaaattcctaagtgttcatgctgcaatggtctttccaaaggcagaggaactgttccagaggtggggtaaaagggcacagtggatgaggcccctcataccagcagatctttccatagtcctcctgtagaaacaccaagtgtctgggtatgccttgtacagtaagttcttggaacctccccagaccctctcactgcactttggacagtgagtggcagagtgggtgggtgtttggtgtttggtttttgtttttgttttttagactgatcgctgcccattatgagtccccattactgactccaaaatagaaaagcttgtggtcagtcaggaaaatgatcatccagcttttttggctcttgaccctgactcctgtcaactaattaggggcattaggcaagatcttgtttcaccatctgtacaagtgttggaattataagtagttatgatatacagtagtttgatatacagtgtatttaaaaagatataaatcagaccgtgttactccagcttgcataaaatctaccagtgtcttttgcgcttaagaccagaaacaaagtgcctttccaaggcctacccccaacctgtgctggattctgtggacctgtggcccctttcccaaaggctcttgttgcattcatgttcatcttttttattttcattttttgagatagagtctgactctgttgcccaggcttgagtgcagtggcgtgatcatagctcactgcagcctttatcacctgggctcaagggatcctcccacctcagcctctgaaagtgttgggcttataggcatgagccaccatgcctggctaatgtttttatttttcaatggagatgggatctccccgtgttgcccaggctggtctcaaactcttgggttcaagcaatcctcccacctcagcctcccaaagtgctgggattacaggcatgagccaccatgccctgcctcatgttcatctttgaagtcgattcccacgtcacatcctttgctcctgttgttccctctacttgcaccagcttccccttacctgggtccgttattaggttccatcacaccattcaggactcagctcaaatgtcactgaccacccagaaaataacccccacctctggtcatttgtatcttattactcttcagagcacatatgactgtctgaaattcttgttcttgtacatcatctgcctatgccactagaatataagctcaaggagggtagggaccatggctgcttatttatcactgtatccccagaaacggcaggtgtctggcacatggtggaccttcaataaatgttgagtgagtggatggatggatggatccttggaagggaagagtaaggcctaccaggtagtagcactgtagtgagcccctgcactggtggcttttatgttggctccattggagtcagaggggacagggttgccacggggaatggaagagcaaagcggtgcagccatgtgcccagcctgcttagagcatgctggtgtgtaacataattaaaaagggcggttgcaggttaggagcaggggcaggtggcaaatggggaaggctattggaattcacatcaatgtgcaaaaaaattgcttcctttgctctttgtatagaaagggactagaattatttagttccctttgtcacaactagctaagctctttaaagcaatcaacagacattcaacatttattgagattgaacagtgtatttcgtgattaaaagcatgggctctgacttcagaccagctgagtttgaatcctagccctgcctattgttagctgtgtgaccttggacaagttacttagtctctgcatcaggttcctcctttgtaaaatggggataatggtagtatctgcatatatagagtacctagcaaattatctggcacacagtaaatgcaaagcaaatgtaacttttaatatttttcttactgtaatgaacaagatacaatccctgcccttcaggaattcagactcagagaagaaaaaacagagtgaaagaaatgcagaactatctgctggccatgatagaagcaaggaaaaggttgctttggaaaagcttaatagcaagtaggtgtctgtttgatggtgtggggtggctagcagaaaggagacattgtaggcagaggaagactcagccaagacagacagaagtatgacatggcaaggcaccttagagcagtagctcccaaacttcagagtccacatcacagtttttgctgtttacctatattttaaactagcttaaaaagttttctaattcatttctttaaaggaagctgtatatcacataaaatctaaatcactcaaaattatgggtttgatgggcttttctaatatacagtttgtattgtatatctaagatcacctccccaaccaatctttgggacacttggcattaggggacacatctcttaactatgaccagaggccacaacacactggcagcaacatctgtcagccttttcttagtggcacaggcctgcacatcacagaggcttggaaatgatcctcacctccacacatgtatatccctgtgttataacagggcgtgatttttaagaaaagagaccagcttctagtcccatttctttccaggcacacctcatatcttctgtctttcttcattctgggatttgggggttagggagatgaaaaggagtaaagaattggaagaaatgtcggtctcagaataaagattatagaaggttaacttttaaaaatctacatggatagacttcgtgaccagctgagaccgcagttgaattgtggtcctctaaactactgaatattcctgatgtattgctggtaagaaaatcccagcagaccccattgtatcagatcaacccctgatgtagtgaagaaggaaaagggcttccttagtcttgcattaattgtgagagataattgatagttttagagcaataaatgttggtttcaagccattaaatccatattcgggaaaagctgatttttctaaataagttgctttctaggaacaaagacaaaaatataaaaaggaaaagagctttttaaactttttaaaaaatatatggctgattctgtttctagaatcacaaactttctatagcacaggatactctcaattattcagcaaacatttattgaatactgattatatacctttctaggtgctgagaattcagcagtaaagaagatgaatgtgatcattgtcccccataaaaatgagagtttactgggggaagactttaacaaaccattacttaagtgaggagtgctatacaaacaagaatattaggacctgtgagaaggttcaacagagagccccaacccaatgggtgtgagggaagcaggaagattttctgagacatccatattttcactgggaacggcaggatggatagggttggtcaggtaaaagggaggggttcaggggaaagccttctagaaagagaaaactgcatggatatgtgcccctaaggcaagaaagaacatggttccctcaaagacctgaaacaaacccagtaagaaaagaacaaaagaaacatttttcttttcttgccttttctctcaagacttggaaggaaatggtaggctagatttaataggacacaatggtgaatacagctttagacccttctctcagga

SEQ ID NO: 339 - DNA, 39851 bp, Homo sapiens
gtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctcccccgccccccgccatttcccatctcccttcctcccatccataacatccttccacagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaccaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaagttgtcagcctcatttgtgcgtcatcccttattttcctgggatctcaggacctctgtccctctcatttctcacttctgagatctgcacatcttttacccaggagcctcagagctcctgagtctggtgtctgcctatccccatcttcactgttagtcctcctgcagattctgtgtctcctttcatgtaggtgctggatccctgtgtgtgggcttccgtatctactccctcattccctccaggaacctccagctctccccagtgacttctaccctttactctgggcgtgcctttgccaagatgtcaaagcttaccaacatctctggatccactaattacctcctgcctcctgtattcgtcttcccactctgattacctgacgtctgctccactaaaccgctggatctctctcaagacaaacccttacctccattgagagtgcaacacagtctgtcaccctatttacagaggcccccttccttttcctcctaaattcaaaattcagccttgtcacttcctatttccctctggtctaaggaatctttttttttttttttgagatggagtcttgctctgtcgccaggctggagtgcagtggcacaatctcagctcactgcaacctccgcctcctgggttcaagcgattctcctgccttagcctcccaagtagctgggattacagaagtgcaccaccgtgcccagctagtttgtgtatttttagtagagacagggtttcaccatgttggccaggttggtctcgatctcctgatcacgtgatctgcccgtcttggcctcccaaagtgctgggattacaagcctgagccaccgcgcccagcctggtctaaggaatcttatagttaaggtaaccctgttttccaaaccaaacaccagagtacccgatccaacacatttttgaccacatgtgagtctgttcttctgacatgatttggatcacacctagccatagatttaacacattacctcaactagaaagaatagagcaataaatcagaagcactccagaaaatcttgggtataaaatgaacttcccccgcccttttctggggcacagctttgattaaaacctgttaggaatgataattacccccttctctttgttcctgtgctattccttttactcctctcctctgattcctccatacccacccatctttcatccagtagcctcctccccatcatctcccatttcttctacagggggactcccccaggtctggtagcccaaagctgctgctacagccgccatgggggggtgaattcctcatcccccaatacaggtaagtattcactcctccctaccctcaaatcaagtaggccacattcactgtctactcctgccttcccattcacatgcctgatatttccacaggcaaccaagactccaagcagggagaacaggaaacaaagaataggtgaggtctaaacccctcccctaacagcctcccaccaccatctgactcccttcctaacatcattctcagtcacttcctactcttaaatcttattgtatgaactggacaccagctcctcccacaattccttctaccttacatcctgcaagcccctttcccccacaggttcaactctggtacttccctttggaatacggattctctgagaggttttaaatttggacatagcactaatggttccagcttcatacccatcatgtgtcctacattaaaacctggcccgagaccttgaagagtctgtaatcttaatttcctctttagtattcctataacccactctccatctccccacctaccaggtctgccagtgaggagcaggccttgtcacaggatgggtctggggagaagcccatgcacacagctcctccacaggccccggccccgccagcccagtcctggacagtgggtggggacatactcaacgccaggttcattcgaaacctgcaggaacgtcgcagcaccaggccttggtgaccgcagccccgtcaaacatcttcaaagtattatttctccctcactacaggaaagagccaaagcccaaccctcataatagatggatacattcattcattcattcattcagcaggcttatcagattcaagtcatttgtatcttttaaccagaccaataaaagtatttatttttatcacaagagctgttgaaaaatttgactcattatttcagccgcctcacccctcactgtcgttgcacccattcagccttcagccctgtttttgctcagctttttgctcaaaggcctcagctgtgaatacagcgcttgggggggcgggggaggctgtaacttgcgcaagcgcactcaggcagtctccgagcccgcgggcgcaggcgcgcttacagccgacagagcgcttcagccgcttccctcgagcctgcagtgcgcaagcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggtgagcggaggagaagagggagggaggagagggggcggggagagaccctcctcaaagccggtgcgtggggcggagcgcgcgctgggttccgcgcaggcgcagagacacccgccgccccttcccacctgtgccctgcagcgcgtggacaggctaggggtcgcgggagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggtacccgagcggtccgcccgccttccctgcagtgagacgatcccctggggggttccttgggagcggagggactcgggtgaggcctaactttgggtgacctccccttgcagtttcaacgtcggtaaacccaggagagtgaaggccagcctttaactgtctcctgaggttgtgtctgtcattagaggggcccgaaatgataatagcttccatttatgtactgctttctaggtcgctacgttttgtttacattcattatttcatataggcctcataacccagtgaggctttattgttctcatttataggacatttgtaggaagcggaggcatagggaatgagaatgcctaaagttacatgatagaattcagattcctagcttcagctggatattcttttttctctgtacatttgcctcgcacacttaatcatggagatgtacaggccacagcatttaatccacagtacaataaaacctgttattcgttaactcatcaagtatgtattacatgattcttgcgataagagaggtgaaactgcccccagtgttggaatctttttttttttttttttgaaatggagtcttgctccgtcacccaggctgaagtgcattggcaccatctcggctcactgcaatctccgtctcctgggttcaagcaattctccttcctcagcctcccgagtagctgggactacaggctcccgccaccacacccggctaattgttttgtatctttagtagagatggggtgtcaccatattggccaggctggtctcgaactcctagacctcgtgatccgcccgcctcggcttcccaaagtgctgggattacaggcgtgagccaccgcgcccggccacatttctttaagattccaacactgggccgggcacggtggctcacgcctgtaatcccagcactttgggaggccgaggtgggcggattacctgaggtcaggagttcgagaacagcctggccaacatggtgaaaccccatctgtaactaaaaatacaaaaattagccgggcgtggtgaagggtgcctgtaatcccagctactcgggaggctgaggcaggagaatggcttgaacccaggaggcggcggttgcagtgacccgagttcgcgccaatgcactccagcctgggcgacggtgagacttcgtctcaaaaaaagaaaaaaaagtaaaatgtctgctaggttttgggaggtgccggtatttatgtcacataaaacagtttgctcggctgggcgcggtggcccacgcctgtaatcccagcactttaggaggcagaggcgggtggatcacgaggtcaagagatgaaaaccatcctggctaacatggtgaaatcctgtctctactaaaaatacaaaaactagctgggcatggtggcgcgcgcctgtagtcccagctactcaggaggctgaggcaggaaaatcacttgaacccgggaggcggaggttgcagtgagctgagatcgtgctactgcactccagcctggcaacagagcgagactccatctcaaaataaataataaaataaaatggtttcctcctgttttcagtagagatggagatgaatccatcccttttttcctatagtaattccatccattctgtcaggaggaataggtattggaagcctgttgagcatccaggggatcaaggggtgttagacaagtggattcttatctttctcccttctgttctttctccttaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagaggtaagtcagtgcaaaagtggccttcgtctacagtgggaaggatgtgggtaatccttggacgtacagggatagtcaactggattcttttttggaaccatgaggcaggcatagaaatatattataaacattttcctgagaaaatgatgttccagccaggcacggtggctcaaagtgctgtaatcccagcactttgggaggcttaggcaggtggatcacctgaggtcaggagttcaagaccagcctggccaacatggtgaaaccccatctctactaaaaacacaaaaatcagccaggcatggtggcagacgcctataatcccagctactcaggaggctgaggcaggagaatcgcttgaacccaggaggcgcagtgaaaggagatatctccattgtactccagcctaggcaacagagcgagactccgtctcaaaaaaaaaaaaaagaaagaaaatgatgttcctcattttgggttaagggaggttaatcatgggatgagatctttcactccaagatgggagtaaggaggccttaaaaatagaaaactgggcctggcacatggctcacgcttataatcctagcactttgggaggccgaggcaggcggatcacaaggtcaggagttcaagaccagcctggccaacacagtgaaaccccgtctctactaaaaatacaaaaattagctgggcatggtggtgggtgcctgtaatcccagctactcgggaggctgaggcaggagaatcgcttgaacctgggaggcggaggttgcagtgagccgagattgtacctctgcactccagcctgggcgacagagctagactccatctcaagcctgtaatcccagctactcgggaggctgaggcaggagaatcgcttgaacctaggaggcggaggttgcagtgagctgagattgtacctctgtactccagcctgggcgacagagctagactccgtctcaaaaaaaaaaaaaaattagaaaactgaaaaataggattatcttttctttcccactgggttgatgccatcttcttccacctagcttcccaagctcttccttcagtcccacgactacagtctgtattccttggatgtggaattcatcaatgagatcctcaacatacgtaccaagtgagaattggggcacaggtagggcactggggaggaaaagcacccaaaggtatatacatgacccttttcacttcccagagaagttcctagactgcttctcacagctgttccccattccttagaagccagtttggttttctaattctgccatcatgagatttctttcccatcccttcttcacaggggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggtaagagagaaatgagaaaggacccaaactataatcagttccttttttttttttttttgagacggagtctcactctgtcacccaggatggagtgcagtggcgtgatctcagctcactgcagcctctgcctcccggcttccagcaattctccagcctcagcctcctgggtagctggaattacaggcacaccatcacacccggctaatttttgtatttttagtagacagagggtttcaccatgttggccaggctggtctcgaactcctcaccttaggtgatccacctgccttagcttcccaaagtgctgagattacagatgatctagtctcccagacaacccttgacctatcctcacttgactgtttaaggacagggatcctgtttagtttatgttaatgttaaaaaaaaaatagagactgggtatattagaaaaacctctgagcttcagtttcttcctatacagtgcctagcacatggtaggtactcaaatacttactgaacagactgggtgtggtggctcatgcctgtaatgccagcactttgggaggccgaggtgggcggatcacttgaggtaaggagttggagacctgcctggccaacatggtaaaacccaaaaaaatacaaaaattagcccagtgtggtggtacacacctgtagttccagctacttgggaggctgagatgagagaatcacttcaacctgggaggttgaggttgcagtgagccgtgatcacattactggactccagcctgggtgacagagtgaaaccctgtcacacacacacacacacacacacacacacacacacacacacacaaaagtactgaacaaatgaaaagtcctgtctcatatgttgagccttacaacctggtaaatttccgcctgggagtagaatcccaataaattgttagactcagccacaaacattggatataagtttttaaaccagcagttcccaaactgctgcacagtagaaatgcccaaggatcgttaaaaaatattgacgccaaacactctgatttaattgagacagggcacaacctaagcactgagatgtttgtaagttgcccaggtgatctaatatgtagcagaatttagggactactcgtttaaacaaatgcttgaattcagctttgggaccagtcaccttctccctcagtaagcctccctctattccccaggacctatgatgcctactccactttctacctgaattccagtggcctcatttgtcgccatcgtctagataaagtgagtcctaggtagggctgggtggggtaaagggtagaacatttgtgtgcctcccccaactggcattaacctttctccctgcagctgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaaggagctggtgtcaggttctgtttacgtccttctcttaccctagctcttctcgtgttttgcctatttttttgggcattttcttagcatggggatcttctagctccttggccttataataatggggagccacctccagaagccaactgctctcaatctccagtacctaggagagagaaaagatcaatggagttcccttctttccaacatagatcttttgttgttgttatttttttttcttaaattgaaacagagtcttgctctattgcccaggctggactgcagtggcgtatcatggctcaaagcagtcctactgcctcagcctcccaagtagctgagactacaggcacacatcacagtgcaccattaattttttgtatagttggggtctcactatgttgcctgggctgatcttggcctcccaaagtgctgggatggtttacaaaaatgagccactatgcccagccccaacctagatccttatgtgtatggtcaaaagttatctttcctctttgactgcagggctaggtgtaaaggtgcctggctctattattatatacccaaagggcagatacacctctgtatgttattcaagataccaaataagctattcccaagaaaagtctagaacaacatgccaggcacagtggctcacacctgtaatcccaacactttgggaggccgtggcaggcggatcatgaggtcaggagttcgagatcagcctggccaacatggtgaaacccagtctctactaaaaatataaaattagctgggcgtggtggtgggcacctgtaatcccagctacactggaggctgaggcaggggaatcacttgaaaccgaaggcggaggttgcatgagctgagatggtgccactgcactccagcctgggctacaacagcacggaactctcaaaaaaaagaaaagcctagaacataaagactatactctgtgagaccagagactgctttgttcattatagccccagcacctatacagtagccattcaaatatttattgaataagtgtctagttctcagatcttggaagatgctgacacacctgttagaaaggatgtctttgggctgggcatggtggctcacacctgtaatccctgcactttgggaggccgaggcaggcatttgagaccagcctggccaacatggtgaaacctcatctctactaaaaataacaaaaattagccaggcctggaggcttgcgcctgtaatctcagctacttgggaggctgaggcatgagaatctcttgaaccccagaggcagaggttgcagtgaggctagattgcgccactgcactccagcctggacaacagagtgagactccgtctcaaaaaaaacaaaaaaaaacaaaggatgtctttctattttaccctaccttcctctttctgtaccagtcccagcaacttgaacctgggttcttagcttgccaggacaccatctctctacatagtctccacctgcgtgggcacaggatgttctcctcacctgtctcatgaactctttggtggtcaagacaagttcgtggtagagcagccagcgtggctgttgctcaaagagggaggagttgggatgaatgaagactgtctgctgctgtttcactgtgcggtagccactccgagtcaaccgtgccgtgtggtaaaagtaaccagcagtgatggcctaaggagcgggcaggaaagaaaatcaatggaaaaggcagacatctggggaccctaagaatgcactacctttttagttcaggcttcaggaaaactagagaggtaaggaatgcatgaagaacttcccaggaatgaaccttcagtggtctggggaagaaagggccctgggaggacacgtcatacacaaggggaagagggcatgctctcacgctggaggaaatgctgcatgcccccagagaagcttgctcctgggaaggtactgggggtggaaagcaggaggctgaagaaatgctgaccttgcgtacacggatatagtccccctggcaggaactgagaccaacttccacacgttccaagagcccttccagctgttcccgcacatcccgggctcggcgcatcgatctgaactgtacaaagttctcatagcaccactgggaagagtaaccactctcagcccactgggaagacagttaaaaagaaaggagagataattaagtatacagcaggactaaagtcccccagtgtctctcattcccactcacccaagcccagtgacctgtgtgtaaacatttagcagaaccaggtggtcaccgccagggagaaagaagttgacacgggcattgtcagcatggacgaccttgtcctttggtcggtagaagatggagttgttgacagagagcatggcagccactgtcaggatctcctctgaacagctgtacctgggacaggaaggggaaagcatgagttcaaagcaagacacataggaacagatatggtggagtggggagtgatcactgtgtgatggatgtttcctcatgtggggaaggctggttggcataatggctacaaagcagccagcagatagattctggcagcagcttgggggtcaaggaagtaggggccatagatgaaacacagtcacaaaggagggacatccatggaggcaggagcaggaaacaccggggaattctgaggcttctgcagaaagtgtgcattcactatgtgcatttggaaaagatctctgacagcagaggaatggcatttaaaggtcatccctccacagctacatctaaatgttctagttggaaaccttaggaacaagtaagttcctcaaggggccgggcgcagtggaatcaaggataggatcaagtgtcttacccttgtgggcctcaaaagggggcaatcagagttatctaatactttattatgtgttaagggatagtatgatgaacagaaaaagacagacaaaggggaccctggagacagaggaggcctggcctgtttgtgtgctgggggcccaggtggaggcgagggcttacttctcagaggctaagatcattttggacagcatggggtccaccggcagctctgccatctttcgaccagactaaggagaagagagagagagttgagcccagtcctccctcaggtttcccgctactactacaggggtccctggagccatcctgacccctatcatcctgcctccacccatgctgtcccccgactcaccgtggtgagctccccaaggtggttgagggctcccagagcatacagctgctccaaagccagcagcagtgtctcatatggtggagggtccaggaaatcaaagtgcattaggtcatggatccctagaaagaggtgtgatggatggaacagagtcccttcaaaggacagtgactccagcccctccctcctctctcaggtagcccaatcacctaagctcttgagcagcaacacgacattgcccaagctggtcctctggatctcaggcactgtggtttcctcaagctcgtgctgataggcccaggcggtatacaggcggaagcacttccctgcagccacccgacctgccctgccagctcgctgattggctgaggcctggaaagaaaggggaacaggctggctgacaatttggtcagggaaaagaaaaaggcagtatttatgcaagaaatctggaaggatgcaaactgctcatcccggttccctaggaagcccccaccctgcttctgagttggaccttctctgtgggccaactccacctcccccactcccatgcatccccaggctgaccttgctgcagggtgtgacagtgagcgattccatgcctgtgcgggggttgtagctcttctgcttacagaaccctggatccagcacataaatgatgccctcaatggtgagtgatgtctcagcaatgttcgttgccacaaccacctgagtgataggatatggggtcacccagtgaccccacctacctagttacccagaaaaagtaatcttggaaagttaggagtagtgaagcagttgcagtaaggggcaggagctgagggaattagtagtatccaaggtcaggagcaggggacaaggccagaagacaggggacagggaagtgggggctgggagtcagcagggccataggaggaaaggaaatggagaagaggatttagggttttttttttttttcagagatgggaaatgggggtgttcaagttcctgcccgatcctccccatcaccgctttcgtcttcacacaacacttcctgtaagagcctcctaacgtgtatccctgcttctgctcctagcctctgtcacatggcatccaggatggtccttttaaaatacaaacctgtcacatcactccccatccttcagtggcttcctatcctactctagaattcaatccaagccccttaaaagcctggatcacctaccccagctgcctttctgacctcatctgctagcactccaccacctccctcactcctcccacacactgctttgctctgcccaagtaagtgcactcctcactggatcatttgcatcagctattccctctgtctggcatactcttctcccagatatcagcctggctccctccctcacctggtttgggtctctattccactttccccttactgaagaggccctccctacaccccaaggaaaataccttcatgccagtcctcactcccaccccacagagtcaagttccatcctactatgctgccttgtatctcttcatagcactggccacaaattgacaatatgtatttatgcatccactgcttccccgatagaccacaagtgcaagtttgttaggctaaggactttgttttgttcatcactgtatcatcaacccctgtgtacctgacacacagaaggaactcattaaatatttgttgaatgaaagttatatctctgctcaaaatcctttgactgctactcagctgtctaaagtccaaacttcgccaagcacagtggctcatgcctgtaacccagcactttgagaggccaaggcaggcggatcacttgagtccaggagttcaagaccagcctggccaacatggcgaaaccccatctctactaaaaattagctgggtgttggccaggcatggtggctcacgcctataatcccagcactttgggaggccaaggtgggcagatcacctgaggtcaggagtttgagaccaacctggccaaaatagcgaaacctcatctctactaaaaatacaaaaaattggccaggcgtggtggagggcacctgtaatcccagctactggggggctgagacaggagaatcgcttgaacctgtgaggcagaggttgcagtgagcagagttggtgccactgcactccagcctgggcgacagagtgagactccatctcaaaaaaaaaaaaaaaaaaattagcttggggtggtggtacacacctgtaatcccagctacttgggaagctgaggcacaagaatcacttgagcctgggaggtggaggctgcagtgagccgagatcttgccactgcactccagcctgggcaacagagcgagactctgtctcaaaaaagaaaaataaataaagtccaaactttcctgtcatcaaaggccctccctaatcttagccccaaattgtttttagccttgtctcctactccttcaccacatgaacctcccactaagcctactagctcacactctgacctcaaacataccttgggccttcctctgatgacttctcagccatttttcttttttgagatggagtctcgcattgtcacccaggctggagtgcagtggcacaatctcagctcactgcaacctcctcctcctgggttcaagcgattctcatgactcagcctcctaaacaggtgggattataggcgcacgccaccatgccctgctgatttttgtattttcagtggaggcagggtttcaccacgttaggcagcctggtttcgaactactgacctcaagtgatccgcccacctcagcctccgaaagtcctgggattacaggcgtgagccaccgcacctgacctcagacatttctcttaaaggtccatatcaaatcccacctcttagcacatcaaggacttcccttctccactgaatctactgtgcatactttccagatcacatatttggctctctcttggttcacaccatatttctcctctcttcagtcccaggaacaagggactggctgctcctcagctgtgtgcagcagtgcgcaggactcaccttgcatggggcaggcacacagctttttcactactagttgtgggaagcataggggtgaagagtgtgggtttctccaactgacctttcgtgccccaggtggtgtgggctggaagatacgggcctgcatgtcagagggcagattggcataaatgggcagcaccaggagctcccggattttggagcccaggcggcggcagcgatcctggagcatctcacaggcagcctcaatctcctcctggatagagggtagggagagcagcaggggtcccagagtcacagaaggccaacatgccggccctgtcttcccctgggatacatcatcccctctccccaccatgtcaggcacctgtcctgtcaggaacaccaggatatccccagggggctgggtcacatggatctgcaacacagatactacacaagcttccaagtagtcagcctctggagcctggagagcagaaagagatggggtcacaggagggccacctgcttaggcaaacctttcctctcctcccaattcaacatacactttatcctagttcccctttgaaccttccattccatctttccctccacaggataaccttctccaaaggcctcagcttttctgccacagacttaagcccatcctccctgagggggcaccttggtgtagaagatgtccacaggaaacctgcgtccggggattcgaaacacaggggcgtcatcaaagaaggtggaaaaacgggcagtgtccattgtggctgaagccaccaggaccttgagctcaggtcggaagcgagcaacatccttgatcaatccaaagagaatgtctgtgtgtagggtcctttcgtgtgcctcatccaccatcaccacgctggggagggaataggagagcaatgagggaagagcgctaggcaatgcagtatcagacaccagagttaactggatgagaggggagtaatggacacaaagagttcaagaatgactgttgacggagggggctctaaggagaagtcagccatcccacttatgtagagcaacagaaagtcagagaaggccagggccccatgatctgcaacctatcccagcctcagcagataataggagacaagatgtagaggctgcacactgaggccaggacaagttagccataccctctagttcagtcaagagtctgcttagactcagcagctgctcttactagaaaaagttgaaggatatgttttaggctgggcatggtggtagctcacgcctgtaatcccagcaccttgggaggccgaggcaggtggatcacaaggtcaggagttcgagaccagtctggccaatacagtgaaaccccgtctcttctaaaaatacaaaaaaaattagccagatgtggtggtagacgcctgtagtcccagctacttgggaggctgaggcaggagaatcgcttgaacctgggaggcagaggttgcagtgagccaagatcgtgccactgcactccagcctgggtgacagagcgagactccatctaaaaaaagaaaaaagaaaaagtggaaggattttttttttgagacagtcttgctctgttgcaggctggagtgtagtggcatgatctcagctcactgcaagctccgcctcctgggttcacaccattctcctgcctcagcctcccaagtagctgggactacaggtgcctgccactgtgcctggctaattttttgtatttttagtagagacggagttttgaaacagagtctcactctgtcgcccaggctggagtacagtggcacgatctcggctcaccgcaagctccgcctcctgggttgcgttcacgccattctcctgcctcagcctcctgagtagctgggactacaggtgcccgccaccacgcccagctaattttttatattttttagtagagacggggtttcaccgtgttagccaggatggtcttgatctccttacctcgtgatccgcctgcctctgcctcccaaagtgctgggattacaggcgtgagccaccgctcccggctgatacgttttaaaggaaaaaaaaagtggaaggcagggtccctttcaataagggtgggccagcaaggctgactgggggtaatagacctgagctgctgtgattcaaatagcctagaagctcctggtgtcctgtgggacaactgctgctggcatcattcttgactgtttcttcttttggagacaggagcaagttaagcctttctacctcaactctcacaggactctgcatgctccttggtttcctcctaactcagttatgtgcatgacaccttctttctctttgttctttggcttttctgggtggcagccaagtcccaggaactcatccccatcttcccctacccacctccctgacctcaactctttgtgcctaaccctaactgtgatggtgaagtccccagccattccacaaagcaggctggctcgatgggcaaaaacatctgcatcagacactcttgcgctggctggctctccatgggttcttagagatcttttgcaagggatatgaaggataaaatcctatctgtccaattgctccactgtgatcttccaagaccagaaattcacagcctctgaagagtcaaaaaggcacatattgttcagctggcctgaccccacccccattacattcatgaatcccttttccccctcaacacatgttcaaccaacccctgcttggccatttccagcactaagagctcattattcacagaccaagctacccaagacttgtgtggagggccaagacccagagtccaaccactctgacaggccctgcaatctccaccactctgagggttactcagccattggtattgagttggaatctgtctccctgtaacctccccatggctcctagctatgtcgtgtagggtcacataaaacaatctgatccttctttccatgtaacagccttcacatatttagagggaaccaggatgcttcctgtttctccctctgagctgagcattccaagtgttttcaaatggtcttcacacggtatttcaagtctcggcagcaatgctctgctatcctggttgttttctaaaccctggagatgaatggggaaagaagaggctttctctacaatctcttctgtcctccagccccatctccgtggtacctggaggtcagttcaaggaccatttgaaccacaaagattcaagaacgggtggattaatcagaagacaatggctgaattggctgggtgggaagaagggagagaaaggccagagattagagatacctgtaactcgccaggtcaggctcagagaggaactcccggagaagcatcccatctgtcatgtagcggaggacagttcgctctgatgtgcagtcctcaaagcggatgctgtagccaacctggtcaagggaaccattagcaaccaagtgtgggctggtgtgccctgaaaggaacttggggaaaggtgaagtggggcagcaccaagacttctgctgtagggacctgagggaactgtagactgagtcacagaccccagactctaccccccggttccctagaaatctcacctcattcccaagcttcacacccatctcccgggccactcgggcggccacactcatggcagccactctccggggttgggtgcaggcaatcttcatacccttgtttgtataaccctgaatgacaaagaaaaaagaagaagtttgccctttactaaatatgcaccctgggaccaggtacatttcagagaaagaagttgtaaaaaccaggcaggagaaaaggaggaaaagacagatgctgaaaaccagaaaagaagggcaaatagataggatgacagacctagggccctcaaagggggtcctcacccagctctgggtaattaagttcatgactctgctagacttgagctggaaaagaacagattagctgagacagagccagctaaggtaaaaaagcaggaaggctgggcacagtggctcatgcctgtaatcctagtactttgggaggctgaggtgggaggatggcttgagctcaggagttcgagaccagcctgggcaacatagtgtgacaaaaaaattaaaaattcaaaattttgaccaggcacagtggctcacacctgcaattccagcactttgggaggccgaggcagacggatctcctgaggttgggagttcgagaccagcctggccaaaatggtgaaaccccgtctactaaaaatacaaaaaattagccgagcatggtggtgcatgcctgtatttccagctacttgggaggctgaggcaggagagtcgcttgaacctgggagacagaggttgcagtaagccaagatcatgccaccgcactccagcctgggcaacagagcaagactctgtctcaaaaaaaaaaaaaaaaaaatttcaggccaggcacagtggctaacacctgtaactccagcactttgggaggctgaggtgggcagatcacgaggtcaggagattgagaccatcctggccaacatggtgaaaccccatctctactaaaaatacaaaaattagctgggtgtggtggtacgcacctgtagtcccagctacttaggaggctgaggcaggagaatcacttgaacccaggaggtggaggttgcagtgagtcaagatcgcgccactgcactccagcctggtgacagagcaagactccacctcaaaaaaaaacaaaaaatgtttaatatgggcatggtggtgtgcacctcccagatactcaggaggctgaggtgggatgatctcttgagcccaggagtcccaggttgcagtgagtcatgatggtgccacatcactccagcttgggcatcagagcaagagcctgtctccaaaataaggcaggggctaggcacagtggctcacacctgtaatcccagcactttgggaggctgaggtggctggatcacttgaggtcaggagttcgagagcagcctggccaacatggtgaaaccccatctctactaaaaaattagccaggtgtggtggcgcatgcctgtaattccagctactctgaaggctgacgcaggagaattccttgaacccaggagtcagaggttgcagtaagccaagatcgcaccactgcactccagcctgggtgacagagcaagactccgtctccaaaaaaaaaaaaaaaaaactaacaaaaaggcaggaaaatagtcctttaactccttgttttttggccacgttggagcatagggaggtccacatttatacacgccccactccacctatccatctacccgtccttccaaatgaaatgaatgcaggaagtgagaacagaaatgtgaaaagggtatggtctttactctcaagaatttcacaatttagtggaaaagataggtaagtgactactaaaaatataatgtaaaaggagctctgacaggaatgaggacattgatgccaggtgccctggcaagctgaagggtgagatgactgtacctcctcaaagagatactgcgggatctgggtggtcttccctgagcctgtctcgccttcaatgatgaggacttggtgatttgcaatagcagccaggagctcctctcgaaatgggaacaccgggaggctgcggcggacggcctggatggactctttctgctgggcctgagttgaagtgggtggagctgacggctcctaaggaaagagaaggaggtgtgagctaaatagctcgctacgggtcttcctcagaaagtctcccagctcccctcttacctcatcaccctggagctgagtggcccggacaaactcaatggtctcctcctcctccagcaccagttgatacttgggctcctgagaggcagcatctcgggccccaaacttcagggacgctgccccaagccgcgcctcctcccagcgccgctgctcctccccaggggctcctgattcctcctccactagatccacagctcgggctggctacagagagaggggatatgtgaagactcaaaaacaggatgtcctctctgccctctcccctcttcccattactacccccgcccactgcccattgggaacggcaaggcaagaaaggggatgacccacgtgttgcccaatcccctgaagccttccccacaacttgtcttggggaccaaggctgaagcagacgccgcttcacctcacctgtcctcgggtttccttgggcatgtggtagcgattggtggcctccagcttctcctgctccccagctgcccggtactcccgggcgagatcccgcactcgccgcttatatttgagctcctgccgctcgtgccggctcagctccacgtccccaaaaaggaactcctcatcagccagctccgcctccaggtcctcaagcttctctcgctcccgcttagccaggtactctcggcgagatttcttccgcagctcagggacctgagttgggaaaggacagtcgaatcctcatcttgctggaggagcaacccctttctctaccaatccctacaagggaaaaatcccctgacaggcaggcatgagaacctcaggatgcaccctctaccttccctctgcaatgcacaaccaaaacaatgacatactcaaatctgggcctctttggatgctacatgctgaccccacatcgtatcttcctgcagcagaatccagctggaaagtcctcttaggcagcattatcatctttgttaatatagatgcactagggagatgtctgcgtagcttatattttactcttgccattttattcaaattagtggaaagggggaaaataaaaggctaatccagcatttagaagcacaggactcaaaccgaaaacaattcagacaaagatagaaaccagtgagggggccaacaggaggcaatcttcagccccagttagatgttctttggtcttaaacggaatgactgtagtttgaggaagggagaaaaactgattataaaaagttaggactacagcatcagagtgtttctgtaaggcaaatgtaatcagggatgtttggctttctggtactaacctctcttcaccatgctgtgtctcacttagtttctacacatttacctttgatacaaacttttcaggacacattatggatgacagcagaaaactggcaatatctataaggccctttcctgccaggagtcctcccactatgacatcatcctctctgtgatcacaacttcctctactgcaaggtcaaagcccctctggtggctgggtgggcgtggtgactcacacctgtaatcccagcactttgaaaggctgaggtgggtggatcacctaaggtcaggagttagagaccagcctggccaacatggtgaaatcccgtctctactgaaaatacaaaaattagctgggcatggtagtgggcacctgtaatcccagctactcgggaggctgaggcaggagaatcatttgaacccgggagacggaggttgcagtgagcttagctcacgccattgcactccagcctgagcaacaagaacaaaactgcatctttaaaaaaaaagcccctctgctgttctacccttaaggggcctggttctatttagttgtttggcttttcttgtttgttctgtaaagacttaaaatgcagtttatgatcatgacctaatctgggtaccacagtcaaatattccttccatggaagagccagatagattttttttttaatatgggcaaaaaatcagagccatttgagcattaaaaagaataatgatgtgagattataaaatactgaaaaataaaaattcatgagtccaatttgacacacacaaacaaaaaacaagggaaaaaaatctgtcaccagtgaaatgactgttacagcaaacgccttactctaaaaattcgtatttaaaaggaaacaaacatttaccctttttaagaaggaactgtagcttgttcctagttgttgaggaaaagctcttctttatagacaaattctagccaatacacgtaacaggaatgacagaatcaaaaaatcaccatttcggccgggcgcggtggctcacgcctgtaatcccagcactttgggaggctgaggcaagaggatcacgaagtcaggagatcgagaccatcctggctaacatggtgagaccccatctctactaaaaatacaaaaaattagccgggcgtggcagcaggcgcctgtagttctagctgctcaggaggctgaggcaggagaatggcatgaacccggaaggcagagcttgcagtgagccgagatcgcaccgttgcactccagcctgggcgacagagcgagactctgtctcaaaaaaaaaaaaaaaaaatcaccattttgcaatccccaataaaaataacatgttcaggaaaggattaccagtggcttctaaaagcatttgatgaaaggctattggtagaaaggatattaatactaatatatagatacacaactggatagtatgtccccgtgatatgacataatatgaagtgcacatcaccgcccaagaagtgttcctgccacaactgtttaatctgagtgtcaataagctttagacccaattcctgcttcaaagaaagcacagggcagagaagtacttaacaccacaagataagaatcaggcaaatccagaatgtaggacactgcaaggtgagacagacagagagagaaacaaacttaacatctaagacccaaatgcaatgcatgaaccttgactgcattcttgttaggaaaaagcagtcattaaagttattttgagggtaatgagggtatcttttattgtagagagatcttagtcgatacataagaattactgttcaacttcctgactgtgacaagagcattctgattttagaggacaatatctttatccttagcaggtacacactgatgtacttagagataaaacgccatgatgtctaagactcttttaaatggtctgaaaagaaaaaacataccacatttacaattacaatgcaaatactacccatagtattaaccatttttcaatctgaatagtgtctatgagtgttctttgttctattctttcaacttccctatgtgcttaaatatttttgtaatcgaaaaagaaaaattacagctgggcacagtggctcacgcctgtaatcttaacattttgggagaccgaggggggtggatcgccaaaggtcaggagtttgagatcagactggccaacatggtgaaaccctatctctactaaacatacaaaaatcagccaggcatgctagtgcatgtctgtagtcccagctgctcgggaggttgaggcaggagaatcacttgaacccgggaggcggaggttgcagtgagccgagatcatgccactgcactccagcctgggcgacagaatgagattctgtctcaaaaaaaacccgaaaaattaaattcaggccaaaacagtaacaccactaccaccacaactgcactgagatgtcccagaagcctaaccacagtcaatttcaggaagagatatgagataaattggtcaggagagacctgggaaccagtaggccattcttagaactccaaaagttggccgggcacgtggtgactcacgcctataatcccagcactttgggaggccgaggcaggtggatcacctgaggtcaggagttcaagaccagcctgaccaacatggagaaaccccatctctactaaaaatacaaaattagccaggcgaggtggctcatgcctgtaatcccagctactctggaggctgaggcaggagaatcgcttgaactcgggaggtggaagttgcagtgagccaagatcacgccactgcacttcagcctgagcaacaagtgcaaaactctgtttcaaaaaaataaataaatgaattttaaaaagtaaaaacggccaggcgtagtggctcatgcctataatcccaacactttgggaggccaaggcgggcagatcacaaggtcaagagatcaagaccatcctggccaacatgatgaaatctcctctactaaaaatacaaaaaattagccgagtgtggtactgcaggcctgtagtcccagctactcaggaggctgaggcaggagaatcgcttgattcctccaccagggaggcacaggttgtagtgagctgagatcgcaccaccacactccagcctggcaacagagtgagactccatctcaaaaataaataaataaaaataaaaaataaaacaaaacaaataaaaagaaggctgggcatggtggctcacgcctgtaattccagctctctgggaggccaaagcaggtggatcacaaggtcaggggttcgagaccaccctggccaacatggtgaaaccccgtctctactaaaggtacaaaaaattagccaggcgtggtggtgtgcgcctgtaatcccagctactcaggaggcggaggttgcagtgagccgagatcgcatcattgcactccagcctcggtgacagggcaagaccccgtttcaaaaaaaagaaaaaaggtttaaaaaaaaaaaaaaaaaaaaaaaggaacttcaagagtctcaaaattctattggggtattggggaatctaagtgtgactttacttgacaagaccaggcctttggaaaacagcttaccctacctagtttcacaccataaaaagtccagtttatgaattacaagggctctgtccctgtccagtgagaagacacagggagatcacaaagccacataaggggtgcaggaattaggtggtgggaaggtatttggagatggtgtgcctaagctgaatggtcagcacatccctgtacagtgggactgctgccctgcccttgccctccagcaaccttcttgacaacattccagctgcctcatatctcattaggactcaggaatagggaaagctcacaatttcattcactaatagagtatatttgatcctaaagttaagagtcaaggaggacttatgggtagcctccttccccctacaacttaagaaggatccttccctcaacaacataagtctatcctcagctggctcctaacaaccaagcccctcttctagaaacctgaccaccccatcagcatccacactgtgcttcctctgtatcctctctccctatacactctatcagaaagtctttccttttgtcttctgatcttggctccctaggccctgggactcaccatggccttccggtcttcctcggccatcttgaggcgcttctgagcctcttcataagcctagaagaaaaaacaagaatggaggggtgtgaggccaaagagcccccacactgacagctgctcccctctagaatcacaaggatcattcagatgcgccctaacacaaaaaatgtcccctctcagtgaggaatctctctgattgcaggtacagcagacagttgtcttagccacaggatgcacagggcttctctcaccacagaggtgaacatctcactagagacagccccttgtcttcccagagatcactatctctgcactcacagccaacctcagatttcaccctgggatcttggggatttacagaacatgctgctcctattcaccttcttgtctgaccgttccaggacatttcgagtccgatccttgtcccgctgtcgaacccgctcagcaaaggcatcacgctcctccaggtcctgaaggcgttcacgctctgtccgttcccactcatcttccgactctggcttctctgtctgctgtttactccccctgcagcccatccaggggattaaataagggcatagagaacacttcagcctgccccatcctctctcaccctgcttctgacttaccctgttttcttcttccctttctcagaagcctcttcctcctcttcttcctcacgcttcttcctgaggtgtttccgctttttacgtttcttctggaggctgcttccagccctactcacagtctcctcactgctctcttcactgtcttccagtaacctataagatcggttcttctccagcagggcccgggcctctcgctctgctgcccgagctggcttttctaccactgcctttcgtggtacctgtcagtagaggggaagataaggaggtctgagcaactcctgatctctgccctcccacttagctctgttcctaatttaagcaattacttagtctttcctgcccccgcggcccggccccactgtcaggcaatggcgtgatctcggctcacttcaacctccgcctcccaggttcaagcaattctcctgcctcagcctcccaagtagctgagattacaggcacatgccaccacgcccgactatttttgtatttttagtagagatgaggtttcaccatgttggccaggctggtctcaaactcctgacctcatgatccactcacctcagcctcccaaagtgctgggattacaggcatgagccaccacacccgggcacaattacttagttttaaaccagctaaccagcattcattctctttcttcctcatggcttcaccccatcttcatcatcctgaatggggttttttatttttttttacagacagggtttcactctgtccctcttgggctcaagggatcctcccacctcaggctcctaagtagctagaaacacaggtgcacactaccacgctcaactaatttttaatttttttgtaggacgaaggtttcgccatgttgcccaggctggtctcgaactcctgggctcaagtaatcctcctgcctcagcctcccggggtgctgggattacaggtgtgagccactgcacccggccccctctgttaattaaacgactgaaaggaagttcagaagatgaggggggccgggcatggtggctcacgcctgtaatctcagcactctgagggggctgagagaggattgcttgagctgaggagttagagaccagcctgcgcaacacaccaaggcctcatctctaaaaataaaaataaaaataaaagatattagccgggggtggtggcgcgcgcccgtagtcccagctaccggggaagatgaggtgggagggtcgcttcaaccagggaggtcgacgctgtagtgagccgtgatcttacgaccgcactccagcctgggcgacggggcgagcgagactgtgtctctcaaaaaaaaaaaaaagaaagaaagaaatgcagaaactaagatccctactgaatcgcaatctgcattttaacaagaaccttggatgcatgttaagagttcgagaaacaccgttctattgcgcttaacccgacacacctaagccctcctcaatcttctccactgagctgggcgtccagcagctagcacagtacctacgcgacaacggacaaagaataagtgcttgtgaactgagctttcttaacttctcgatggaccgttaggccagcctcaccgggacaaatcacagggcccctccccacccctgccgacaccttgttccagagtctcagggcgaagtcccgggccggcccactgagatccaaggtatcagtgtctcgtaggcgctgcacgaactcctcggcagaggtgcagcgctgtgcggtaccgatcagaaactgggcgacgtgccgctcgctcagccccaacaccgagtgcagctcgtcctgaacccagcgctccagacccgccggcgtcgccatggcgactcacgctccctgctcccggccctgaagcgtcgggcagccgcgctcactgctgggccggtcagaggcctggagccctcggctggagcctcagcttcgcaagtcagctaccttgggacctctaggatcttccgacatcccaaagctgtcttcccgtaccgcggagcccggaaggggctgtactttttcggcctctaagcactacggtggccgagcgagttcaaacctcgcggaaccatacctgaaaactcggggtaattcttttttcttcatttcgcctctgtccagtttctctgacgccccctgatggtcagtctgtgagtgcttcgctcacgcattcattcaacaagtgaaattaatttaatggatgcctaatgtgtgctcattgctttccgtccctgggatatagcagaggacaaatcaaaagttccttaccaaatttacattttgcggtgggggagggacaggatacataataaagaaagtatggaaattttatagagccaaaaactatacaaagtaagggaggaatgaaattctatttcagattggaagatcgggtccatgctcataaaacatattagcattgttggccgggcgcggtggctcatgcctgtaatcccagcactttgggaggccaaggcgggcggattatctgaggtcaggagttcgagaccagcctggccaagatggcgaaaccctgtctctactaaaaatataaaaattagcctggcgtggtggtgtgcgcctgtagtcccagccactcgggaggctgaggcaggagaatcatttgaacatgggaagcagagtttgcagtgagccgagatcccaccacggcactccagcctgagcaacagaggaagtctctgtctcaaacaaacaaaaaagtgaccgttgctaggactggtttgcctgcagcaggagtgaagacaggtcaggtataagggaagacctctaggcaggaagaaactggggaactggggaaagttgttaaagacaaaatctccaaactaaggaacaggcaaactgtgttctgcatttttgcttaacagcttgagaaaatcactggtggctgcttatttaaaagtaagcaaggccaggtgcagtggctcttgctgtaatcccagcactttgggaggctgaggcaggaggatatcttgagaccaggggtttgagaccagcctgggcaacagggtgagaccccaccatctctacaaaaaattagccaggtgtggaggtgtgcacctgtagtcccagctactctggagactgagacaggagaatttttttttttttttttggagacagagtctcgctctgttgcccagactggagtgcaatggcacgatctcggctcactgcaacttccgcctcccaggttcaagtgattctcctgcctcagcctcctgagtagctggaattacaagtgtgacaagcacatgccatcacgcccagctagtttttgtatttttaatacagatggggttttaccatgttggtcaggctggtctcaaactcctgacctcatgatccgcccgtctcggcctcccaaagtgctgggattacaggcgtgagccaccgcactgggcctgagacaggagaatctcttgagcccaggagccagaggttgcagtgagccgaggtcaggcactccaacctaggcaacagaccaagactatgctcaaaaaaaaaaaacaaacaaaacaaaaagctgaatttgttactcgatgctctgctgtctgatttgtttgatcctgcatcatacttttgtgattaattgcagttaccaggcactactgttaggaaatgaaacattgttcttattaatagccacaagtggatctacatcactgacttttttttttttttttttggaaagggagtctcggagtctcactctgtcgcccaggctggaatgcagtggcgtgatcttggctcactgcagcctccacctcctgggttcaagcaattctcctgcctcagcctcctgagtaggcgggactacaggtgcgtgccaccacgtccagctaattttttgtattttagtagagacggggtttcatcatgttgcccaggctggtctcaaactcctcagatgaggcagtccacccgccttggcatcccaaagtgttaggattacaggcatgagccaccacacctggcctgacctcttgaatgcattgttttctgtttctgagatggactgtgagcacccctggcacctcggagcttcctaactctgttttcctgggtcacaactggaaactttttaagacctttacctaacaggctactaatataatcattctgtttccttccctacccagaccttctctgaactggctgagtcttttgacacctggcttgttctcttgctagtaaattgaaaacctttggcgtatgcttaagttcaatttgtctcatatattttgttttatagtaaaggtgtggggcctcctctgaccagtctgagaggagcaacttgtagtggtagaaggactataactattcaaccatatctttgttagcctggagagctaacaacaaacaaacaaattttcctgatgagtaaaatattgatgttccacatttgtataagatattctttgaaatgggaaaattccaaatatcaactacatgggcaccaaagccatgcactatcaagatggtttttaaacctttttttttttttttgagatggagtctcactctgctgcccaggctggagtgtaatggcgcaatctcagctcactgcaagctccacctcccgggttcatgccattctcctgcctcagcctcccgagtagctgggactacaggtgcccaccactatgccccgctaattttttgtatttttagtagagacggggtttcaccgtgttagccaggatggtctcaatctcctgaccttatgatccgcctgcctcggcctcccaaagtgctgggatcacaggcgtgagccaccgtgcccggcctttaggcctttaacgatataaaatccattgtctatcagaggggaaccttttccaggaaactgactcttgtacatacttacttcattttgcagcaatttcagatttagtattcgtagccccagctctttaagtaagtatccctggattagccacatgggttgtgtcatacactacctagctgccttcatggcagcaggcttctgaatactagaacccttcaactcaaagtgtcctctgtaatattttaacccttttcttctattcattcatttgttgtcattcattctagaaataattccgtgtctactagttgacaggtacaggatattgcagtgaatccagctgatgtagtcagccctcatggcacttccagtctagtggacacttcaactgccctttctcatgtcacctgcttgtcctgcgtgaaacccacgtgcagcttcccagaccccttttgacatgtcagtgccgagttcctggttcatcccccatcattttcctctcccccagccaccagagcctcccctcacataccctttttttttcccaaagaaggagaagcagacgagttgaagagaactccattttattatggaaagttaaaaaacaaacaaaacaaaacaggcaattgataaaggcggcacaatggggaaggagaggtgaggtgtctccttagccacccgacaccatctcaattcagttcaattgtgaaccactaggagaaacagaattaaataactatcaaggggtacagagttaagagttccagccttccctcttggggaaaactaaggcaaagtaatactgagaaaaagtggaggaagccacaccttcaggtcactccaatgaggagactggaggggacagaggagagaattccacgcagacacagcaagtaagcgtggcttgtaaacctgggactttggcaggtggggctgggagctgatggaatttgtaaaccaggctgtggtcaagggaggaggcaggagctgtaaacaaaggggcagtgacctaggaaatgaaggagatgtgcctataaatggagtggggtctgggcctcccagagagacgagtgcttaaatcccgagagtccccacgggatggtggggaggaaggctgtggggagagtgtaccctgccatggggggcaggtgctccatctccaccctccagggagttctgtgccccttctcaggacttggcgctcactcttggatgacctaggatgcaccagcacgtttaaccccacccacaccagggactttggattagggtagaaattgggcaattggctctgcccccagaaacagggtggggaaagcaagttacaagatgttggttgcccttccctgccaggctcattatcagggtctgtctgccctgaatcttccgggctccaggatcttcagttataagaaggagggaggtatatccctatgttggaagatggtcaccgccggcaggactcatctgtgggagagggggcaataatgttagagaatgagtgagagcctctgccttctgcccacccttcccccccacacaaattgaagggcagttggcatgcaggaagtcctataatatcttccatatctaaagcatgttaccaccagtaaccacatccatcactcatttagctcggactctgtgccaggcatccttataactgtttaatctcaccataactccaggagagattaagtaatatgatatccagctgtggctcttggtgcttcacaaaaaattacttaatcttggcctggagcacctgtaatccaagcaatttgggaggctgaggcaggaggatcacttgaggtcaggagttcaagaccagcctgaccaacatggggaaaccctgtctctactaaaaatataaaaactagccaggtgtgatggtacacatctgtaatcccagctactagagaggctgaggcacaagaatcgcttgaatttgggaggcagaggttgcagtgagccaaggttgtgccactgcattccagtccaggcgacagagggagacgctgtctcaaaataaataaataaataaataaataaaattacttaatattttctacaagtctaggaggtagtttttggtttctgtttttttgagacagaatttcactctgtcacccaggctggagtgtagtggcgtcatctcggctcactgcaacctctgcttcccgggttcaagtgattctcctgcctcagactcccgagtagcagggattacaggtgtccacctccatgcctagctaatttttgtatttttagtagagatgggttttcactatgttggccaggctggtcttgaacttctgaccttgagtgatccacctgcctcggcctcccaaagtgctgagattacaggcgtgagccaccgtgcctggcctgtttgtttcttttgagacaggtcttcctttgttgcccaggctggagtgcagtgggtggtgcaatattggttcactgcagcctccaactcctgaggtcaaacgatgctcccacctcagccttccaagtacctggaaccacagctgcgcactgccacacctggctaatttttttttttttttttgagacggagtctcactctgttgtcaaggctggagtgcagtggcacgacctcggctcactgcaagctccgcctcccaggttcacgccattctcctgcctcagcctcccaagtagttgggactacaggtgcccgccaccacgcccagctaatttttttttgtatttttagtagagatggggtttcaccgtgttagccaggatggtctcgatctcctgacttcgtgatccgcccgcctcggcctcccaaagtgctgggatcacaggcgtgagccaccgtgcccggcccacacctggataatttttcaatttttttgtagagacaggattttgccatgttgcccagggtggtcttgaactcctgggctcaagcgatccacccgtcttggcttcccgaagtgctgggattacaggcatgagccacaggaggtagttattattaacttcatttcataaataataaactaaagcaagagatcagatggtttccctgagatcacacaattaaagagacaagctggaattccaactcaggcctgtcgacccaccctgtgattttgaccagattacagcactcaggaagagttctcgttttgaaacctgaagactcaatgtgtacttcactgccggggacctcagtttgcccatctgttaaaggagcatgttgaaccagaggacccgccaagccccttccgagtgcctacatgtaatcctccctcctctctcctggaccacagcgcccgctctgacagcagggggcgccctcgggccggcggagcctccgcttacccacaatcagggccttggtgcgcagcccgccctggagctctggctgcagcagcagcagctcttcctcatcctcttcgtcgtcgggttgggctgctggagggttgggggcactggggacctcaggctccgggcccagctcctccagtaccgaactctcggaggggtattggtacgtggtctccagggctgtctcgctgaaggagatcttaagctgaaggagggagaaaaagggggcaggaggcaaggtcagcaggggagaagcccgcgggggttgagggagagaaagcgggggcggggggggcggagtctgcaagggagcaggtgggactggcggaacgtgggggtgggggctggactcaggtgccccactcactctccccatccactctgggatccagttttcctttccatactggctctccaattctagagtttccctcttcgatcatatcatttcaaaacatcagactttgccctgtacgttggcaggggcttgggaggcagaagtgaataatataagaccaaggtccctgctatttcgagtgtgggaggcagaggggtaaaaagaaattaaaatacatggcgataagtcttgtgatcagaaccgagtctttgggcaccttgggggcaatcgagtgaacttcccagaggagcccagcagactggccagtggggaaagaactggctggggagcgagtctcagacaaaagcaaggttttcatacccacagccccttgctgtcctatgcaaaacccaggaccctgggcacctgttccctcctactctcctcattcctctcctatccatagcaaagggagtctagggcctaggaagagatgggagatgaacagaaaggccgagaggaaccaagagactccagcaacacacaggggaaagatgagccgctgacaccctgaaggctgggggagatgacaagggcagaaaggaaagtccacacaaacctggggtgggggtccacagtgtgcccaaagggacaggcacagagacaaaataccagacagggcacagaaaacccttggtaatcacactgtcccaagagcaggcgagtcccagctgttctcactgcctttctacccttcccctttgccctattaagaagctcagggggaaggggcagggtgggattaagtctaggagccaaagggattagggagacagcaggaggattccatatgaactacttggaaaggtccaaatgatctactcaggccttccctggcatctgtttgggaagacttggggtcagccgtacatccctgagtcccctaatgaactgaggtatgaaaagagagaagccagaagggtggctgggcaggtggttgttaagagctgcatcaatatgacaccagtcaggcatggtggctcacacctgtagccccagcactttgggaggttgaggcgggaggatttcttgagcccaggagttcgagaccagcctgggcaatagagtgacactgtctctaaaaaagaaaaaaaaagaaaaccagatatgacacctgggtccccatgggaaggtagaactcaggaactgtatatgttactccttgttggctctgaaccctgcagtgtctccccatctcacttggagcaaaaagtctactccaggctgggcgcggtggttcatgcctataatcccagaactttgggaggccgaggcgggcggatcacaaggtcaagagattgagaccatcctggccaacatggtgaaacctgtctctactaaaaatacaaaaaaattagctgggcatggtggcgtgcacctgtagtcccagctactcgagaggacgaggcaggagaattgcttgaacccgggaggcggaggttgcagtgagccgaggtcgcgccactgctctacggcttgggcaacagagcaagactctgtctcaaaaaaaaaaaaaaaaaaaagtctacttgattgcccccaaggtgcccagagcctgaccaaagcctacagggtgctcccagtatgccaccctccccttgcctctctggcctcttcctccactccagccacactggccttggttccctccacgcactcctacctcaggaccagaacagtactagctattccttctgcctggaacactcccccaaaatatccccatggctctgaccctcctgatcaccctattttgaagtctccatattcactccccctacctcctgaccctctaagttccactgttctatttttttttccataatcacttaccaccttctaacttactagataatttactaatatattatactcatgtctgctgttgaaaggagcttggggccgggtaaggtggctcacccctgtaatcccagcactttgggaggccaagacaggtggatcacttgaggtcaggagttcgagaccagcctggctaacatggtgaaaccccgtctctactaaaaatactaaaattagccgggtatggtggcgtgcgcctgtaattccagctactcaggaggctgaggctggagaatcacttgaacccgggaggtggaggttgcagtgagccgaaatctcaccattgaactccaggctgggagacagcgagactgtctcagaaaaaaaaaagaaaagaaaagaaaaaagaaaggagcttagaagttggtacaatgcaagaggttagggtttgttcagacctcacatgaggtgccatcagaggaccaatgctggggaaacgatctgcgggtggtccagcctgtacacatttgacccccagttcatgtctgtggaactgctggtagaatctagtgacagcagccagactgcttatatcccaagttctcagaagggaccgcttaggtttctgtaactgacagatttacccacatttctgggaacccatttttgttttcttctcatatcctcttttggaataataacctctgtactttattttctactctgaaaatgacttattttatttgctctcggtctatgtttatatctccccccctaccctgcctgtctcctcaccccccaccaacttctgactgggcttctcagaaatgcacagcctgcatgggagtgggggggtagagagggggtgactcactcgctcctctcccatcagctatataaggtcacaatggggctggtctctcagcccaaccaagaggcctctggggtagggcaccagccacagccatcccctgggctccagtggcagggctgggatttctctcctgatggcagggataaatttgatggaattagcctgcaaacgagttatttagggaaggtgaagcgggggttggtggcagggtcctcctatctcctattcctgagccagtgtgttgcagcagagctgggacaaggcacccagtccctgaagaacaggttgctgacagggggtagagggtggagggtgaggcgtctgggtcagaggaactctgtgctgcctcctccccacccccacccaagcagcggctgcttccttattctctcaccacatcctgagcacagatctggcaggcccagggcccagggcccagggttccccactcagccccaccagccttccggcccccaccccaggcttcctgtttgggcgatctgcttccggctcccctgctctctggcctaggtatggtcaccagcacaggtcctgccctgcacttgcttcctggctcccctgggatgctccctgggctttgggccccaaagcttcatgcttccctctgctcattcttccccagaggcacaagcctctctcagtaggaagtgacttttctgaacacctcacccgggtagcatttccggacttctgtttttttcatc

SEQ ID NO: 340 - DNA, 28750 bp, Homo sapiens
tagcctagtggttcaactatatctctgctattcactgtctgagtgtctgtgggtacactgttaaagctctgtaagttccagtttcctaatttgtaaagttgggactagagtgaccaacctgtctgtttgcctgggacttatctggttttagcacttaaggcaatacatcctgaagaaccaccccccgacaacccctcaccacttcagtctcagatggttggtaaaccaaataataacagaactgatttcataggtttcttgtggtgattaaaggagacaatatgtttaaagagcatatcagaatgcttagtacataataaaggtccaaaagatgggtactgttatttacttctccctcacattcctctttttatttatttatttatttttttattttttcacattcctctttgaaaagcttatctaagaaaaaatggtaggagagcccaaacaggcttaacaatagtttgttggttaacaggctaccttaggttgaagaaagaaatattgataattaagcacactcatgtctgcattacagggaagttgatatgtaacacagctatgttctttttcttccttccttaatagcaattcccaacatgcatggctatcagggtcttacaggcacagctgtattcacagtgatcccaactgcaaggtacccccacctgctccccattaatttgagcccagtggttttctagagcagctatctttgaatgcaaatatgatgaggctgagaggaaaacagtactttttctgcatccccagtcatttttaactcttttccacgggccgttattatggggcttcttgttccttagctaagggcatctgcagtaacattctggcatctggggatgtgttccaaccaggtgaatatcagattcctacaacttcaaagcccaacctttataatcttctttgtttgcttttaaatactcataattttcatgtttaaacattttaagaccctatgaacaatgaggaacatgattctccccagacacagaagattttatctatattcccatctattaaaatctgtaagtaactggaacttttaaaatacttcctttccatcaataattccttcatacctggaaccacatatttctttagataactgggtgggaatttatatttttttatttgcaagagcttaaagagaagtttttacgcttagaattcctttgccatttaagtttctcattcagcacataagcccctttccttttggaaagtgctagataagtattatacttattctccatgcaggccacacctcaggtttgaaggtatctggagaatatatataaaagcagaattttgatacttagaaacagctaaaagtcatttagagcaaaatctgatgtataaaatcagcaatcaacttgagaaatgctaatctgatttttttaattggattaaactctctagaggcattgcacagaggagtgtaatgattaaaagcatatgatctggagtgtaagtggtgagatttggattccagctcaatcatgcacagtgttaaactctctacacctcagtttcctcatgtgtcaaatgggcataaaaattctaaccacatagggctacagtgaggaataggtacatgtcaagtacttaaaggtttagcattaattacttagcatgtattaagtacttaataaatgctagctactggtagacacttcagggaatgatgaggattggagagagggtaagagagcaaggctgtggcttacttaccattgtcaaccagagaatattccccttttcctgtttactcatattgggcttctgaagtaaggttctgtaggttccacagctaaacaaagtttgaaaaccagtaatgaagatatttatttatcaagaggaaaagataatcaagacctattgctaaatgataaaagcaggttggcaaaactgtatattataaagcaactctatttttctttttttttttttttttttgagatggagtttcactcattgcccaggctggagtgatctcggctcactgcaacctccccatcccgggttcaagcaattctcctgctcaacctcccaagtggctgggattacaggtgcccaccaccatgcctggctaatttttctatttttagtagagatggggtttcaccatgttgctcaggctggtcttgaactcctgacctcaggcgatccacccgcctcggcctcccaaagtgctaggattacaggcatgagccactgcgcccagccagcaatcctatttttcgatttatctatattgtctcaaaggatattaccaaaatgtgattattgctggatggtaaaatttttaaaaaattttatcctgcgttcacatgttggtaacctgtatttaatattttatgcaataagaatttaagtaaatatatttctcttaggaatttaaagtatatttaaaatatttttgggccaggtgcagtggctcatgcctataatcccagcactttgggaggccaaggctggaatatcactggaagccaggaaccagcctgggcaacataatgagtccctcatccctacaaaaaataaaaataaacattagctgagcataatgacatgtgcttgtagccccagatacttgggaagctgaggtgtgaggactgtttgagaccagaagtttgacgctgcagtgagctatgagctatgattgcaccactgcactccagcctgggtgacaaagtgagaccttgtctcacacacacaaaattttttttaagtcttcatttttaaatggcaaaagccaaaataaaacttgcaaagttaatatttaagctgcgacattaaacaaaaatttccttaaataaattgttctattttatcctagattgtagatgtaaatggcaatgttctacctcctggacaagaaggagatattggcattcaagttctacccaaccgaccatttggcctttttactcattacgtagtaagtgacttactaaataatctcattttctatttatttctcaagtgcttggtaacaatccctgtttgccacaaaacatacctaggataggtacttgaccctttcttgagagattggttgtcctgaatagtaatccaaaagacaagaaattgaagaaatacccaaattcttgctgaagaaaagcatgctggtcccctgaggccagatcactgttccaggtccacgaaggcaagaggaagggaccctagaaagaggacagcctcttaacatcccctgatcctctcaattatcaaacaaaacccactcattttcctgaaatccagttagtgctctttcttttcgggaagagtgagagggacaggggatgcgggggtggtgggattaagcaaatgtctttcacaagaggctttctaagctccttactgtttacaacaatattttcatctctaatcacagtatacaaattagagcaaagtctctatcatataataaaagatccagatgctacttgccagtgtatttgatataatgtaacagtatcttgttttttcttatgtcagacttgcagaaccaattctattattgtgtaaaacaaaacaaagcacaaaaacaaaacaaacctgtctgctctttattaggtgtcagtgctttcttttgactcttgagtatttacttctctcttttcctaccagcattatctattaatcaattagcaaaagacttaatttagtttactcctctgagctactgcaatatttattttgtaatctatctaagaaaaatctcaagatggaaacatgactaatctttgtaactgtagtttacctttcttctgtcgggctagctccatgctggaatttcatctttattttcacaatctatctcttcctaactctaatgcttctcaaaggagccaaacttttctgcttccttgaacatttaaaaatccaattgagggccaggagcggtggcttatgcctgtaatctcagcactttgggaggccaaggtgggcggatcacttgaggtaaggagctcgacaccagcctggccaacatggggaaactccatctcaaccaaaaaatacaaaaattagccgggtgtggtggtgcacgtctatagtcccagctatttggaaggctgaggcaggagaatcgcttgaacctgggaggcagaggttgcagtaagccaagatcgtactactgcactccagcctgggtaacagagtgagactgtctcggaaaaaaaaaaaaaaattccaattgaccagaagagttggattcaccataacaacaaaatgctatttgttttgcaggataatccttcaaaaacagcttcaactctacgaggcaatttctatatcactggggacagaggatatatggataaagatgggtatttctggtttgttgcaagagcagatgatgtcatattatcctctgggtaactttcttttccatatgtgcatatgtctgtgttaactgatcatcagtgttctagagtgaacctgccactcacctgtatgtattcctgccatatgtgtttctagctatcgaattggaccatttgaggtagaaaatgccctgaatgaacacccttcagttgcagagtcagctgttgtcagcagcccagaccccatcagaggagaggtaaaagaactgattcatgtcaactttataatttgttggcaatttaacacatacttacaaacagtagctcagtgaaacagaattaaccaaatgattcatttactaaatatgcaagtcagatagaaatatgctagtcagaaagaactgctacaaaataagattgaattatgagttgcagctctgatcctaacagacaaacaaaataaggctgaaaatacgtactagaaagaatttgaattccttccgtggtggactagggcaaagatggtgtgaatgccagtaacccaggctcacgtcaggatggggtgacagaagtcagctggatgggatcaaattgttacccagaaggtctggaaaccaacgaggtccctggtgtagtgaaggagaatgggctggcatcagatgtcagaagtgggaaccagaggctggaactgaggtaaccataagcagtcttggtaggtaaataagtagagatttcaggaaataaactctgaataacacaggtgtcctgaaagcccattcctattggggctgaccacacagtattttggcttaaaagtaccatgccaggcagcctcctgcgttttgcctgtgtgtctacaacatgcccctagggtttctctagctgagttacaagttctcacaagtatttcttcaagccatatcccttctaacactgaatccaagttttgaagatgacactgatgtcaatacaaatccagaactttctgtaccatgtattcaagctccttatctcaaatcctaggtatagggcttcaagcacagggcacagggcagagttagaaggtatccaatctcaggggatgaaataggtcctgaagtttaaggcaggccaggcacagtggctcacacctgtaatcctagcactttgggaggctgaggtgggtggatcacctgaggtcaggagtttgagacaagcctggtcaacatggtgaaaccctgtctccactaaaaatacaaaaattagccaggcatggtggcacacgcctgtaatccctgctacttgggaatctgaggcagaagaatcacttggacccgggacggggaggttacagtgagccaagatcgtgccactgtgctccagcctggctaacagaacaagactccgcctcaaaaaaataaaaataaaaataaaaaagtttaaggtaaaaataggagatgtgcatgttacagtggagggtggatctccccccaggactgattcccctaactgatctttgatgccagaagataccctgttaagtcctcctggatggcccaaagttgttccagatatagcccagtggctgggaattggtagtttgtcaagttgctaggatgacaatcgctatttactgtgaaagggtatattccaggcagctgagggcagggaaaacagtcagtgattattggcttgtctctttgctctgaacatcatcggcaaggtttcacgagtcttagctcttcctgtacttctcccctaccattagtcatcatcagttttacccacctagacaggtgcttactagggacaggatggtagctgagcctttcggaacagggttagcttggcagccacctgatatcctagcgtacaatataggaaaggtctataagtgggttgtggtcccctcacagctccgggggcttggcatagggcttggattagtcagagtgagggggaaagtgtggccagttttccaacagtggtaggctgcagcatttcctagtagaagatgtgagtgggtatctcaaacgaggtatccatgaacaaaacggccatgtgctccatgcctccctttctgctgccaggcctattctacctgggttaggtccttctctaggctgggtcctgccaggcagggtaattgggtagcaagttccagaattgattaaaaagaatatttggatttgaaataccattttaacattggaatgtgaaagacttgtggaatatgtgtctagatcactaggttcttaaatttttgggatcacatatctctttgagaatgtgaagaaaaccataggccactgttaagacttatgcagtgatggaaatgttctatatttgcaccatccaatgcgatagccatgcatggctatcaatcacttgaaatgtggctagtgtgactgagagtatttaatcttatttaattttaattgatttaaattgaaatagacacacgtggctagcagctatcatattgaatggcacagccatagacttttctcagaaaaatacaagattttgcatagaatttcatagagatttgaagcccacttatggattctgggttaaaaaataagacccaaacttcttgtaattctaagactacaactaagagctaatgtttttgatgacttactatgtgccaggcattatacatctatgctaattcatttaatcatcataatctcttttacagagaaggaaactgaggcacaaagagattacctaacttgtccaacattacacaacaaactgtgacttgaacccagctgttctgacttcagagttcatactcttacccatgttaggttgttccttgttaatttaacattttctgcagtagtttaaaaagataaaagagactatccaagttgtagaaatcgtcaatatgtgaaccagtattgcagtttttaaaataatttacctttgaatgactcacttacaacaagcataattttttaatttgtaaaaatgttaatgcagcagagctagcataactacaaatgcattttataaaatgtcaaaaagtgaatggaacaaaattatatccatagacacacacacacacaagggttcacaactgccgcatggcacatgtaaattaaaaatgttcaagtgttgttgttgttttttttcttagagacaaagtctcactatgttgcccagtctgctctcgaactcctgggctcaagcaatcctcccacctcggcctcccaaatgttggcagtacaggcgtgacccactgtgcctggccacaagggttttgggtaaagacaaaaatgggtaattgttcatacaatgtaaaactgcccactggtgaacagttttcaatatgtgaaaaaattataacttcaagtctttgtttctcaccaaatggctgtcctggtaatttgttgtttcaaataattccttttcaatgaaatctttactcccagatcaaagtggataggaaatgttgccagcttatctttaagctggacaaacgaatccttgaatttaataagatttcaggcacctaagtgcaggatacttaatcataaaaaagcttcaggggactctcctggaactgtgcctacagggaagcatcattccatagccagctccgggctggtaatctggcgttggaggtacatactagttgatgcacctagactcatgcctctagggaaggcagtaaatggcagtcctggtagtgccctaggagagaaaatgacaggactccaaatttacttttaaagggggctatgagggatggcctatctttctgtcttctccattacaggtccaaaaactaggcagagttttcaaaaacatttctaggaaggataaaatttggagaagaggatttgtaagcataaagtaataacatctttcttggcttctgccagttaaaggccaccatgatttccactcttgttcctcagggccatggaaatggatcagagcaacaaaaaaatagctgctggaatcttcacagccttgtataaagactgcatgttctctgtgaactgttcccttcaacaaagacatggcaaactcagcgtgactactgtttataagtaatcccccatgctgagggctaggctggatgaggctgggttgttacaggggtcccagaagctctcctgtattaggtacagaccaggaagtggctggcttaagagcacagagctgggatcaaactttattaaaacacactggcccaccccaccaggcatgtagattctcagagcaagcaaacaagacatactaaaacatacaaatgcataactcattttcctggtgtttcaaatatttattttaggtagtaaaggcttttgtcgttctaaatcctgattacaagtcacatgatcaagaacaactaataaaggagattcaggagcatgttaaaaaaactacagcaccttacaaatatcccagaaaggtaggcatcctaattataacgaatatttgctcagtgttgtggacaatttcaagtgtttatttttacattttaatgaatattttcttcacacatgctgcaccacatgtcccaaactgaactgatgacatatgggtaagaatcagaatctttgagattaaaatgaaaccctgaacctattttgtttggtcctttggcttactggactcacagtaaatacttaatatcaagacaactttcctaacaatacccttttccctattttggctgttacccaaaacccattccaaagactattctaattcttccacctagaattcataatcaaactgctatataattggctttatgtaaagataaaaatttccaggctaattttcttccccttgatgccaacaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctccacattagtgtcaatgttcctatcatttcttaatataaaaataataccatcaattgctgattaatttttaaatgtatagtatagaagcagtttctgaaccagatctctgctacataggttttcaaactttagttgactaattcttctgatatgttgatatacaaatcagaaccaatgttcaagcctgaaataaaactaaagaacttataaaagtttttagaaaaatataaaatatcagttagaagattatgataatctcaaagtacaagaatctacctgaaaatagactagggatttttattagtcacattttttgcaaataatttaaaaatagtttagacttgtttcaaggtctaactataaaagaaggatcatatactattgttgcttattatatgtaatctaataaatactgtttacaaaagattacacttgtggttcctgaagaaagtatggtaaatgcagtaaacattaatatataaaataaaaataaaatagtgtaagatgttatcagaatactcatgtttggaaattcaaggaacaattaggattcatacatgaaaggttatcaattcctcattgaaggcctgagtctcaaagaatttttggtggaaatacttaaatttctgtcacaaatatggcttgtttctggagaactaaaagtgagtccccctgtggaatgagatggaaccatgctgttggctctttccttttgaagtgtttgttcccatttgaaataaccacaacattttctgttttcttggtatttcccgatagggcaacaatagaagacttttccatggttcggtccattattagaaacaacaagtctcttagatctccgaccacacttgcataatggaggtgtcattttcccactcttccatggctcttgtaggttaactgtagaagttaatatagatgggagacgcctccaggaagaacttcttactggggagcaatcagatgatgtaggcttttcttcatgaatagtgaagggttgtttttttgctggtgggaaagcttggggactgcatggattccttttggtaccacctgaaagaagaggatgtttccccaaaactaaaggatgagacatattggcattaactctgttgaaggtacttgatttgtgttcaggtaacttaaaggcagaaatatctgaacctggatctttggcttcttttacattataaatagtagtgtgaggactcttgtacacaatagacttagaagtctcagatttttgaggagtttcctctatgtctccaaagttttcatgacttgacatttccaattctttcaaaaccattaatctttctccagaattaaatgaaatctctaagtctgagtcactaatgggaactgtacagtctacgttttcctcaggctgagatgctggcagtaaaaccacatcctcccaatcagccaacacaggtaaacagtccagagtagagctcatttccaaatcagaaacatgatgaacagttggaacggtggtagaaacaagtaccaattctgaaccaactgttgaagccttagatttggtattaaatgcaagatgttcattttttccttgcttttgcatatagataggtgaattcaaggtaggagactgcaactgccccacagaagtagaggacttagtattaaaaagaggtaaggaacttttgacattgtgaagacttgcttttatattgttttttacttgtaattgatcctgttgtgcctttataggagaatttgcacaaattgacttcatttgaactttttcatgaggatttattatatttttaggctccttattatatatgctgggaccctggatgctaatgttacaggcagacatttcttcaacttgaattgtattcaaatttctggccagaatgctgaaattcttcttagtgggaacctatgattccacagacaaatgcaacagctttagaaactgtgcattcgttaatttcttcagtatacagttttatgacaaaaaagagaaatgtcattgatttataaatgactgcacacattaaatctacgtttcaaagaacgtatgactgtttatgaagtttgagatgacagaataaaaaggcaagacactactaaccttgttcaacgaccttgtaattttcattacacaaccatctctgatcattttccaagcaagaagggcagtattccgagaatcgtccaaccctgaggatacagatatcaaacactgaatttagtggtactagtactatttccttagtactaaagaaataacttaaaaagaaaaacaccacttgtgtagaaattggaacacagttttagttttatgaccatctactaattttaatcatgataaactggtcttggaagtggaaggctatggcagcattaccagtgaaagacaagctcgtccacatttatagaggaggatatgaaaatgtattagacagttccccaaaatgtggccagcgttctgcaggaaccaggatttgtgaataatctaatagtcttgttcagttttttcactagtccattctattatttgagcacttgtttaatctccatttgatttggctcattcttttcattcttcttagcaactagaaagccactagatggcagtgtatcttacaatagtttatgaaagtggtaatttgaaagtcttagaaacaatgtgaattgtttagattaggagttttttttttttaggctgaagatatcccttactaatgacattaccaaaaaatgaaattcatatgaagtattttttaaaagtcaaatggcttacataatttttaatgtatactaaccagaatgttctcgtcctgagaattctattcctacttcctgcaaggcaccacttagtccttttggttttctcctatagaaaagctaaccaataaaaaaagatatatttaaaagaagattactattttaaagactatgtattaaacacttttcataatttttagttctattagatttagaatgtgcttattttttgtgtgttgtttttaaatactttaagaaatgcatttatgtgaccagtacaaaagaaagtatcttctttgcagaaacccatgcccatgtgtaggataaaagttaatcatttttccatagaaaaaagtaaacatgcccccattttttaccattaccttgtaagttgctctgagatcaatccaagaatttaaaaacacaggttttaacagctgctttcttttacactcatactccaggcaaacccccaagtcccagtctgcattaggtacattaaaatagaacaaagtcaatgatgccagcattttttacttatgctgccaccatttacaaatagaatgctagaagatcatataaaatagaacagtatgatttcattgctctgctaatatctaaaaattattcactttatataacttactattaacaagttaggttgatgactaaatttcaaaatgatttcttaaacacccagtaaaaccttatttcagaaagaagagtaacatgttaaattacaaggactatattttctatattctaggaaaatattaatgttattgagaaaccaaacattttatagtaactggaaaccaaatatgactatcaatgctatcttatcaatgacacagtattgctattaatgactattaacagcaatgctctaacacagtcatacaaaaaacctactttaaatggctcattttttttttcttttaagtgtcaaagcataaaagcaaaggatgttgagctgatgaagactgtagaaaatagcataagagtgttcactaaatcatctttgcttaattcttaacagtggaactctagaaacatttttttaagttcaggcttaatattttaaggtatcccaaaaggttaatttaaaaaatatgtattaatttacttttcttggctaacatctgctaggcatttaaattttttttcctagcccagaagattaacaaacataattctaggttagcaagtataaaactagaaataaagaattacatagtggtaatgctacccatctgtgattaataggtataacttattctttacctgaccaagtaacaaatgcacataattttacttcagaagcagaaggctctgaaatcccagtagcaaaaataatgttcttctgttgctgaatcttatgaatccatttacagaactgagataagcaaatcttcagagggactccttcatcaacttgagcctgagtagagagtcacaaaagctgaattcaacaatcaaattccattattatttagcatgttttataactgtggagaaagattaatggttttaaaagaatcagaaatgccaagtcatgaaaacacagtgtactgtgggaagacataacaaagtggttctaactggcaaagagtttatttagtggaaagaggtaaaaacacgtgggaaagaaagaatatttagaacccaccaaggtaagaaagattaggttgataaaaactaaaatcacacagaaatatgatcattaagtccagactgacataaatcatagacaaatttgagtcacttaatttccataaaatcaatttgatcctcatttttataacattattcttcctttgctgtgtatttatttaatttttaaaatttatttttttttgagacgaggtcttgctttgttgcccagggtggagtgcagtggcatgatctcagctcactgcaacctccacctcctgggttcaagtgagtctcctgcctcagcctcccaagtagtgggaatcacaggtgtgtaacaccatgcctggctaatttttgtatttttagtagagacggggttttgccaagttggccaggctggtctcgaactcctgacctcagatgatccacccaccttggcctcccaaagtactgagattacaggtatgttcctttgctttttaaatcgagtcctgaggtgactcacgcctgtaatcccagcacctcgggaggccaaggtgggcagatcacttgaggtcaggagttcgagaccagcctggccaacatagtgaaaccctgtctctattaaaaatataaaaattagccagatgtggtggtgtgtacctatagtcccagttactcaggaagctgaggcatgagaatcgcctgaacccaggaagcagaggttgcagtgagccccgccaccttactccagcctggccaacagagcatgcctttgtctgaaaaataaataaataaatacataaatcgagtcctgaatctggaataacactaatcttatttatttatttacttatttattcatttattttcagagacaaagtctgtcacccaggatagactgagattatacctccctgcagcctcaaactcctgggctcaagtggtcctcccacctcagcctcagcctcccaagaagctgggactacagacacatgccaccaagtcaggctaatttaaattttttttttttttttttttagagatggggttctcactatgttgtctaggttggtctcaaactcctggcctcaagcaattctcgaacatcagcctgcaaagtgctgggattacaggcataagccatcatgcctaacactaaataaatctaatttcaaatggtataataacttttattttctttttgaaactgacttctgaattttaagatttgcatcatacctgctttatgcctgtcaattccatgcaaaattctgaaagaattggatgttcctgaggttgaacataagcctggaactcagagtcaatctgtccagttgatgtgttcagcaacactgctggaaactcaactaaatgaaagaataatcaattgacagttgaataaataatttttaaattaatcctgtaatcatcctaaattaaacatgttaccattttaattaaacaaccagttttcagtaaaagcatactaaaatgaccaaagcagtgtgacataaaggttataataaagttatgctaaagtcaaaatattgaagttatgagcatgttgtcttaaaagaaaacaatataattaaataaatataaaaaccatatggaatataaaatttactttttttgcaaaggcatttttttcagtttctatgccattgaggtgttgtatgtaatataaaacaactattttatataataacacatttaggtatttgagattttgctcttttttattcaacataagttttgcattaaactaccaatgcatagaccatcctgttttcttaaacttttggctgattcagatctataaactttaaagtgactcatctagtgccagctttggccattcgtagcccagacttacttatttcctggctatggtggtgcttcccatcattccagcatgtcgattcaaaatcaatgacaattaagtagtcaaacaactgctctgcaaaagatcaagttgttcttatgctttaccagtgctgaaaatgcaaggctacaaaatgcaaagaaactaagcatactactcactggatttgcttcttccgagatttccatttgctggcgcaattgactttctcctaattaatccaagctgcctaaaaatgtgaagcaatccaaatatgatcaatgaactcattcacactcctgtttgagtaggctaccaaactaatggtactgggcaacaatctcattatttattgtgactgaggggaaatcgaactggactttggctttacctgcacaggcctcgaaagtacatatttgcaaattaggctaatttgttggttttgtttttgagacagggtcttgctctgtcacgtaggttgcagtgcagtggtatgatcaccactcactacagccttaatctcctgggctcaagcaatcctcccaccacagtctcctgactaagactacagatgcatgccaccacggcccattagttttaatttttttttttttttgaaggcagggcctcactatgttacccaggctcatctcgaactcctgagctccagcaatcctcccacctcagcccctcaaagtgctgggattacaggcctgagccactgtgtccagccaatttacactaattttatgttacccttgttttacagtaatactgagtaactcatttgagttcctacaatcatttgattgtagaggtaaaaatgcactgaaaatcttatttttccccctgcattttttaagctcttgctatgtgtacagtgcagttttaagaagacaagacaatgtaggacatggttcagtcttccagtttaaaaatctgggtaaagaaacaaaagatagggccaggtaaagtggctcatgcctgtaatcccagcactttgggaggccaaggcaggtggattgcttgagctccggagttcgagaccagcctgagcaacatggtgaaaccccgtctctacaaaaattataaaacctagctggggcgtgatggtgcatacctgtagtcccaactactcaggaggctaaggtgggaggattgcttgagcccgggaggtggagactgcagtgagccgagatcatgccactgcactccagcatgggcaacagagcgagaccctgtctcaaaaaaataaataaataaaataaaataagaaaaaaagagaagagcttactgaggtcttaagtgcaagtaaaacaaactacttggtattagcaggtagagttttaactaggcagacacctcctgtagttttctgtgtttgctaagagtgggaagtgccaggatttgggaataataaatatcatttattgactgcttactacatagcaggtactaaaattaaactaagatgatggcctcctttaatcctcaacaagtgtagtagctagaaacttttcctacctatattttatggatgagaaaactgattcttaatttgccaaagaacatagctttggtatgtgaacccaagactgtccaattctgaagctcatgctatttgctattatattacatctttctagtaatcagaaatatgcacagcgcatccaggaatcagggaggacacaataattcatattgtgaattaaaaggatcactaggccaggcaccgtggctcacacctgtaaccccagcactttgggaggttgaggcgggtggatcacctgaggtcgggagttcgagaacagtctgaccaacatagagaaaccccatttctactaaaaatacaaaattagctgggtgtggtggtgcatgcctgtaatcccagctacttgggaggctgaggcaggagaatgacttgaacccgggaggcagaggttatggtaagccgagatcgcaccactgcactctagcctaggcaacaaaactccgtctcaaaaaaaaaaaaaaagatcactagaaaatgggtttgtaaaaagtagaggttcctcttcaaagacttccttccccgtctaattaggaataaatagtaacttctcttagagcaaaatttattcaaagacctgtgctaacattcttaaatatctgctagatataataaagaaatcaatgtactttatgttcttagctcccacaatttagcctaaatatttgccctggcatgcttatactggtccaatcaaacattaggtcatagcctgttcctcttccttacttaaaagtgtttttacctttctcagcattccacaagttacttccttcttcctttgttctcctctgcctttgcctcttttaaaaagttctatgttgctagtcagtcgggacaaatacagaatgtgaggtcccgttccagccaaaggaaaccggacacagcagtagggtggacgcgccacgttataaatgaccctgtctcctttgttcagtgtactctcctggcaaaactgctggcgagtgtaccctttctgcaggaagtaaaaatggccttactaaataaattaaatttaagtttaagttctatttctttacagcaccgaggaacgagcatttcgaacaggttgaacaccttgacagattcagtgtgtggcctgcctgagacctccaaccagtctgcagggcactgtcacgtccagtcgtttcccaaggcctaaaataggcaggcactggctcaaggccacacagtcaaggccccagggttcgtccgcctcgggctcctgtcaccctcgggtagaaggtggcccaaggctgaagaccgaggtccagggaggcgcctttccaaccgtgccagagagggcaggtcgcagacgccggggctgcggggaatagaggccctcaccgcagatgccacctgccgtgccctgctctgcggccaacgccagcgctggacccggagctacccgcccccgacccggaactccctcgagtaccgcgcgagccgcttggtcgccattcccgacactccttgcttttccaagtccagctgccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccggtaaccgatgcggacggtaaagccgtttgggttagagcggcgcgggtgtccagtccgcggaacggggagatcgttggcaccttcgcttttttaggggaacggggatagttcggtaaactgaattgagaagcggatccgagggaggttgaaagctgtcaagcccgtgtagctctcccgctaggaggcggcacgcgggggaataggggcgctggagtttccccagctctacctcatctttctccacagccatggagccagagagggaagggaccgagagacaccccaggaaggtcagggaaagcaggcaggccccaaataagctggtcggggcagctgaggcgatgaaagccggttgggatctcgaggagagtcagcccgaggccaaggtgagcaacggggatcccgagcaggcggccctaggcggtttggagctcccggaccctcgcccaaccgccgtcgggggcactggattcgggcgggctctccgccctggcctctccgaacctgatccctgatcattaaaatgggaatgagtgtaataccaccttcctgcaacaaggctgtcattggctgtcactgggatagtgagtcggccgagtgcggtggctcatgcctgtaattccagcactttgggaggccgaggcgggcggatcacgaggtcaggagttcgagaccagccttgtcaacatggagaaatccccgtctctaccaaaaacacacacacaaaattagccaggcgtggtagtgggtgactgtaatcccacctacttgggaggctgaggcaggagaatcgctagaacccaggaaccagaggttgcaatgagccaagaccacgccattacactccaccctggacaacaagaaagaaatcacgtctcagaaaaaaaaaaaaaaaaaaaaaaactgggatggtgggccgggtgcagtggctcacgcctgtaatcccagcagtttgggaggccaaggcgggagcatcatttgaggccaggaattcaagaccagcctgggcaatatagcaaggaccccatctcttaaaaaaaaaaaacaaaaaacaaaacaaaaaaaaaactgcctgtacataataggaatgttcatcgatatcctggggcacaaaaatacaattccttgccctcgtgcagtttacattccagtagggcgggggtccccaaccccctgtgcacagactagtacctgcctgtccatggggtccccaacccactgtccacagctggcctgttaggaaccgggccacaaagcagcaggaggtgagcggtggccgatagaacgttaccccctgagctccacctaggcattagattctcataggaatgtgccaaacctattgtgagccctattgtgaactttgcatacgagggtcctaggtggcatgctgcttatgagactctaatgataaatgtaatgcacttgaatcaccccgaaaccatccccccagcccttctcccagtcagtggaaagattatctaacacgaaaccggtccctggtgccaacggttggggaccgctgcaataggggaataaaaaggctgattatccctatcatccttaccatttactgagaactaaatatacttcattcatcccttcagtcgttcattgggcttttttgtttgtttttgtgtttgagacagggtctctgctctgctggactcaggctggactacagtggtgtgacaaggatcctcctgtctctgcctcttacaggcatgagccactgcacccagctattcattggtttttattgtctgccatgtgctggggcactgacctaggtgcttggggtacatcagtgaatcaagttcactgccctagtaggtcttatattctagtgggcagagacaaatgataaaaataagttataatatgtgagagagggattagggatgtgatttttttttttttttttttttttgaggtggagtctccctctgttgcccaggctggatttggctcactgcaacttttgcctcccaggttgaagtgatcctcccacctcagttccaccaattagatgggactacagatgtgtgccactgtgccagctaatttttcttttttttgtagagacggggttttgccatgttgcccaggctggtcttgaactcctggacttaagcgatctgtccaccttggcctctgcaagttctgggattacaggcatgagccactgcttttttttgtttttttttcgtttgtttttttttaaagagagacagggtctccaactcctgggatcaggagattcacctgcctcagcctcccatagtgctggggattacatgtgtgagccactgcacccagctgaaaattttttttattaaagtgggattccagtttttttgcctatcaaatttgcaaaaaaatgtttaatgtttatgtggttagtgtaaggagattgacaatcacatattttgttatgttgaaacaatctcaaacttttagaaaagttgtaagaatagtatcaaaacctcccctcaaccaacatttgaaagtagttgctgacacaatggtctttttctacccaccctcaagatattttattatatattctctataaacctacataatcacaatgcaaccatcaaaattggaaattaccatggatatatcatgaccatctactcctcagatgccatccaaattttctgtagttgtttgaataacgctttttagcaataagatccagtctagaattgtgttaaatttaattgtcatgtctccatcaaacagttccttagtcttcccttgatattcatgactttactgcatttgaataatcctgggccaattattttgttgaatgtcccttaaattagatttgtctgtttcttcattgattagattcaggttatatacatctttagcaggaatatcacaggagtgatactctgctcccttgcagattgtacacaatttgatttgtcccattattggtgatattaaccttgataactagattaagatagtttctactaaagttctctaaagttatctttttctctgtgtaattttcattcttatttttttgagacaggatcttgctatattgcccaggctagtctggaattcctgggctaaagcaatcctcccacctcagcctcagtgtagctgaggttacaggcccaagccactgctcccagctgtctgtaatgtgcttcctcaaacactttgggcttatgcatttacttttttatcagtatgatgaactcagtggtacctattttgttcagtgtgttactatcttttactggattgtgatgctttaaatatccaagattttgtcattaagctagcttctgtggccttttgacatgacaacatcattctttgagcatgtcattactttctggcacaagaagatattccaggctcatatgtgctttccctgccccaagcctggaatcagtcatttctcttagggtacctggttctttttagtgtagaatgatatttagatttgggtgctatggtgatgttaatacagatgcttcttcacttaaaataagattacgtcccaataaatccatcgtaaattgaaaattttgtaagttgaaagtgtatacacacacacatacttacatttaaatatttttctgtattttacttatgtgaattcacatcagtatctccactttaatccaaatccagtaatacagggttcattctattcattctagttttctcctttttttttttcttttgagacaaaagtcttgccctgtcacccaggctggagtgcagtggcatgatctctgctcattgcaacctctccctcccagcgattctcctacctcagcctcctgagtagctgggattacaggcacccaccaccacgcctggctaatttttgtacatttagtggagatggcgtttgaccatgttggctggtctcaaattcatgacctcaagtgatctgcccacctcggcttcgcaaagtgttgggattacaggcgtgaaccaccgcgcccagtccattttcatatttgtaacttccttcactaacaatgagaaacccgacacccaacatcttcagtatatttgatcaatccttattgctgccgctgacccaccctcacaccctcttgactctgcttaggctctgtcaccctgcactggctccatcaccttgtaccaggtcatcttcctttgtgagcaccctcatcctatgacaggtggctgccaccatccctctcaggtttataccctcatcctgttcaggctttaaaccctgcaacaggccactactgtccctcagcattgatgccctccttaccctaaatagtttctgacatctgatgtcaggactcactgccctcccttccttcctgtatgggtgacgtccttgtgctgctgaggctttgacaccccacaccagagcaccctcctgcatgaatgtcctcagcttctgctcctagtcctggactgtctcctctacaggacaccttcctcacccaactcaggctcttgacatcccatgcctggcaaccagggttactcaccgccatatagactccatcttgctcagtctcaccttattaatctcatgtttttatttggtaaaaacaaactggcatattctttcaggagttcatttgaaccaggaattgatcctaagaaagtagatagatgtacaaaggtgtctgtacaaggatgttcatcataatgttgtttgtaatttaaaaaaccagtgttatcaatagggaatgtttttcagatatattataaattttcaggtaaatttagaaaatggactattattcaagtattaaaattgattttttttaactgatatggaaagatacagcttaagttcgggagtagggagttggtttcaaaaaagaatgattgataaaatccactgcgggctgtatagtatagagataagcctgcattccagtcttggttctatcatttatctgtctctccaatttatctgtaaaatggggatgatagtagtacacacttacaaagttgtgagaattaaatgatttaatgcatgtaaaatgatcagaactgtgtttcgctaatgtaagagtttaacattagcttaaggccatgggaatacattagcaataatatctaatgtttattaagtacttatgtcaggtactagcctcagtacattgtacttgaactatttcattggtcctcccaattatttaatgagataaaattataattactctctagatgaggaaactgagtcttagaaaggctatggcactggtccaagatgatgatgatggtccaaggctatggcactggtccaagcctggtgtttgaactcaggtagtatgactagggcttgagcttctaaccgctatgctctgctgcctcgcagaccaaaacgaaagtggtgattacctctaagttgtacttttattttaattatctctgaggtgacttttattttcgtttctctgtatcatttattttacaattctctgttaatgagtcttttgtaacaaacacgaattactttattaaacaaatataggctgggcgtggtgactataggccgggcgtggtggctcatgcttgtaatcccagcactttgggaggctgaggagagcagatcgcttgagctcaggagctcgagaccagcctgggcaacatggtaaaaactcatctctaccaaaaatacaaaaaaaattagccaggtgtggtggcatacatctgtggtcccagctactcaggacactgaggcaggaggatcgcttgagcctgggaggcagaggttgtagtgagcaaagatagcgccactgtactccatcctgggtgacagagtgagactctgtctcagaaaagaaaaaaacaagtataagttcaaagcctttttaaaggggttgggagctttgctgaactcttgttgcccaggggataaattctgattcattagcttaggccgcattgatctatgatctggctcctgcttccctctcctcatacctccactactatgcaacatgcaatcctggctccttgccaaaccatactacatgttgaatgcgatgttccctccaacatggcattgttttcaaggctcagcctcagtattttcatctcagtagccttccccaaactctctaacccctaaggcagttagactccttgttctcatagctttgtaatagcacttacccacactgtgttggaattagctattgctttctctccctagtagaatggactctttgagagcatgaattatgctttatttatcctattcctagcatgtaaccaagtatctataattcagttttgtgtcaatgataattactttattaataatgtcatacctaccacatattgttattttaggccatcattttcaattaattagcacttccttatgttagaatatacctgtatgttaaagtaatcagaagctagaataatttaacttgctttgttggtattcttgataaccaataatggcttgctacgccctgattaatctttgcagaaagcccgcttatctaccattttatttactgacaactgtgaagtaacccatgaccagctgtgtgaattgctgaagtatgcagttctgggcaaatccaatgttccaaaacccaggtatgagatgaatttaaatggtgggtattgaccagcggtttcttttttttttttttttttttacctctcccaagctccatcattcaaaccagaggtttcaaactggcttatcgacagtatttttttgctatgcagcatgtcctgaattttttatgatggctgccaagtgttaattctggaaattcctatataaaaatctacattttcttcttccaaaaactcaaagatggcagctatccctatattcccacatggcaataatttgtcaaagctgagtggtggtctccccctttatatgggacatgtatactacaatgtcctacctggcctgcttcccatatttacagtatctgtctggctactatagatattttagtttgtttcccgtgttgcagactcagctgaaataacaatgatctgtgaagaattccagttaatcttttttctttcttttacaaataaaaggcaaagagagccccggcatagtggctcacagttataatcccagcactttgggaggccaaggtgtgaggatcacttgagtcccagagtctgagaccagcctgggcaacatagcgagactcaggccctacaaaaaaaaaagagaatcttactgttctgatattgttggtgccattattaagtgtcttatgaaaaatattttgtatgtatgcaaataatacacacgtctttctgggggaggttgttatgaattggctagctacttcgagaactgtcttctccatcaacaattacagccatcagtctgtcagtttatctaaaactgtttttttttttttttggtaggttttatgtctctattgcaactacccaacttggccattgtagcccaaagcagccatacataacacatagacaaataagcatgactgtagttcaatagtcttatttacaaaaatgggtggagcaggatttgacatttttttggtgggggatggagcctcgctctgtcacctaggctggagtgcagtggcacgatctccgctcaatgcaacctccacctcccaggttcaagtgatcctcttgcctcagcctccagagtagctaggattgtaggctcatacaaccaggcccagctaatttttttgtattttttttagtagagatggggtttcgccatgttgcccaggttggtcttgaactcctgacctcaagtcatccacctgcctcggcctcccaaagtgctgggattacaggcgtgagtcaccgtgcccagcgaaaactgaatttcttaaagccagccatttgattccctggtttaggaaggaccgcagagtaggttggtatcttagggatgactttgtaaagtgagcttagttctgattccaaacaaaccttaataggactgtgaatttaaatgcattgcattttgcttggtattttactggatttgaatacaacaagtatttatctctagggatctttatttgaattctgtgcaataatggctgtcttccagttccaggcagacggtgaatggtgataaattctattaactctcactcactgcttttcctgcgccttctcccctatttcccctctatatgactgtaactgacttaaggccatctgtcttaactgtgttggtttgatttcttggcagctggtgccagctttttcatcaaaaccacctaaacaacgtagtggtttttgttctgcagggaatgagtcagctacacttttacaggttctatttggagtttggatgtcttcgaaaagcattcagacatgtaagttaagaatactttgtactaggggctgagtctgttttcccattctgagactaatacatgtgtcagggaccatgctccttggcaacctaactgaacaaacagtaggggatatagaaagcaaaaagaccttagaggcctcatgtagatttgtctctgattttctttggaaatctaggcaaactcttattcccaggttataatctgtagctcctaggttgatattgttctattttatttgggctatggtgttttcagaaattgtaaaatataatacaagctgagttttctacctctctttaaaaaaatcgcaagattgggcacccttaaaacagtatatggaactgaatagcagttgtcatctttaaaaagaggcacctgctgtccattttcccgtagcctcttccatttcctagtgacccatttcatccatttattcctgaaggcatttgagttggtgagccctaatttaacctccctgggtcaccattttttttgctttcatttattgagcacttcctgtgtatcaggctctctattaaccacggaccacctgctacacgtatcatctttaattatcacaatagtcttataaaatagatactttttaatttccattttgtacatgagaaactgagtaacttgcccgagttccagctagtaagtggtagggctgaaatttaagcccaggtgaacctgaagctgaagctctcaacctttttgccgtgtgataccatctattctgatggcaatggcatgctttccaatgaaataatagatttggaagaactttgaaaatacaaagggacttttcttgtctaagttgtatatttctgtaaagtttgtctattttacaatatataatcatagggatcagttagtgttgtgtggcttcatttacttagtcacttttctatattaaggaaacagttcttattttaaaatgctaacaattactgtctagaactttcaaagcactgaggtgacaataaaagtccaggcctttcacagtattttagctgttttcaaccatttttgtaaaacctgttaatatattttcagaaattccgcttgcctccaccatcatctgattttctagctgatgttgttgggctacaaactgaacaaagagctggagatctgcccaagacaatggaaggtatagctatgatgctggtttgatgctttgctcactctaaaagatacggatatgattgtaagtaggtttagcacaacaaaactcaattctaactagcttaagcacaaaaacaattttttttttttttgaaacgggggtctcactcttgtcacccaggtgtgagtgcagtggcgtgatcacacggctcactgcagccttgacctcccagactcaagcagtccttccacctcagcctcctgagtagctggggaactaccagca

SEQ ID NO: 341 - DNA, 25477 bp, Homo sapiens
ggctggagatgctatcctgaagaggaggtgactcagaggccagcagaggtgtcctcaaaaagctgaaggctggcattagcacaaggaattggactaatgtcttatataataaagaggctgacctagaaccagttaccacattcatgcttcagggaattagattcagccttgatagagaaagaactggctaatagttatagctgtccagtggtgaagcctcactgctgaagaatttcaaacagaagtggccaagcttcagattaaaatttggaccaggagggacactagagtcctcaagtccctgctgccattgggccccacagccactttcagagaacaagaaagattggccagggatgggagggaagggccagagtcagacttcactcttgtatgtgcctcctgccccataattcaggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagctattcagtttgtgtattttgttatagtagcccaaatggactaggcagttggcctctgccacatgactgagtttatgatatgttaaaaatactcataaaacagtgtctttgtctacagagggcttacactgtgggatagaagggaatagtaccccatcctataacacaattaaagcagggtatataaaaatttcccacaggatcctactgggctcagaaataagtgaccgagtataatgttgccagagttgcagatatttgtttttaattcatcggtctctgaaatctttctctttaataacacataatgactccgttttagtctcatattaatacttttttctatgcttggacttctattgtacattctcagccaatgagagctggcctggcaggctctataataaccttaactcaatcagttagcacatcattttatcatgacctcagccagtggctgttctaccatgttattctgaattacatggtgtgattttctccactgtggcctttctttgtgccatttattccgtgcagttttgacccaaaatgatttacaagagacatgcacatgatcattctagacataccacaaagaaacaaagacatagaatcatgccgatggtaaaatgagagttttatggtagttcttgccaccttcgagggaaaaaaaaaaaagatcaggaggcatctgggaattggtagaagtctgtaaacaacactacagcctgagaggactgatttacaattgtgtgaatgggagttgcaagaatgaccagaactgtcatgactttgatggacttgaaaaaatggaagctcagttgccaatgtaccatggtggatgtgtctccaaagatactatgttataaccactctacatggagttgatttcagctaatgctcgcatttgcatgaatgcatcctgcaagctcctgctaaatggggaattcatttacagatagtagaagctatcagagatctgggaaagaaaagatggatgcagctggctgagataaatgtaatctctgtacacctcatccatgtgtatctgtgcacctctatcaccacactgcattttaattttttattactcatttttgttcaccagagggtgaggtctttgagaatactcctgagctctttgttccatgttgtgtcattgatgtctagtataatgaggcatatgtaagttctcagtaaattttgtttagttgaatcgagttgggccagcaaaataagggaaaacatcttgaagaggatgggaatgaagctggaccttaaaggatgaatgtcatgtctggcatcagctaaatctccagactctatccaggggacccagcctcagtcaaggacttagaaacctcagggagaggatctatcaacagggatgaggaaggcaagaacagagctaaaagaatgagagagagagatagggagagcaagcatttacccgtctctttctgtctagcctggggaggttggagagggagtagggaagaggaatcgttacaatggatctggtttatggcttgtgccatttaggattctgtaattgacagaggtcccaatgcagctatgctcaacattgtctctgaaataaacattagatagcaagcacatgaaaaggaaaactgttctccgctcacaatacctctgacatgaaacatatggattcccataccaagtttttatctgcttctcagtggaaaccaactagatgttctacaatttatcgattctggctccaactacccagagtcagcacagaccccataggttaaggggtcagtcccacatgactgctctcacttcaaaagccaattgcaaatcccaggcttctggtacttgacaccgaccagctataagtcagaggttctcacaactccttgggttcaataatttgctagaatggctcacaaaacttgggaaaacagtttacttaacagccaatgacgatatacatagggcaaggtatgtgggaagaggtgcagagtttgcacgctctctgggtgtgccaccctccagcttctccgtgtgttcactgatctggaagcccttagaactccaccatttagggtttttaatgaaggcttcattacacaggcatgattgattaaatcattggcaattggtgattcactcaaactccagcccttttctcctccaggaggtcaaggtgagttttccacaccaagcaattctctaattctcagcagaaaccagttagatgttgtgtaatttaccaattcttactctaactacccagagttagcacagacccctgaaagttccaaccctctaattgcagagttaagagtcaccttattagcataaactcaggcatgattgaaggggctaattatacataacaagaaatactcatctcatccctatcactcaggaaatccccaggattttggtagctctctgccaaagagctacccaaaggggcagagaaaagtacatatttcttattgtgttacacacgtccattatcttgtaagttgaacagtgcatctgcatactctgtaacccagaaccccatgcctaggtggatgcgcccaagagaaaacttagcatatgcacgccagaagacaggtgtgataacgtttacagtaacaaagcttgtaaaagcaaaatttggtactgaaatgcctttcttttattgaaaagaagtcagtgcagatgtccaccaacaggaaaatgagtaaattaccatgttaatttgtttcaaaccatattaaacaccaaactctatataaataggatgttgtactaccagctatgcacttggaagtggggatgatgatgaacaagacaggaactcagggaatagatcgctcactggggactggagtgttcaggtgcatctcatgaagaagataatacatgggtggggccttgaaaaacatgacagatctacagaacaggagaagagaggaaaggacgttccagagtgggatgatgtaagcaagggcataaaggggaaaactggcatgcagatgtcagggaaaaagaaggcaaatcctttgaaacagagttcagcggaaggaaataataatggagaagtaaatagactacagaggctcttaaatgtgctatagaggctctttaaatgtccataagaaaattgatcgaattctgtaggtaaattttgagtaaaggaggaactcgtgaaaagtgatgtttaggatgattattctggcactctggtataaggtgaatggggcgactagaagagaggttgagggaggtggatttgaaggctgttgttctcatccagccttctgagacaagggccttggctagggacaggaggaatagagagtaatgatctgagaggtgttaacaggtctgggtgatcagatatggagtagcattgcacctcccaaacacaaagctctctgtacccagcccagtagcccaaggtagaaaaacttggttcagttacaacttagaagagactagggaagggataaaatgacctgctagaatcataggaggaagtttaaggagggtgtgttgggataggcctcaccctagtcctgtcttcttaaaagttttcttccctcttggtatcaaccttctcccttcccactggacaagaggagatgtggagaaatacggagagttacagcacagccttcctgccagagttccttcagacaggcactgttagttttcattaactatgtgtgaatttctcataaagctaaagacattcaatgtaaagaaatactctgctctctattctgaaattgtcctttgcactcctttggtatcgaaatgccttccttttgctgaaaagtttacattaaagaatataattttatgccgggcacggtggctcacgcctgtaatcccaacactttgggaggctgaggcgggcggatcacctgaggtctggagttcgagactagcctgaccaacatggagaaaccctgtttctactaaaaatacaaaactagctaggcatggtggcgcatgcctgtaatcccagctactcgggaggctgaggcaggagaattgcttgaatccaggaggcagaggttgtggtgagctgagattgcaccattgcactccagcctgggcaagaagagtgaaactccgtctaaaaaaaaaaaaaaaagaatagcaatagcaattttaaaaaatatattattatcagccctatcctgggttacagaaaataaaataagaataattttaaatgttcttatttaggaaaagaaaaatttgtttgataaaattacaaaggtaagaaacactgaatattgatgacaagagggaatgggagccacgtgaattgctggtgggtgtataagcttctgcagccacttttgagagtaatatcacggtattcaatctcttcctttgtttatgccacaaatacttacacagcacgtgctatgtgctgtcactgctgtaggtgatacatcagcaaaaaagaaaaaattcctgcctcaatggagcttacattctaatgggggaacctaccacaaacaaacaaatacaattccgggtggtgacaagtacattgaagagaaataaagcaaaatatggagccagcaaatgacagtgaggagatactattttagatagcacggttagcgaccatctctctgaggaagtaatatttgagtgaagtgaggaagtgaaacttacaaaaatctgggaggagaataagaatctttcaggcagaaagaacagcaagtgaggccctggagcaagactaagcatggaatgttccagcaactgttctaaacacaatgtggctagatcagagtgagtgagggggagagttgtaggaaatgaggccaagggtcagagaaaggcccgatttgtagggccctgtagaccatgggaaggtgtttggaacttattctgagggtacctatggggaattttgagagaaagtaacacaatatggttaacattttaaaagtatctctctagcgactcagtgaataaattactgtacaaaaagatcaatgtagcaggtagagtcatcaggacttgctgatgaattagatttgagttttggaatgagtgtgcatgtaactcatgaacataattctgcagtcttgctctcaggtgtgtatcccataaaggcgcttcagggctctgtagggaagcatcatgtccttaccagtactaacttacatgaaacttcctatgtgccaacccctgttctaagccctttacatatgttaattcatccagccctcacaatatgtaccaagaagtccattgtggaattgtctgtggtagctgagggtgggcagcaactaggatgttaggggaatggacaagtgcagtgtagcagaagcatagaatattagggcagtcatggctgggcgcagtggctcatgcctgtaatcccagcactttgggaggctgaggtgggtggatcacctgaggtcaggagtccaagaccagcctggccaacatggtgaaaccccatctctgctaaaaacacaaaattagccaggcgtggtgatgcacgcctgtaatcccagctactcaggaggctgaggcaggagaactgcttgaacccaggaggtggaggttgcagtgagctgatatcatgccattgcatgccagactgggtaataagagcaaaactgcgtctcaaaaaaaaagaatattagggcagtcaaaagcaataaacatgatgcatgtagagcaatctgaacaaatttgaaacatctgggattaatttttaaaagtagaagtgaatataatatctagaacacaatgccacttatgtaaattaacaacactaaatatttctcaaagctaaaaactgcatgttatacctaatgtaaatgacgagttaatgggtgcagcacaccaacatggcacatgtatacatatgtaacaaacctgcacgttgtgcacatgtaccctagaacttaaagcacaaaaaaaaatagcatgtatatgggaacacacagtaaacattttacagtgggtgcttatgtggaggggaggaggacaataatgtgggtgaaagtcaacaaggtaagacaataagagggggaacttgcaaagaccaataatgacagccggccatgagcagcatcttgaatccctgacaatcagagagataagagaacagattttggagacagacttctattcaaatcccagtttcatcatctcagtttcctcatatgcaaaattgggatattaataattcttcctcaaagggccttacaagaattaagtgcagtaatatctgtgaagcacttagcatagtgcctgccacatgccgagacactaaagtgagctgtcatcagcaacaacagcattagttcattactgtaattatcactgagaacactttatcaccagaatgcttatcaaatggtgacatatattgtccagatgttatgttgtgataggcctcaaataattgctcaagttacaaatgataatttctaaatttttctgcattgtaaaggagtgaagaattagaaattctggggaaaagtcctagatggagtaaaaagactcactttgggaaaaacttagaggagagcctagaataaataaatatttcgtgggaaatttttcaagtcaaattctgagcactgtataatatgaacagtatggatggttccagaggtttctagggacgactatacagttcacaaagttttggtgtactaaggtttcttctgaatcgagtaaaggggctgagatctgtgctctgggggatgagaagccaaaatagagccagcttgtgttgcctaagaggacagctgacaactgcattgcattcttaccattgaggtggtggcttggtgcagaagtcagacctctgtggcaggctgtggatcatgtgggaagccacacactggccctgagacgaggaattattaggatggaggggaagcacaagagtgctggtcagcccaggcactcctaaagcaggcaggtgatcatccctgttcccagtaattagttcttctctgcctcccctactcttgggcacattgtcaaatatgtccctactttgtttgaaatctacaggactctatctcttttatcaaaacctgcactcaaaacatgatctgaagtgaccagcataatttaaatgaccagtcacattttcctaagaggcatttgcatttttaaaaggggctagtccattaagcaaaatatgaggggactctcagagtggaacttcaggcatcagcaagaggggaagatactatcttcctgggagttgacagtacctgataattgatctccttcccatcagatttccaagggatcaaggtgccccggttctaaacaaccacaggtaaggacaggatagagtccaaggagacacactatcaggctggaaaattcattaagtatttacatgaaaattcaggttctcctcattgctcaggtacggtcacatggctcagaaagcacaagaagtagagccccgaggtcagatctgagaggcttctgaggggccgatgcagtgacttctctgctgcaggtcaggagttctggaactggggcgtggctggggaggggttgcagggaagggtgggaggaaggaagaaaagaacaagtgattggaagtgccacaggatgagctcattgggatgggtaggaaagaagagttttctaacttcttaagaatttaagaatttatgagaactcaagatttcaggaagggaggaagaagaaacacattgcatttctatccttgactggggaactagatgatagggatgtgaagggtggttggtgagtcatgccttttcgtctactcattgtggcaggatgtgagctctgggggcaggcaaccgaacactgacctctctaggtctcatgccaatgtctgtcatcaggagtgagcaggaaaaaggtccttaaggacatgaggccgtgtcttcctcagctgagccttgcagggctggctggaaggtggagaagggatgggatgggagtgggatgtcaatgggagcctgaagatggcggggtcatctgctggagcctggggttctatggggctctcttgtgctgtggagggcacaagttctgcaggccttcctttcagtagtcagggctggcctgagctgtgaggtggctgtagatgcggtagatgagacagtgcctggcacttgggatacctgatattcagcctgtctcccactggttctggtctgctatcttcaggaactaggagtgggtgggagaagcagcaatgtctcctagtactcagtggcatccactggccacattctttctctctgttccccatctcatgccagtgcatctccatccttctgcagctgctgcagtcagatccatcatgtggccactgacagcccttctgctcctgggtgagtccacagtgaggcagcagaagagctttgggtggtggagaatagggtggaccaaggtatggggagaggagggtgggtatccaatcctcagtttccaagtggttcattatctttttttggaggggtgaagaagaaggggctttctcagagcttgggaaaccaggggcagaagaagaaaaacaggttttgggaccattcagcctttcttgtcgtcaagagtctctctcctctcatcgccaatattctccttctccttcctcttccttctttcctgttctgcagttccaagcagtgggcaagctggtgagtcttataaatttctcatcccaattttctacagcttccactccaaccccctaagtgaccttttcaagtagactcctcacttcttggctgcgctgggatagtgtctcttcccactctcgtcaacccctgggactaaatttgcttgaaggcatttagaaatgggtgctggctgatggactggtagtctgtaacccaatgaatgtgatctcctctcctgcagggatgggttagtacatgggctggggcctgcgagctggggtttcctaagatttcccaaactcaggtcgtttctttgggcacctcaccttgattctctttgcatgctgccccctctcaccccactccccaccccagctactctggagaagcccatattgtctctacatccaccttggaccaccatcttcaaaggggagcgggtaactttgaagtgtgatggataccacccactgctcctggagctccagcccatcagcactctctggtatttgggccacctacttctgccctctcacaagaagagcattgaggtgcagacaccaggggtgtatcgatgccagacacggggagcacccgtcagtgaccccatccacctctctgtatccaatggtgagtggactgagcacgaggggagggggagcacgtgtctcctctggcaatactagtcctctggtgggagggaacactgggccaatcccaaggtgcaggaaacaagggccacactggggcctatcttaagtctctggagcaggtagggacctgcacggcactatgcgagagatgcagtaaggcatgcctagcccccaaggtccccttaccctcctgccatagtgtgaggcacagtgtgaacatttctgtttgtttctgagaccagctcagaagagcaaaggctccaaggacctggagtgctggacagagaactttagggggttggggagggagcagtaaaggaaattcaccaaacaggaaaggtgagtttccctggcagtctgagcatagatcaaggatctactctcagttgaacagtgtgatgcttctctgtgcctcagtgtccacatctgtaaagaagggacaataatagtatgtatctcttcggctgctctgaggattaaaagtgaattatgatttgctaaagaaaaaaagcagcaattgaactgagcacttactcaaagttttattgcagacgtgtatatgtgtacacaggagtcagctgagaaactgattctcgagatgcttgaagggttttaaaacaggataagaaaaataacaataatttgttcaataaagtacaggattgctgggcacggtggctcaagcctgtgatcccagcactttgggaggccaaggcgggcagatcacctgaggtcaggagttcaagaccagcctggccaacatggtgaaacactctctactaaaaaaaaaaaaaaaaaaaaaaatagctgggcatgatagcgggtgcctgtagtcccagctactcaggaggctgaggcatgagaattgtttgaacctgggaggcggaagttgcagtgagctgagatcgtgcactcctagccacaatttgtattcagaatttaaagcacatcactcaatgttcagattagcacttacacacacttcatattcatactctgtggtttcttgttcggaaatcattggtgatagcaataattatactgagtactataggagtaattactgcttacagattgggagtgcatgtggattgtggctattacttgcaggattctttctcaatgtacaacacctaaaatggcatctgctctgtgctagggctatgtaagcgtgctataatgatcacagggtaattatgaggtgctgtaggagatacctaaggctctcctggggtgtcagggatgttttctggaggagataaggtctaagcctagacatgcaggacaagcaggtgaacttaaacaggtgaaagagagtcttcttggctgaggaaatagcaggtacaaaagcctcgggctcagagcagggccagttctctcaacagttcagtatggctggaacttatcctgttaggagtggaagatgaggaaagtagagaggaaatggggcaggaatgaatactgccatggtgagggagaggtaagcaggacccagtcaggaggactctgacaccatcctaaggaggttatagttgattctcatggtcaaaaccctttgagggtggagccaagtctctggcatctttgctccctggctaagtgaaagaccagccatcccccttccttcccactcacctacaaatatatcttgcactatgaggctgctgggtgccaaccaccagggaaggcctgtccgctcaagaaagcagtgggaggccaggcccggtggctcacgcctgtaatcccaccactttgggaggccgaggtgggcgtatcacctgaggtcaggagttcaagaccagcctggccaagatggtgaaaccctgtctctactaaaaaatgcaaaaattagctgggtgtgatggcgcccaccggtaatcccagctactcgggaggctgaggcagaagaatcgcttgaacccaagaggtggaggttgcagtgaaccgagtttgtgccactgcactgcagcttgggcgacaagagcaagaccatgtctcaaaaaaagaaaaagaacaagaaaaaaagaaagaaaaagaaaagaaaagaaagcggtgggagatggcggggaagggagggagaggagttaagaggagaaagctggaaggctgtgagagtgggagatctccagggctggactttctgtggagtcaagcgtgtctgtggtgtctgtcgcagattggctgattctgcaagtgccctatgcgccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaaggtgggagagaccaggggccccgggagggaggcaaatgagcattgagaaattctgggacaggagctcggcgagaaaagaaggggcggaagttcaaatagctgccacttggagggtttctcttagactatggacgctgtctcctctcctttgccgtgaagcagcgcttgatccgccgcctgcttggaggctggtccctttccccgacgcacatcctggcttctcactctggctggggactcccacagagagggcagctctggcaggggcaggggccactgtgggactgggacgaaggagcgactccctagcgtcctgcaaggcaggcgcagcgtctcctattctaggctgcagaacccgagctgagtgtcagtcgggatgtgacatgaagcgtctggcctggtccctcttcctttcaagctttccccgtccctcgtggactcggtccccctgccccacatttcagaaggctccccttccccctccacgtggacacacggcctcctcccctccccccttggtctgtgggtctgcaaggagccctcgcgggaagcaggaaggagcggggtcgcggagcggtggacaagccggcgccgttgctccccgccctctccgtagagctgttccgggcgccggtgctgagggtgatgggtccgcgggaggcccgcggcgcggcgctgggtggggtggtgctgcgctgcgacacgcgcctgcacccgcagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggtgagtgcctgcacaccctcccggacgccgaccctggcggtcagccctgcttccgcctctcggcacccacgaatcacccccgccccctggttcccgtcccgccccccgcctttcccatctccccttcgccgccctcctcctcacccctcttccggccttccccatccccgcccaccgccctacgcccctcccccagcccagcgccgagaagaaccatgcaagccgcgcgtgactgggcgtaatgcattcacaggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagggggcggctaccgtcccctctgcaggctcattcctccttggtctcctgcttcccctcacgcgaatttctttcaaagccatctgtttgcatccttgtgttttgctgtggtttttaaaggagcgcccacgaagtgtagtggctgacgatttcaacctcacacagcagtttgtaaccgcaagcattctctttgaattctcacagaattcagcaagaagtagaaacctgttatttactacattgtgatttaactttggatgtgaatttagtcacccttagcccttcagataagcctagccagtacatatttcagcacaggcagtttttttggtatttaagtacattgaggtaactgagcacttgagaatattttagggtcaaagtgtaattattcataatgaatttactctgttgatattaaaaagacgttcagtcctattactgatgagtttacatcttcaaataaatcctgggttctatttagttttggcgagagaaagttgtttgtgtgggcctcccattccctggttaaaagggtcagagtctttgggaggctgaggcggggggggggggggaatcacctgaggtcaggagtccgagaccagcctggccaacatcgcgaaaccccgtctctactgaaaatacaaaaattagctgggcatggtggcaggcgcctgtaatcccagctacttgggaggctgaggcaggagaattgcttgaacctggaaggcggaggttgcagtaagccgagatcgtgccattgcactccagcctgggcaacaagagtgaaactccatctcaaaaaaaaaaaaaaaaaagggtcagagttctgttagacttaacccaggtgcaccccctgccccagtgcagctagacagactgatgggctgtggtagcagcaggcagactatgctaaccttagccgtatattaaataagtgtaccatttgcattgagaaatctttttgaagaaactttaagacaaatcctcaaaattgagttctcattcttagcagcttttttcttaagagcctttccaacatgaatacaccaagatacacacatgcacagatcagtatgccatcctgcatggtgactttactctcacttagttaaaagaagaaaagtgagaagccatttcaattgcaatttcatggttatgttcctggaaagtcccattttgatgggttttcccatctgcctactggagccatcaatcctctgcagagctagtgtgatttgtcctcaggaggcctcgttctcatcaggtccatatccttcttcagttaagtttcactgttaaggcttagagctgtaacaactgtaccctctcatcctttacttctgcttgatagatgttgcgtcacaacccgattttccatttctttctgagtgattaaccagaataatatcaacagccttcatcctattcttcttaatattgttcttcaccatattattattacaaagccactgaaattatacagagaggcaggcaggcaggcaggtgcacacataaattacactgcaatgtgataagtgctctatgaaacatgataggaattcagagaagaaagttgaatttttaaggaagagcaagaactaccacatggagatgtgagaaagattgagggtatggcaagtaggctgaggaagcaaagacacaaagaaatgaaagactgtagcgtgtttatggagctacaaataattgggagtggttggagaattatgtgtgtttatgtgtatctgtgtaggtgtattttagggaggaggtgacagagatgaatatggggaagtaggaaggaatcagaacatgaaagtcttgttaagaagtgctttagcctgttggatacttgggatggctatctgaaagcattcctgacatgaaggcatcaatatgtctaatctgaggaaatgctaacttaaaattagacaagaagaatcaaacttatctcagtggatctttgcttaactctgagagatatgtccaggtgcctataattcagttctggggtcttggtctacaagggcctttgtggctctgatttccagctttctgatgcaggctcatctcacttctcagaactctcttccaaggccacctttcctagctaactgcactctatttcagtgcccaggctcttttccccttctgattttgtttccctgagatttctgctttttttttttttttttttttttgagacggagtctcacatctcactctgtcacccaggctggagcaatctcagctcattgcaacctccgcctcccaggttcaagtgattcttccacctcagcctccccagtagctgggattacaggcacctgccatcatgccaggctaatttttgtatttttgtagagacggggtttcaccgtgttggccaggctggtcttgaactcctgacctcaggtgatccacctgcctcagcctcccaaagtgcagggattacaggcttgggccaccgcgcccggccggtttctgccatcttgatatagacaggaagtgactaacattagtggcaagaggcttagtaatcaaagaatctcaggtcatttaaaaaatcagttgatcattttttaagagtacaaaaaagagaaatagttactcaaaggagagctagggcagcagtatctctttcattcacacctttttggcaacatcaacatccttgttcttgttttgccatctacttccatttagaactaggatgcggggggatggggaagaacaaggactttttggtgagagtgaaaatcattcatgactcaactttctggtgtaggggagaggaattgactcatatggcctgtagactccactgtcttcttcgtgtaccccagcttttaagaggagggcaggatcaagatgatcttctaagatatctgttattgatctcccaggaagacctgcattaaggaaatatcagcttcatcttcatcccttttgtttgaggttcctacatgcatttagggaaaccagaaggctagctagcccaggttgtccaaggggactctcagagctcattcccaaacagcagggatggcagaaaaatgctggagaaacctagggaggaatctgcttctctctgatactctgatcagtttggtgtctcagacttaggctgcaaaccctaatcctgcggctgtccatagcagatgccagacaaggaaccccaatgtccgctatcagagagcagaaaaaattctgtcgcattccctttggatttcagccttactctttaaactgttctccttgagtctcagtttttacttgaccttacactatgaaagggggatctctttgggtttgtaaaccaaaattaaaattctaagcccccccaatagactgaatggacccccctcacaaccaagaagatttcaaagaaacctgaaaaaccagtttagtccacgaagggaagtgggggattggacatgcctaattataccctcccccttttggagtttagcacaactgaccagcataacattaaaatagagatcctaagactgacagaactgactatgtagcaataagataccaactccaacctgactctgaaaatcaaagtattttaccccaaactatatttctttgacatattttgaaatggccctgcaacgttgtctcttgtgggggaaatttacattccgtagagaatcctcttccctctccaggtcttttcctgatccagaagagatgtaactaagagtctgacatcttttaaggtcagataagagatattcactatctattctctctgaagtctggaggtttcacctacatgagaataaccttggcttccagaaccgctcccttcccttaactcaagctgacttcaattcttcaggcatagcttatctctttcaacgaattgccagtcagaaaatctttgaatccacctattacctagaagtcgccccctcaacccgactttgagatgtcctgcctttccaggccaagccaatgtataccttacatgtattgatttatgtctttgtttgtaacttctgtctccctaaaatgtataacaccaagcgtagcccaaccaaattaggcacatgttctgaggaatccctgaggctgtatcacgggctatggtacttaaccttggcaaaataaacctatgaactgattgagacccgtctcagatgctttttggtttataggtttcacactcatggcttttttcctaagagattgaattaaattctctaggttaaagtccaaacttcccatcacagtatattgagcccattcatcatatattatggccacaatgaccacctgctctttccccaacacaccaccacctttcatgactttatttttgtatatatttttgcttcaactgttgtagaagggctgcacaggccttctgagcccaagattcctcatttgcaaagtgagggaaataatagtaacctcacagggagagacaaacaaacagatcctttcatcattagaggttttaaaacagttgatgataagaagcacagaggagagatactaagcccagtgtgggggtccaggaatcaacttcctgccagtccccaccgataagctatttgtttctaaacttgtgctgttttaaattatgttgcaatgaatatctttacatctgtatctttacgcacatatctgaatatgtctgtaggataaactcctagaagtagaattgttgcatcgaaggatatgtgtctttttagaattttaatagatgttgcaaattatttctcaaagagaatgtaccaatttgtgcttctactaattatgaaggtgaaagcttgtttctcttaccttggtcaagagagcatatcattgtacttttattttttaattaaacccacgaaaaccttttgactatccagtgttgagtgtccctagtcagatcccgatagatttactatcctgtgccatacagcagtccagtggtacagtcccccaagggtcagtgcacttatttgtaatgctaacccatccaactcctgaattccttgctagctgttctgtagttagctcaaagaactgcacttctgactgtaattccttattaaatacccgttttctgtccattagagctcttattccaagctagatcattgtagtccttcgcgagattttcagcatgtactatagttagcccatattggtttagtttgttccctagtcactctacctgcaaagataattggtttcaatgtttgacattctacttataatgagaatcctcatataaatgtacacgcctgatagagctgagactaaaaaattggtacaacacactactgtctttttcagttcaaaggcgtcagtctcactgcagtgtgggagatgatcattctctcatctcttaacagtaaatataccctagtgcatcatgttaagttgtaatagccaagctaattagctttggacctagagatggcagagttgtataaagttaagagtcttggctcaggagtcaatagacttgggttcgaatgttgcttttactacttaacagctgtgtagctttgggcaagatacattgtctctgaaattctgtttcctcttttgtaaaacggaatgataatagtacatgcctatagaattgctagaaggattaaatgagatttgtaagtagtacatctaatacataagaagcagtaaactgttattatgactgtaattcattgaatctaaaatgatattaattataggatacaccattaaagaaagcataagaaaagggaaaacatggctaaataactacacaatgtcttttagacttaattaaaatagacttataaaatcataaataatgaataaacagggaaacatatgtgaaataaattgggtaagatacttctaaaatgtttttacattcagattctgacttttctgaatcactttccaactcatatttatcagtgcccatgtttcctcactcctgtgacatcttttctatgaaaatcatgggaagtgctgcatttcttaaaggaagtcataaaaaagtaacagtcgttgttgccagacttttaagctggttttataattatctggagctaacttgcttttgacttctgctccaggaatgttgctacacaagtctgattcaccacccaccccatttttcccacaactaacagttgcttcactgttgtctctagaaattttctccaagctgcttacaccattttgtaaattttgatgctggtattttaatgttcatataagcaatgaaaactataacaagacagcaattattagatacatcatgatttcagagatgttaaaacattgtttaaaaaagtcttagaatatataaaataaaataaaaaatcctgagctctaggcaaacaaacttcaaaatgtctaggaaaaaaagttacatatagtcctacatgtggccagagactaaaggtggacatctttcaggatgaattggaggtcctcaaaaaatctgaaggggaaagtaaagactgtttagttcaaccaagaaaccatttattgagatgcttcaggctgggcatggtggcttatgcctgtaatcccaacactttgggaggctgaggtgggcagatcacctgaagtcaggagtttgagaccagcctgaccaacatggtgaaaaccagtctctaccaaaaatacaaaattagtggggcatggtggcacgcacctgtaatcccagctacttgggaggctgaggcaggagaattgcttgaacctgggaggcggaggttgcagtgaagcgagatctccccattgcactccagcctgggcaacaagaatgaaactccgtctcaaaaaaaaaaaaagagatgcttctaaatttttcctgccatgtggccacgcagctgtgcttgactttttgtgagaatgtggccttccattacttcccaaggaaagcccactcttatctttggacagctctagaaattaaaaagttcttccttactataatgagcaaaatgattttgttgtaacttctactcactgtacccccttgtgttacacagaacaaatctaatttctggccctcttgacaggccttcagataactaaagacactgcttagctcatgcctatgttttcttaaaggtatactatttcattcgaatttttttttcctcagggtttttaactttttcaaatttggaattccttctccatcctggcctttttatttttatttttatttttgctgttaacctatttttattttgttttatttttattatattttaagttctggggtacatgtgcagaacgtgcaggtttgttacataggtatacatgtgccatggtggtttactgcacccatcaacccgtcatctgcattacgtatttctcctaatgctatcccttccctacctccctagcccccaacaggccccagtgtgtgatgttcccctccctgtgtccatgtgttctcattgttcaactcccacttatgagtgagaacatgcggtgtttggttttctgttcttgtgttagtttgccgggaatgatggtttctaacttcatccatgtccccccaaaccactcgttttttaaatagcatatctccagttttaaaatttgggacccatgacttacttaccatgttcctcagatggatgtgtccagggagaatacggcaggaaggcagggttttatttttattttgtacaattaaacaattgtacttgtgacaggatgtcagaaatgatatttcaagatacagtggacatgaaattctgaagctggatcatcatatgaagaatttacaaaggaaatggttgaggatctatctgttccttgacttttggactctgaaatcatgtcaagggataaaaaggggccaggatatggagaggagagaggatctgtgaaatgatttatttgccatatttccccttcatagtggggaggcatgggaagcttacctcctcattctcaagcctaatgagaaagatacccatggaatcacccaggtaggtctgaaatgtattctctgcagtagggagatacagggaactgggcctgacttaggcttgagaaagttaaagtgagctatggtggtaggatagaagagcctattttaggattagccagccctacaaaagatccaggagccacatctatatatatttctgtggcctatgaaaaacagagtgcttgctgggcacagtggtgcatgccagtagtcccagctcctcagggggctgcagtaggaggatcgcttgaacccaggagttctgggctctagtgcactatgcccattgggtattcatactaagttcggcatcaatatggtgatctcctgggagcaggggatctctagattgcctaaggagaggtaaatggcccgggtgagaaatggagcaggtcaaaactctgtgctgactaatagtgagatagcacctgagaatacccactgcactccaacctggccaacacagaaagacactgtgtctttataaaaagaaagaaacaataacaataaaattaagaagaaagagacctagtatggggttgccttggttcctgtactatagggtcaccaggaggggcagataaaggcaccaaaaagctggagttgcatctatattcctaggggcagaggaaagaggtgcactggaacacctggaggagagatgcatctgccttgagcacaacaccctaaggaaacaattcccagaaataaacatccaaaaagtctacaaaaatgctcatgggagaacaagttagctttagccacctgtcaaattcagagagtagaaagcagctcagccaaataactttctgttcccttacctattctccctttcttccctctgctctcctactttggcctacgtgagaagcaaacagacgctaatgagaggaggaggggatgtggagagagagagagagagggagagagagagagagagaaacaccaatcaagtcccttccccaagtcaacaccttaaatggataagtaagaagacagacttacctttggataaagactggaggtctgattaacatctagaatgggcatcctgatttagaaattgaaactatacttgtagcctaaagtcattataagactctccattacctaaagaagcagaaaaatcatggctatttgcaaactttaatgtacacatgaatcaccagggcgctgggtgattcatgtgtacattaaagtttgccaatatccacggcaaatgcagattgtgattcagtggtctggggtggggcctgagagtctgcatttctgagaagcttctaattgatgccaatgttgaaggttcttgggccacactttgagtagcagggtgctgtgagccagggaggattacccacactgaatacattttaaattgattttgaaagataaaagagctacattttgatcaggtaatgaattgtgcttttaacatacaagttacactttatttaatttttcaaacattattatgaatatagtctatttgaaaacttcatactgtattaaaaaaatgttaagcctatttttcttgccatcctcccacccactccctcagtgggttatagatgtaaccactatttaacaatttgatgtgcactcttccaggccttttattttaaaaaagagctttttaagtatattattatattgatcaggattcaatttcagagaacagaattaactctagctggattaaggaggaaggaatttattacacagtatttaatagcttacaaaatggttgggagagatgaagagacagactgtagtttgtgttctcagcaaagtttcccaatatcagttcaacaagggagttgctgcctcttctgagatcagaaatttgccagccttgggtcacacagccattgctatgattaagaaaacagtcacgatagaagagacactgctattgctacggtgccaagaccatacctgtcttctatggtccaaggaatggatgctcagggccctgcccctagcaacacaaagctagatcctggacactaggtaggtactattgctggtaaagaaaaaccaaaatctttctcaaccaggtttccagaagcaacatcagctgcagtagtacagcctccgcttcacttttaccttccatgtgttgtataagggcttctgaatggccagacttaaattacaccaagcacctcactgcaggggagtcacggtcccttttacatttccaggctctgcagttcagaaaggcacttgagatggtaatgagtggatgttgacaccacctctacagacaacaaaggggttagtcctagaattttattgctggaaaagacttagggatttagtctaacttgttaatttgagagaaaggaaattgagacccagagagctgaaatgacttgatagtgatggaatagaaatagaactccagccatttacatggagttgaatgtagcctaacgagatagcttcctctccaggactcgtgatattctccagccccattgggcttattgcctataaacttaccagagagattgtttt

SEQ ID NO: 342 - DNA, 44124 bp, Homo sapiens
catgtattttttaaataaactttttgaggtgtaatttacatgaaataaaatgtacccatttaaagtatacatttccatgagattgacaaatgtgtatatccatgtaaccctaaccacaatcaagatatagaacactcccattaccccaaaaggttccctttgtcttccttcctagtcagtttcctccatcctgagcctcagacctggcctgatttctgccagtgtaagttgaacttgtcttttctagagttccatatgaagaaaatcacatagaacgtaatgtttgtaaaagtctgggccgggcacggtggctcacgcctgtaatcccagcacttttggaggccaaggtgggtggatcacaaggtcaggagatcgagaccatcctggccaacatggtgaaactccatctctactaaaaatacaaaaattagctgggcatggtggcacatgcctgtaatcccagctactcaggaggctgaggcaggagaatcgcttgaaccagggagtcggaggttgcaatgagccgagatcgcgccacagcgctccagcctggtgacagagtgagcttccgtctcaaaaaaaaaaaaaagtctggttccttttacttattataatatctgtgagattcatccatattgttggcatttcagtagttcattcctttttatgtttgtttttgctttcatttgaattgtcactatcctatgctcttgcctgacagaccctgagagcctactgaccacagcagctcctgttaccacggctgccgtttctgctctcaatgctactgctcattgatcccagggaggaaaattctggtgcatcacttagtatttatttcaggtatggttaggacatttcagaataaaggatggcttcttctggatgtatctgaattgatctgctgtcatatacttatgaatcacatgctcagaccaaagtacataaaaaagtcattctctttccagacaattttaggggtttgtaaccttggtcttatattgctccatggcctatgaattagtaacaggactagtgaaattcctagtaacatagtcctgttactacaagattacccatatcctttgatgatccatctactgcaaactcatagaatttactggacagtcttcttcattttatgtaagaatgaccactgtatcatcatatgtcaatgtcctgcataactgtcaccacccctccatgccgaatacctggtagcttgtgatgagttgagaacctcactaaacagtcttatccacatcctcaggttctctgaggttttccttctgtccagtccatgcacttgtacccctggtggtcgaagtacagtcacgcactgcgtatgatgttctcatcagtggtgggctgcatacacagcagtggtcccataaaaccataatgaagctcaaaaattcctattgccaactggcataacgtcatgtagtgacacatgaccttttctatgtttagatctgttcagatacacaaatccttaccactgtattccaattgcctgtagtattcaacagtcactgtacaaacctgctgtatagttttgtagcctaggagctacaggttgtaccgtatagcctaggtgtgtggtaggtaggctatactatacagatttgtgtaagtatactctatgatgttcacacaatggtgaaatctcctaatgacacatttctcagaatgtctccccatcactttggccagctgactcagtttgtgatggcaattgtgagaccagttgaagggcgatctgacctgtatattctcttggttaattgtatttacaaattggatacatgatttctctgattgctctcttcacaaactacatttgaatatacaaatgaagtgctaagtggtttttatacagggaaacaaagccagttttgttttctaccaatgcaagtttggataaattcttttcaagaagatgactaaatatttcccatttagcaaagtcctcagataaagagatgccaggtatttctcgttatgttggtttctgtattactatctgttcagacacaagcgtccttaaaaatgtgcttagttgtaatttcttcatagatttcaaccaaaacaacatattgcaagattgaatgcagaagtagatgtgagaactcattctattaagccaagcgtaaatgtttaaaaatgtaaaataataccactcttctgatatgttttgggagaaaatatgtttgtggaaaatatacctatcaaagaaatatcagaaaccttccaaactgaaggacatgtgtatccagattaaaatgaccttccaaatgcttaacatagtaaacaaaaaacaggaggaaaaggaggggagaaaagaaaaaaagaagactcacacaaggccgtgttacgacatttcatcataccatagataaatcagatcctgaaagatttcagaaaggaatatgagatcacacataaaggaacaggaatcaaaatgacattacccttctcaacaacactggaagctccaagagagtgcagcaatgctttcatcctcagagaaaataattatcaatacaaaataatattcccagctaagctatcaatcatgagggtagaagaaaggcatttttagccattgcgtgggagtgctataataatggtcccagtgaaccacacctccctgtatccgcaccactttgcaatgagaaatttgctgtttctcctagtgagagagggagtctatttctttacccttgggcctgggctggcctggtgacttgttttgaccaatacatggaagaagtgacattatgtgagttctgcagctgaagctttaagaggccttgaagtttctcctcaccttcttggaaccttgagaccaccatgctgtgagaagcctgggcatatctactggaggccgaggggccacatgacacgtctaaaactcatacgtcaagatatggtaatataatgtgaaattcctagagcagcttaatgctagtctctatttggctacctttttctttagaattgcttatatagttagtgtatgagattttttgttatattttgcaaatattttctctccattatagctcatcatcttttagctttgtttatggcatgtttttatgatagagaagtttcattttttatttttaagtggttacatctattaataatttcctttgtgtctctgaggttttgttgcttaagaaggacttctcaaagatttaaccttattttttacttaaagagcaaaaaaaaaaacaaaaaacaaaaaacaaaacacgatcacaatataagccagtataagcaactggttcgtgcaggatggtggtagttatcaaagagagcggggggtctaaagctctaaggagtcgtctggagaaagccaggcagagacttgctgcttttctattctacttctttcccttctcatccagcttgaaagctgcacccatcaagtgcgtcctgaatctgacgattcactatcttcacttccgccagtctgctccaggcctccatcctttctggcctaaatgaaccccaaagctggcttgtgtcctgcatccatccaccactcttgcccttgtttcacttatctattgctgtgaaataaacttcaaaaccaagtgattcagtctcacaactctggttttcctgggctgagtggggtggttcctctattcatgtgatgtggctggagctgtgggcatttgtgggcttgaatgggctgagtgttcaccgtggttcattcacatggtggcagctggctaggttctcagctaggacgatggcctctccatgtagcttgggctcagagctagtgttctgagaaggaagtagaagctggcagtcctattgaggcctgggcttgaagtcccagaacatcctttcccactgccttgtaatgatcaaagtagtcacaaggccagcctagattcaagggcttggaggaatactacctttcagtcaatttcccagtttccagaggattttaaaaaaacaaacggctcgacacagtggcatgtgctactcgggaggctaaggtgggaggatcgcttgagcctgggaggttgaggttgccgtgagctgtgattacaccactgcactccaacctgggtgacagatcagaccttgtctcaaaacactctccccaaaacaaatagacataattctcctgctggaatccactgctcactagacttacattgtaatagcctgcctcacctggcccctgcctaactctgtccctcacacctttgctctgtctctaaaggtcatactgctgtttccccagcaccccaaactcaccacccttcagggacttagcctagaacaattttcctccaggacttcacttggccacttcactccattgcttccagacggctggcattatttgcccatctgttttgggtctccttcactggcatgaatgtaaggtccttgccagcagcacttttctgtcctatcctacattcactcttagcatctagaatggtgttatcacaggaaaggcataaaagtatactctgtggttaactgaatttacttgcctaaatcttgggcatgtgatgctttgagaaatatacaaattaatgttaaacagaaccacagtggtcagtaacaggcacatccaaggatacactagtcctgcatacatacccactggcatgtttctaccttcctaataagagctgacagccgttttgctgcatgctgtacaggacagctgctgctgcaaactcagcctctgatgggcccatagtcgatgtgcccactgcatgccttgaactcagggaattcagacgaaatcatcacacactccagccagaagctagagggctgccggccttgacattttaatgcatttttggtgtcagctgcccttcactgattcactcaattctagaggtctgaatgagaatccctacacgcttctcaggggttctgaagaagccagtgtagcccaaggtcatcaacccaagtgaacccacatttatccaggaagcaagaggtgtggcaagggcagaattctaacagacatccattccacatgtgtcagagacaaaactaagtccaagataaaatcgacaaaggctatttattcataaacgtgcagcaggggaacccttctgctgaaacctttgttttggtaagtgttcagaggtgttaagacgttatagagtaaaaaggagaaatactgacagtgttgacttggcaaatgtcatataagggtaggatttgtggaagcaagccaagagacaaagtggtcttcaagtacatttgacttgattagcttcaaggaggcaggtgagcagtctgggaccatttcaaaagaggaaaggggcggagagttttctgtggccagccatttcctggaaaaagtgatggttgatgggatgcttttttgcagtctatcatcatggttcttaggggtgtaaaaagtaaagtgaggttcctcttcaaagactttcctccctgtctaattaagaataaatagtaacttctcttaggagcaaaacttattcaaagacctgtgctaacattcttaaatatctgctagccgtaataaagaaatcaatgtactttatgttcttagctcccacaatttagcctatttgccctggcaatgcttatactggtccaagcaagcattaggtcatagcctgttcctcttccttatctgaaggtgtttttacgtttctcagcattccacaagttacttcctccttcattctcctctgcctttgcctcttttaaaaagttctaagttgctagccaatcaggacaaatacagaatgtgaggtcccgttccagccaatggaaactggacacagcagtaaagtggacttgtcaagttataaatgaccctgtctcctttgttcggtgttctctcgtggcaaaactgctggcgagtgtaccctttctgcagaaagtataaaaatgaccttgctgaagaaattaatgttcaagtgctatttctttgcggcactgaagaacaagcatttcaaacagagggtagggtggggtggtggtggtggtgttatgtggttgccacagctaagttaagtttttcacatggatcattaactttcaaataattaaaattttagagatgcaaggtatcttaaagttcatctggtcactctgaccacccacattcccactctcatcccaagttcatttaatggatggaaaaactcaaacaaaaggtagtttggcatctaacccttagcaaaggttagatgtggaattagaagttttcctgaatcctaggactgtagtataaccatcatgcatttcaaaagtaaaacaaaaaaggaaatttaaaaaaagaaaatacagtaagtagccacataaaccgcttctagctgggtccactggtccccctgcttcttgtttattaacggaatctgttcaggggctctagggctcagagctttaggggagtctgagcccttctccagccctggggtgatgggtcttgattgatccaggtcaaattctccacagatttaattctggccaatgaatatgagaagaaatgagaaggtggaaaggtgtcttagtctactttttgctgctataataaaaataccaatacatggggtaaattataatgaagagaaatttatctcatggagttctggaggctggggagtcccaaaatcaaggtgttggcatctggtgaggagcttcttgctgtccaccccatggtggagggtggaagggcagaaagagagagagggctggaggccaataggtggctgaactcatttttttatgaggaacccactcccataataacagcattaatccactcatgagagcagagcccccatgacccaaccatttcccattaggtcctacctccccacacccactgcactggggatcaagtttccaacacatggaactttgggagacacattcacgacatagcagaggaccactggagaaaggaaggtttttaaagattttttttaggacactatggaagtgatagccattggacatggatggtgtttttgtttttggcatgggaaaaggcttatacaactctggtcaacttggcaacactaatcaaaagtcaaaatctcctttgaccctagggatcccctactattaacagtattatatcttatagaacctaggtatttaggaaagaaaaaaatgttcaaagatgtattgacatttaataaaagcaaataactggacataacccagctatccaaatacaggctatcaggaaacactgtgaaggactttgaaataggtcttgcccactgcccccacccctgcctccaattactgagtgttctgtctaatctagcccacctttctgagttgattccctttcatttcactgcctttgagctactttacaattacgtaaattaagggaaactgataatgcagatgattcttgttcatagaaatgcaaattgtgaccaatggaatataactgattattgttctgcaggtatcagccaattttgccagttttgtaactacgaagcaaactcatttcagcattcctgctaggcttataattatttgttctttggattctcctttgagccaattaaagtgtcctactggttctctcaataattaacaagttaaatacaatcatctttaacatgttacttttatatttgtatgagtcataattttaacttctaaaaaaattatcctttaacaaggtagttaagtaaatttaatgttcatgtggtataatttacttagcagccctcttaaaacagttataaaaaccatatggcaacagggacaaatactcctgataaaaatggcaagtggggaaaaaagcagaaatgcaaaatttgtactacgttgtgattaaagctaaacgttgtaagtgcttagggcaagaaataggaaggagaaaaaaaattgaagttggatttgtttgttagggtggtaggatcctggattaaaaaaaaaaaacaaaaccctgacattattctgttatacattaaaaataatattggcgggcatggtggctcacgcctgtaatcccagcactttgggaggccaaggcaggcggatcacgaggtcaggagatcgagaccatcctgctaacacggtgaaacctcatctctacttaaaatacaaaaaattagccaggcgtggtggcacgtgcctgtagtcccagctaccagggaggctgaggcaggagaatcacttgaacctgggaggcggaggttgcagtaagccgagatcacgctaccgcactccagcctgggatacagagtgagactccatctcgggaaaaaaaaaaaaagttggccctgtattagtttcctattgttgctgttaacaaatggtttaaagcaacactaacttatcaccttagtaataaattctgcagttctggaggtcagaagtccaaagtgggcatcacagggctaaaattaaggtatgggtggggctgtgttcctttcaggagtcctaggggaaaatccgtttccttgccctttccagcgtctagaggctgccagcattccttggcttgttgctctccttcctccatcttcaaagccaatagcttagcatcctcaaaagtctgtccaccctcacgtcgccttcactgatgcttatatggatccatgtgcttacactgcatccgcccaggtaaatacagataatcctcctatctcagggtccttacctaaccacatctgcagagtcccttttgccatgtaaggtgacacattcacaggtcctggggattaggatgtggacatctctgaggactcccatccccaatccagaggatttccctgaaatgccaagttcagtgagaacagcttcccatatgcctgagtgaaggcacaatactgactgtgcgaaaggacatagtgtgggactccatttaaattaaatgtcagaacaggcaacactagcctatggtggaaaagaattacaattaccacctccaagggcggggtggggttgactggggaaggccatattggaattttctggtatggtgatgttctttatcctggcaggggcacaaaagtgtaaacaaacactactctctagtctagtcaatgacacgtactgggggaattgtagtgatgtctgccatttactctgaagagacataatggatagtttgatggacagatggatagacaggtgatatatagatacagtaacatgtttatgatagaatctaggtggtgggtatacaggtgttcattttaatcatctttgtgttgtttgagaatttttataaaaatgttggggatggtaagatgtgaccctggaatatgactctggcactctaaaaaccataaattaacaaaaagaacttagaaagccattaagcaagctgttgaataatttcctttttaaaatcaatggttctcaacctgggcaattttggaaggtgtctagaaaggtgtgggagcattcttgacggtctctagaactctcagtaagggcaaagtgttcctggcacccagggcagggtccagagaagctactgcaaccacgcagcctctccacaggactgtctttctacattaaatgttactgaggaataccaatttaaaatcagagtcttctcttcgtatctcattaatttgcttgcagttgcttgtagcacatctccaagtggactgtgactcacttctcaaaaatgtgttgtatctcccacttttctgtaacccaagaaccccgagcatagtgctctacccagaacacatatttaataaacatttggtaacaggggaggggatgttccctgactatcccagcttgccctttcaggcagctcctttgatgcaaacctaccccacattccccctcctctgacccccaacccgttaatagccagtgaggaaggatgttcactgctgcattcttctgccaagacacaatcttgaaactgcatccccactgccaccctccttcaccctgcccaaccccatccccctgcaccaaatggcaggggaggcacctgaaaataaccaccatgacacagagctgagaaaagccggcataaagcacttttattgcaataataaaacttgagactcataaatggtgctgggggaagggtgcagcaacgatttctcaccaaatcactacacaggacagcaaaggggtgagaaggggctgagggaggaaaagccaggaaactgagatcagcagagggagccaagcatcaaaaaacaggagatgctgaagctgcgatgaccagcatcattttcttaagagaacattcaaggatttgtcatgatggctgggctttcactgggtgttaagtctacaaacagcaccttcaattgaaactgtcaattaaagttcttaagatttaggaagtggtggagcttggaaagttatgagattacaaaattcctgaaagtccattagaaaaaccacaggatgaaaaaaaaaaaaggccacaaagaaggcttcagaggtccctgctggcccagggacagatacctgtagtgtccagcattgcagtgaacatgatctactttcaaaggcagagggtttaaggggagggtgggtgggaatggtggaggcaaaggctctccccatccccacctcagttttaggtagggcttttaatttaacccaaagacatctctcaacttggagagtaattcagtcctcaacagcgcctcaaatctgctatggctttgcagcgcagcagcaagaatgtttaatatataatagataaaaatttcatccaaaaaattaaaataaaatattcttgcaaaccccccccccaacaccaattcctattctaatgttaacctaccacttgtgctgttaatacttgaccatgtacttaattggaaacctatatccaaaagactgaaactgaatcttcaccccaaaatgaaaacaaaataaaatgaataacttgaggtttatggcatatagtttaggtaaacacacatacgaggagaaaggggaagaggaaacagaggtgtcggaagcaaagctgagtgacagaacacattcagtcagggcagatgtctatacaaagtggagtggaacatcaggaaaagctccatatggattcatgtgcacatgtctggaggcaccagatccctccatggcagatctgttggggacagaaaatctgtgagtttccagcaactcagtgttctttgtgtgcagtggcgacagccacgatgccatctgccacgccaaatcccttccccaacagctgagcagtctgagaccaagccacttctgttccagctggagacagccagaaagacttgggctgggtcccaggtgaaacaaactttctccttaaattgatctgtgtgttttgtttaatctaaggttaagtttgccttgctgaggacagcaggagggctagccacccatgctgctgacaatacagttccccactatcattgggtctcaaactgtgctacatataggcatcacctgggggctttaaaaaactcttaatgcctgggttccactcccatgattatgattaactggtttagggtttgacctgggcatcaggaaagtcttaaaaatttcccaggtgactctcatgtgcagtccagactgagaataaactggtcattcataatgttgagtatactgggaaaatatctccagtattcattcattcactcaacttaaaactttctgggtttgcccttggattttccttccagactcttgcaagaagctgagacattctttggcagtgggttgggagggttactcggggtgacttgtagcctttatccctctctcccctccctctacctcatcaagtttacagaaagcctgttcccaaccaggaaaataattccaaggctccctcgagtacagttatgttcaaaaaatgactcagctctcaaagaacaggaaagggattttggcctaggtgcagacctctgggcagacaaaggccctgtaaagtgccagggattccctcccagtagcaatgacaggtgaagaaaccagttatcaaacttaaccaggcctgtattaccaaggtgtgtgtggttcaaacagagagtttaaaaagcccctccacttacagatgtgcacaacaggaccaggttacaagtagctctgactgccatcacaaataggatggcagccatttgttgtggctttcaaacaaaagtgtcctcacccaggccttggctgtgaccctctggttcctatggcaggaggggagcaaataaaaaggtctggggccagttggaaggaagccagtagcattcatgtacttaatgattctaacacttacatgaaaagttacgtgctactaggatactgagtttagttcctaagaaatgagggtggaagaggggaaaatcaacaaacaggggctctggtcctactttgccactgcctggatgtgaccttgagtaaggcctttctctctggccctgtttccttactgttgcacaataaagctgatgcagaggcccctaagatcccttcctagaactgtctgatctaagagcatcctttcaacttcacaagcatcctctggcttcatttttccacttcactcactgataagctggcctgggggcctcaagtgtcctgggtgtggaccctgagcaggtggaccgatgcaggaatgcctccctcataccatctaataggcagtaaccacaaaccacagtgaagagagagccgcagaagctaggacatgatattcatatccaaagggctttttttttccccctctagcttctagaaacacagggtagaacaaagtcattcattaagagtcttatttccaaagaactaaaatgttggcactacaaatttggcctacatttccatagtcctcaattcagttttaatttataaactacatagaaaaacatttaaacagctgccatctccatgagttgaactgggaacatacacatgccaattcctttccttagggtgaccaatttttacattcaaagcatacactaataacactgaaaggatactcaatacagaaagaatgcagggggaaaaatagccttgtggtgttttttgttctctctgctacccatcaaacgctgggcataacatgggaggagcaaaggcagtgaagggcccttcagtattccatttccttacccaagaacagggagctaagggaggaggccattcctgtcattccagttttagaagctccacatcgaagacgagagtggcatgtggtgggatgatgcctgggtgcccagtggcaccataggcataatctggagatatagtcagtttggctctctgacccacactcatctgtgaaaagaacaaggaagacagactcagctggacacatgccccaactgtctctgtaagaaaaagagctgtttacctaggtgttccttggccaggatggtattgactttccagtgactttgcagctgcccaggcatcaccacctccttgtgcaggacttggaggttggcagtcatattccatcacccctgcatctcactccaagaagcccaatggcagttcaaaacccctcctgactctcagaacggtcaggccctcaacctttctacgcaagtcttaatgactaatgctaggcaggtaacattccagatgtctcaccacctagtccccttcagtgatctgtcacttaaaggacatgttaagtgccatctatgctcttcttgaaaaaggaatactcaactttgctttaaaaaaatatatacacaggaagtaatacttgagggtagtctattttttctgtattttttctatttatactcttttacccatataggaaaacttcaaaaaagacaatatgattttctgggctacaaaatagcatttactgaataccatttgtgaaaatattgatatgcctacaacagaaaacatctttggaaggacataccagacatttgctgtgaggagaacagtatggatagtgagtgaccagtaaggagagatttctactttaaaaaatatatttgtgtatattttcagtttcaaattaaatacacaaataagtataaaatatctactttctgaacagtgagcaggttctctgcagtatttccatcctttgacttatctctgcttttggtctccatgtgtatgttcccgactttccaactccaccagacagaggatgaataaagaggaagctccaggctgtgaagcgtctagtccttgctcccctcagaagctgggacatgttggaccaaggtggtaaggatagtgaggtatggctttaccttgtacaattcaaaacaatcatattccttgactcagcaattctatttccagaatattctgctaacaactcaaaagtccatcacagaaggagtggtttcataggcatatccacaccagggattagtcatgagaaatcatatagtggtggctttaaatgtattaacatgaaaagatgtccaagatggatgaaagaaagctgccaaaatggtccttgtggcaggcaggactccacgcctgcaaacatgtaaaaccaaaacaatatcaaaaggaaaggaaaagggtcacaagtcaatctccccttcttcctgtgtttttaactcacttggtgaaaaaatatgctatgaagaatttaaaagatattttatgtagatctcaaactacccagacttctcacaaatgacagggctgtgactgaccccaaaataccagttaaagggggagtcaggcatctgtccaatactcgaccatgcctctccaagcctgggaagtgaagtaggccgataacactatctcgatggcagatacagcactcagtacatacaacgcagtgattgttccaatgctggagcagtcacagaagatgggttgtggtatgaacaatggctggcatgaaagatgggggatgggctacagatccaagagccagacagactagggagacagaggcaaaaagctatggttggcaaggtttcccaagggaagtaaactacaaagcctcttcctcacactgccaaccctctgccctgcaggaacagaaacccagacacctgggagtgggatggcttcaagttcctgaaagttgagcagtttatttggagataaatcagtgatattttatagaggaagtagagcaatgtgtattctggaaaagagagagacagaaatctgtcttttcatcttggttaaatttctaattctcctgggtgagagggaagcagactaattacccatcatgcagagcctaattataaagttccttgggtctcaggtcactgaaaaacatccctttacctggttagagccaagaaaaaattcctaggtttgatggaaagacagaatccaactaaaatttggcaaccctgggtccctattgtctcctgggaattttgtagtgttggcagaacaaaagctgtttccacaaatggggaggaaagagattaggaaacacactcaagacaaacgaaatgactttctccataagtatgacgtctcagaagtggtctcacacaatatgggtaatagataaatacaaattaaaaccactgatatcatgttttactcttattgtccagaggccaaagatttaacaatatactgtgatgctggggctgggaggagattgcacctttatagcctggtggtggcagtccagagtgcaacccctagagatggtaacttgacaagacctctcaaaaacactacacacagcttttgagcccctcatcccacttctgagagtaagtcctatggcaacatgtgcacacgtggaaaatgaagtctgtacaaggtgagttactgcagcattgtttataatagcaaaatactggaaatgactcaaatactcattaatagggcactagccaagtaaattatagcacacttacataaacgaatactaggcagctgtaacagagcttactcctcattttttctttcttttttgaaatggagtttcgctctcgtcatccaggctggagcgcaatggcacaatcttggctcactacaacctccgcctgctgggttcaagtgattctcctgcctcggcctcccaagtagctgggattacaggcacctgccaccacgcccggctaatttttgtatttttaatggagatggggtttcgccatgttggccaggctggtctcgaactccggacctcaggtgatccatccatcttggcctcccaaagtgctgggattacaggaactcctgacctcaggtgatccacccatcttggcctcccaaagtgctggaattacaggcatgagccaccgcgcccagcctactcctcttttatgtagtggtattgcaagtgtcaaaaatgcattaagtgaaaaagtaaactgcaaaacagtatgtgtgtgaaagcaagaaaaaagttatgtttttatatgtgcttaaaccacagtacaagaaacattaacaacaggagcttcttgtgggggtattggtcagatgggatggcatgagggtgagacttttcactttttttatttttgaaccgtataaatatgccacctataaaaaaatataaaaggtaaatactagaaagcaaaacaaaacaaatgagagagcatacctgggcaaccccttcttcccagcctcggatcacctcctgcttgcctagcataaacttaaagggcttgtttctgtcccgggaggaatcaaatttctttccatcttcaagcatccctgtgaaaaagacgactgtaacatgagcagcagagtaatgacacaagacaagtcagaaaccagcagcagagcactcatcagagatgccagtgctgaagagtctggcaggaactgcagtatctagggagggtttcctgtgacctcactggacatctaaggagttgcgacagtcctactccagacctgtgaatgctcttccctgactccaagcaataactcgactacaaaaggaccccgcgtaccagagatgagcggcagtccaccttcttctggagatggggagtataaacttcctcctgccctgactctcccagcaccccgtggattttctccccagctaaaaataactgtggtccctcgaggtgcacactatgtctagaagtcacacacagtgcaagaagcaatattccttcccaaaatcccccatcatctttcacatataatgtgtgtatatattgctcctccattgttcagtgcaggcaaatccccctccaccatctgccacccccatgggctcctctgtggttcactaattgtgacctacacacattgctgctctccaggctgtgggtcagcactatgggatgtggtaagaggaagctataaggcaagctttcaccctcattctagtgccaagtgtctcacaccaacagggaacctggggcgtaaagctggccccttgtaggctggttcctgagttgtcataattttcctgggaaagtaaaaaccaacctaggctgaaatagagaaatgaaagaaagaatttgtgcagcattcatcccacttattttatccaatgctgccccacaaaacaacccatgctcatttttgcacagctaatactttgtaacagagatgactgaagagaacaggaatactaaggaggttgcagtggtggcccttcaagaattaactcagtaaacccagccaactgctagcaactctgtggccagtggttccactctgagttactctaaatgggctaggtgctttccacacatgaacgaatgcaattctttctccacagcactatccccatttcacagatgaagaaactgaggcagacagggagaagtgaaaatagtaaatagtaaaatttactattataaaaatagtaaatttataatttagtaaaatagtaaaactacgttataaattataaacccaaataccatgctctttctattattccagtttcccagaagctggacaagccacgacggcgccttccaataaaaggggaactccagagacgctatgagaaaagaggaacagacatctgcaatagatatctgcaacttccttttcaaaaacaccatcggcattgctttctcaggaagccactgccagcctattgtgatagctgacactgagttcctgagaattctctaattaggatcccagattggagggtcagccagtggttaacatataatggacacaaaactgattttactggaagactgagggtgggcactcaccatggttctaagcattcattactcagaagatccataaaaacattacagttctgttgtgtaagagtttaggaaaaaaagaaaatcctgacaaaaatcccaacctaaaaaacagtgtcaacatttgtaagtaggatggggaggcagagatgaattggcagtgttatcacagctactggactatgtggactttaacaaagtaagaaacgggtgggggttgggtggtggtatcttaatagagcaggagtagagacggatgtcctggggcagaatgggtaccaatgctgcctgaagcctggagctgggagctgaggactaagaggtagacaggagggtggggaccggtacctgctccaaggaactggtgccccagaactggtgagctggggtatgcatttagctcattcgtttaccagaatgcagtcaccacctgatgaaagaaatgactaatggcaggacttgaacagttctctataaatgagtacctgggagaaaaacaggtctccaggctccacaatacccaataaacacactgcctttagcccacttcaagctgcacttcttacatggaacccaacccaaccaacctcagaggtaagggtgagagcaggcaatgaacagctatgattctccattccctggccaggcagggagcctttccatccaccctcgtgagactgcttgtaacagaaataaggaaaccgactccaaggctcagtaacccacccaaggtcagaaccacggagtggcagggcctgtgagccacaaaggagactgaaaaccagaaagagcttctctctggtctgttattttaagaaaaacatgcccagaggggccacctggaagcaaggctgtgtggcaccctcaccttcctaattaaacaacaacttcccaggagcaacgacagcaacaacagcctggcccagcagatgaactcgaatcaatccaagcccttcccctatacgggtcagtttgggcactactttacctgctgtgaagtctactgggatcttccaggaaagtcccacctcattagtaaaaagaaaaacaaagactcgggaagaaagttcctgccctccctgttgaatgctgtgtgaggataagatgtctggagcatggcagtcaccctgtgactatcagaaggccaggcgtaccacaaggtggtcattccagtgctctgaatcagccccaaaccacttccctcaagactcatgttctgaggtgattaaaagtgtgctttgaaggtaaatctaggatgacagtcaacagatcagtgattgccaggagtcaggggtagagggagggaagaacagatggagcacagagaatttttagggcagtgaaaatgttctgtatgatactatatataatggatacatgccattatacacttgtccaaatgcacagaatgtacaccaccaagagtgaaccctaatgtaaactatggactttgggtgatcatgatgtgtcaatgcaggttcgtcaattgcaacacacgtaccattctagtggggggtgttgataacaggaggctatgcatgtgtgggaccaggggatatatgggaaatctctgtacatgcctctcaattttgctgagaatctgaaactgctcttaatgaagtcttacaaaaataaagaagtctgctttgccttaggttgggtcttcagttacctgcagccaaatgaacacaactggcgtgaggtaaacctctgacacttagtgagcacgctacaatgtagtgctgccacgaaaggaataacaaagaaacagaactcaacaactaaaaccacaaagaactatccctgatccgcgacaatgggaacagtgtctcatgtcaggacccagtacacacccacattttgtctgtgtataaacaaaatttacatgtaagttactacatggcatatacttctcatttttaaaaagaatgctgattgtgacccactacatttatttcatgatgcattaatggttcataacccacaatttggaaagtacggtatacctataaaaaattagccttatttcttgccaaacttgaacacggctctgacctgtgcaagatcgtattttgattgcagtgaaagccacagggtactgagacagactccctaaacttcctttttattcctgatcaaatgcaatgccaagcaacctccagacactacatgcatcaatgtatcaatgttgctttgcctgaggtgagatacttcaactatctatctgactggtaccaggctaggagcactaggcaggacacagcctgaatctgctgctgctgctgctgctgagccagcatggagatgtgtatgttcttcagtggctctatgtgaggatgcctgtctaaccccagctctcctgagcctatcttggacactgaggggcaaacctctccctagtatcttaaaaccataaaagccaggaagcaggatttctaagtaaaggagctttaaacaggacctttgcctaggatcttaattttcctatgctattttggatgctctgttgtccctgggaaaggggcatgagacttgctccagaatttcagaccacagtcaccaactgtcaatctcatctactttctaaggagaaatcttcgcagggcagggttgggtggtggcagtgatgttggggttccttgagtccaaggagaggatttcccataatcgagtccgaaagctaaacaataatcccccgaaatgggtggggtggtatgtgattaagtgggtgtcacacaactggcacaagctacaggacaaggagaaggagggcttccccagtggggaggaacaggccacttatctatggccctaagttgtcagcctgggggagaaggtggaagcagtgtttgttaagctggaatgagtgtgcatgtgtaggaattatgctgttcagtctgtaatgtcaaaacagatagtgagaacttccatttctggtcacggtggaggacaaggatcagatttgttcatgaaacaaccaacaaccaaccaaccaaccccttcctccctacaaaaagtccactaaaacctaaaaaccacctagacaaaatagctacaacgatggtttgtaggacaccagacatctgtaatgaagaacaataaatcctgagacatgggaaacaagggcagccctatatccttgggagtttccagggagagggacctggagtggagctcaaggcacctagagtccataggacacagtaccagcaggagagagctatacagagatccccagagatctgcagggtcctctttgagtattcagcagagtccctctcagtgcatgtatctgagcaaactattcaaggccaggaaaagaactatccaaaaggcttagaggaacagtatccagtgctcacacagggctaggattagtgcttactaccccccggtcaaactggagaagctcatgattgacaaagcactgggcagaatactcaggaagatcttgcctatagtaggaaataatcagccctaaactgagctctagacctacctaacaaatcacaaaagcaagactcgcaagcatcaaactgtttccgggtaacttaaatgcttctcagtataaaactcaggaaaatttataggaataaaaatatccagcaccccaaaaggcaaaattcacaatgtctggcatccaaagattaccaggcatgcaaagaggcagaaaacaggacccacaatgaggagacttatcaatcaattgaaagcaacccagaactaacacaaatgttagaattagtagaggagaaccataagactccaactttcagagatgaaaactacaatgtctgagatgaaaattacattgggctgaaatgacaaaatatccacacataacacagtaaaaacttcacaccattatcaagcattaactcaaaatggatcctagacctaaatgttaagtactaaacctatcaaatttatagaagaaaacataggaaagaaatctttgtgacctcgagttgggtgaagatttcttagtatgatgtcaaaaagcactatctataaaagaataaattgaacttcatcaaaataaattcagtactttaaaaagcactgttaagaaaatgaaagacaaaccatacactgggagaaaacttttgcaaagtacatatctgatagaggacttatatccagaatataacaaaccaaaattcaacaattaagaaaaccaataaaaaagggctaaagatttgaacagatacttcattgaaaaagacagagggcaggtaagcatatgaaaagatgctaaacattcctagttattataacaacgcaaattaaaaccactaggaaacgcatctaccaccactgattagaatgagtaaagctaaaaagactgaccacgtcaggtgttagtgaggatgtgaaggaactggtattctcatacactgctagtgggaatataacataaagcttcagaaaacagcttgatagttaagttaaacatacacctcccatatgacccagccattctgatcttgagtatttatccaagagaaatgacaggctatgtccacagaaaaacttgtacacaaatgttcaaagcagatttattagcgatagtcaaaaactataaactaacccaaacatccaccaacgggtaagttggtaaatacatgtttctatatatagaaaaatatttagcaacaaaaaggaacaaacaattgatacatgggacaatacagatgaatctcaaaataattataccaagtgaaagaaggcagacataagagaacgtactgtatgattccatttatataaaactttagaaaatgcaacaaatctacactgacaaaaaagcatatcagtagttgttagaggagggtaaggaggggtgaattcaaagggaaacaatgacacatcaaaatttatgaagctgtacatttttaaaatgtgcagtatattggatttcaatcacgcctcagtaacttttttaaaaaaggaaaagaaaaagagtaggcagtggcatttactaaaatgctatatatgtttagctcccacatacacactggcaatgaatgaaaagtgcttcctctctttggggagggaacaggtaaagcaggcagcaagtcaagtctcagcagctgctccaattttaactctggagatcacttgtgccaggagctggagcccttgaacagtgaaaccacctgccaagttagtgccataatttcctaaagaaagcgtgccctgctcagagaaggcaactgaggttacagtgcagacaagacagctgacagtctttaagctctaaaggccactcagcataaaacatcacaagcattgccttctaattgcagaactgaccaatttcattcctggccgtacaagcctataactcatgcctaacaaactgcctggaatagctccatattcttattttaagtatttagtcttggctctcctgactgaatgcagcccaagctcacagacctggcctgcgttctgtgtcctggtggcacgtatggtgctggtactcaagagcactcttggatttgctttacttgcatgatttttaagaaccagaaggacaagcatgaggccttcatatttagaccttcttccctatatggtaacaagaatatgaggggtaatcccagaatggtaaactttactttaagcacctttagttactaatcagtaagaaaaatgtgaaaatgtgctccagttaaaagcacaagaccatgaaagaagccaaagctatgactgactgcatgcagaggctgttgacgtcatcttcgcctgggtctcctcctgaactgaaatccttggaaagggagcaaaagggtttacaaaacaagacggtgcagagagtctcaagtctgtctactccacagcagcctgctctttcctgttgcttttcaaggaatcagcagagggagacctggccagcagctcctgggcagcaaagtatccccagactgtgttcctggtggttggctcaagccactgaagcggtggttaagactcaagaccaggacctggagattcacaaggaccactgggatactatttcactaataacccaatagaaatggagtcacttccaaggcactctgctttggggaagggcagagtgccatataccttctactgggtaacaggactgaagaaggcacctctacagacttatggcttcactacttgtagtgaaagctcatgactcacaatgcagtttatagttgctcatgaatctttgcaggagtgtttcctataggcagcattttacagggacaaaatatgggaagttttaagattaaaaaaaaaaaaatgactaaactaaaccaaaaatcaaacataacaaaaaaccagaatatcctaagccccaaaccttcaaaataaaataaagtccttgccatttacagtttggagagggaaaaggatttctactttcaacacgcaggtgagtttcttaatgacaaaaagtacaatgaggccagctgcggaggaggctcatgcctgtaatcccagtgctttggaaggccaaggcaggagaatcacttgaggccaggagtttgagactggcatgagtttgcaaccagcctgggcaacacagcaagactcatgtccccaatcctgtttctgcaaaaaattaaaaaaaaaaaaaaaaaaatttagccagacatggtcctagctacttgagtggatcaagtgggagatcacttgagcccagaggtttgaggttgcagtgagctatgaccgcacaagtacactccagactgggcaacagaacgagactctgtctcttaaaaaaaaaaaaaaaggtgtaatggttgaatgggtggaggtagggggagccagtatttttctgcagctttgcatttgaagccactcagaacattcccagatgggcgtatggctcaaggtctaatggtttagctgtttgctttccctcttcttattagacacagaagttctcttaaccaccttttactcagctgccttacttggagactcataaaactcacagccttcgtaccccagcatagtgaagagcactcccctcatgctttagtctctagctcatgatcacttcttcattcccatatgagttctgtgttcacaaagggaggagtggttagctgtgtttgtccccaaatccatttatggtagctatatttactgtgtaaatataatgtaattaaatagtatgtaaatcaataaaatgagtgtgaatacaaacagcggttctagctgactcctgggaaagactcaataaaggcaagtcactaaaaaactattgctagtgaataatcatatgggagactacatttagagaaagaaatcttaaaaatctggaaaggtttggtttttaaatgttctcacaatactctttgctctactttaaaaaaggtcaaattggtttttgcaagaactatgatgggaaactccactagcagagccatcctcaaagataaagacatagtcctttagcaaatgatttatgttagagtttgaaatcaaatgtttacagaagccatgtcacttttatgttagcataccaactacccacttgtctcaatcatgatgggtaaaaagggattctacatttagataggcaaaagatacaaattcaaatcttacattcttattattccatttctgggtctctgtggctgtattccagcacaacctccctgaagtggggttctgagaactccttatgagtgaggggtatgaccaaaggtccaagtgccaacccaaagagggaaccagctcactctcactatcattttcctgagatcaccaacagtgcaagcacatttcccatacgcagtatggaaatgcttctaacctttggctaaatccctttagatcctataaccaaaagtgtattttcaaaggcagggcccatgatgggaagaatatgcaggatccaacggcaataaaaagaacacagaccagaatgcatgccctgtgggtgtgtctctccattttccactttaatcacagtataaataagaggagttactaccacattatatcgcatggggagggggagaaagaaataccactaggccgggtgcagtggctcacgcctgtaatcctagcactttgggaggctgaggcaggtggactgcctgagcttcggagtttgagaccagcctgggcaacatggtgaaaccctgtatctactaaaatacaaaaaatcagccgggcatggtggcgtgcgcctgtagtcccagctacttgggaggctgaggcaggagaactgcttgaacccgggaggcagaggttgcagtgagccgagattgcaccagggcactccagcctgggcgacagagtgagactccatctccaaaaaaatcaaaagaaataccacttaacaatagctagctggaagtggtagaaatatgcattttctatagggtataatggttaaaggcatgagttctggacctctgttacagactattattacaactccctccctggtctccctgcttctgctcttgctctcctacagtctaaacctgacacagcagccagaccctactacccctcggctgaaaaactcctgtgactcccccatctcaggagataaaactcttaaaatggcctacaagaccctctaagaagtgtcaagcctccgcccctaccaccatccctctgacttcacctctgattactcttgtacttttccagtcccagaacattgtttccttatgttctacatacacaccagggatacctccacccgtgggcctttgcatttgctgttctctctgcctaaaatgatcttgctcaaacagtcacataggttacatccttacctccttcaagtctttgctcaaatgtcactttctcattgaggcctttgccaatctatctaaaacctcaaccttttcctattccctccttaacacttactagcttatacacaacagtcttgcttattaatcatatttattatgtcttttccactacagtgtgagatgaaggcaggaactgtgtcttcttcactcctaaattcttggtagccaggacagtgtcttgtacatagcagacattcatcaagtacttacagaaatatcaaaggtacccttttctcctcctggcctgtgtatatacctggaagacgctttcctcctgcctgactgcaccatacacacccaagaccaaatggcacttcctccaagaagttctagcctataggtgtaggttgcctgaggtactttcattgtaactgaccactccctacagggtaagcttcttgagggcaacattgaggctttgcccagctccttatatattcactgagtgaccgagggaatgccaggtcctaactggccactcattcaaacagtcactgaatagctactctatgccaagactgatggggagaccttggagaacaacactagtgtgggtctggcctcctggagccttcagtcggttggggaaagagcagatgtttaactacacggatcctgactatgatgggggctaagaaaatagatgggtgcattgttgcagaattagaagcatgcatgtatgcatccaaagtgttacttaagctgtgctataaagaaaagagcctgtcatgcagtggggagtgggggcagtgtggtggcacctaagcaaaggggcagagacctccatgtgggaaaaggcttggagcattcgaggaatgaatgcaggccaaggtggcttgagctcctgggagaggaagagcaaatgtaacagaaagagacagtagcatctaagaactggttatttctacctccccgactttctgcactgctagaatacacctggtcaaaatcaaaggggtccaggggagggaatgcagagacttggttaagctttttagcaggaaaagaaaacaaaaaaacagaagaaaaaatagaagtaaaaataaacaaatgtcaccatgagcaccaaagggagaactgaatgctatgtgattaagttattcataaccttggcttcttccatgggaaacagcaggtgacaatatttttagagaaaattccaaggcagacaaatgatttccagtttatggatacaataaacccctcagtaattcataaaaatcagtttaagcctaaaaatgttctagttaaaacatctatgagtaaataggtgaatttatggtatgtaaattatattcaataaagctgttaccaagaaaaaaaaaggtcatggaccccactgaaaggaaccagagctctttgaaagatggctgataattggaccagagtagtgaaaccgagaaatggatgaaggaatggtgggagcctgtcaaaaaggtactggagccagcttaaagggctcctactggccaaatttaggatgatattagcatcaaaaagaataatgggtatcattgatcttaaggccctgacaaaaaatttcagcccacagtacagtcaaagcaaatagagggggaaaaagtcacttgcccccactgggaatggcaataccccatcagttaacattcatttttcattttaaaaattggtaattaaaggctgggcacggtggctcatgcctgtactaccagcactttgggaggctaaggagggtggatcacttgaggccaggagtttgagactagcctgggaaacctggcgaaacccgtctctacaaaaaatacaaaaattaggacaggtggcatgcacctgtatgcccaactattcagaaggccggatgggaggccgggatgggagtctgggaggtcgaggctacagtgagccatgatcaagccactgcactccagcctgagtgacagagacactgtctcaaaaaataaaaataaaatttggtatttaaaggtaaagaattactttaccttatcttatagaaggataacagctaataaatttagaaagaatgaaggaattttaaaaatcaacactttgtgaatgccagtgacttcttcaggggagaatgatcagatggtgtaaacaccactaggtgaaaggctgatgagcaagagaccatctatggctacctaagcactccacagatcactgctaaatgcaaagggaaaaatgtacctttacagaaaagatcaaatttagcatcacaactagtgatgtttcccatgtgtgctgaggatgaagtactcacactaaaatgtttaaacggaatctattcagacacttaaaagattaaacatccggttcagaaaatcaaggcagggaacaagttaaacaataccatgagaaaacagtaagacagatgtggagtattctataactagcctgctctctttgaagaaatcagagttattaagaaaaaaacagcgtaaggactcttctagactgagattacagacataacaactgcgatgagtgaggctcaatggaactgtggttttaaaaaagagcaacactttggagacaactgggtagtctcgataggcatttgcttcacagcaggcatcgttactcccattttatagacagcatgtggaagctgggaactgtgggacaatttgttcaagctctcatagcccgttgtatggcagggtcaagatcagaacacagcgaagaacccacatgctctttggggatcactgtccacctggcaccacttctgcccactgcctgagctggcactccacacacctgggatacaaccagtgtcctgtttctgcctttgcccccaaaagcccattgtccacacagtagccagaaggagcgtgggttgggggggcgggggcgggcattaaaagccaagccagccagtggctctcacctgagttagaaaaaggcaacgtttttataaaaaccaacgaggctccaccatcccctcatctcctgccacataccctttcacacaatccacttcctgttcctctaacgcaccggtcttcttactgttcctctaatgcaccgagcaggctccagcctcagggtcctgcactagctcttccctctgcctggatactctagacagccctgtagctccctctccaatgtcctttgagtgaatgttaaaatgccatttttttcagaggccttttccaatcaccctcacgaaaagcagccaacttcccttcccatccctcactctgctttaatctctccagcgcttcttactacctgatgtgctccatggccatactatcagtctcctcatcataagcaaagccccaccagatcaggtctttgtctatttagttcactagccatgtccctagagcctggcttgctgctgttgctcaaaaaacatctgctgtgggaaggcaaagggacttgttgcagccctgcccaacagttacagcctgtgtgcctcaagacagcacacgtcaggggaagccatctgaggcatctctgctgagggtgagcctccctccagacatcagatcaccaaccaagagatacctagcaagggagtggatggaataaagcagaggagaggggggaacaaagctaaggaaaagcaaggggcttgagggaggctgcagcaaagtggccacacctgtcccgggagcctcagcagccttcccagtcaacctcctgaggacatgaggttgaggggctcctggtttttctcagtcagaaaccgggaggctatacctgacttaaacctgatcccaaggacaaaatgtccagttagttactttttaagaagaaaaaagaaaacattccttcaatccccttggggctgctctcacaatggcaggcacacggcctgctgaagtaagtaaaagaggtctaaacctagctgtgtgccaggacaagctaacagtaaagatgacgaagctactggaggcagcagggaggcgccatgagaattccctggctcctaaaggcacttacttggcagcttacctttccaccacctccctcccacctcaatgcctgtcatgctcctaggagatgcttagctggtgatagtgaactttgtattttccctctggtaccacagaggtagtgcaggcattcctttgaggccttgctcatgctgtgctctgccagaaggtcacggaagtcaccagagggacccttgagagtgacatcaaggtgactgacagccattagtggcatttaaagcatccatgtggtaaaggtcagtctgtgctctgcacacctgtgatggctaaggggagattttggccaccttacttccacgcctctttctctggacccgtgcccaaatcagctgagtggacacctggcaagagctgactggatcaagagtgttcaccttactcaaactctccttctcagagaagtaacaatcagaatcacagccaagaaatctgagccagatactcaaaagaagacagagaagctggccatggggaggggggaggggggaggggggacgggggagcatgcaggggacttccaccacccaccagttgggagaagcagacaaacacaaatctctaacaggagactactgaggcagtcaggcaggaaacaaaacaaaacacaaaacaacaaccaaaaaacagagatgagaactagaggcatcatgattatttcttttcccttcttaggacccagtgggcttctgcctttgaaaacccctggaacctttataacctccaccttctgatcatgttcccccaagatggattctgttcccagtgacttaaaagccttaactgctacagatgagatctcccagtgcctacccactcctctcacgcccccacaggtctcaaacaggttattcctgggaggctggtgacaaagacccacgggaacaaagccaccagcctgctcgaaaacagtctattctgtgagcatgaggcagagctggcttctcactaaggcgtctttatagggcttatcaaaacgaaatcaaaaagaaagcttttgtcctaatgcatgccagggtcctgctgctgctctggaaacatgtgggtgcgtgccacccgcgagaaaaacacacacttcaagaggcactggaaaccctgatggtgttctgggtctcatgaccatctgttctcataggaaaaggctccagacatgctgtgtggggatatttcacaaagagacatggtgaagtgcggcactgcctacatgctggggtccagtcctgttggcagcaccagaacatgggcgagcatgaggggcagacgtgggagtgggacacatgctgccaagcaccctagtgtggctatgtacaagctagggtggggagggggtgcggcagaaggcagctcctcacggcttgagtcccaatctttgccccagttggctgcggaactgaatgaactgcccactcaccccagcactgtaaatggttactctcctcatccttccgatgacaaatcaccaaaaggatgcgctttcatctaccagacctcccaggctcaggtgctgactgtggcctacaaggacagctatctaaaacatcaaaagcactttccagcttccttcacggacatgagactgcctgctccccagaaagatgggtttcagtaactcctcctttggcagaatttttaaagttctagtccttaacttctacctcctgcccccatttctacccacggggaagggccacagaaataaaagggcatgggaggggggatgttagttgccttttcctctttccagtgaaagtcatttccctcaatagagggatccctccatgtttccatgatttggaagagaaaggtggagcttattcgtgagcaacttggccagaactgcccacagcctactacccaggaggaggaagaggaggagagggagtgggaaaaaaagagggaggaggagggggaacagaggaaagggtgggaaggttgagaaaggggaaggaggagggggagggaaggttattcgtatcaacaactgtggctacaccaatcactgccacccttgtgggacccacagccactgagtctccgccaactcagctctccccctcccccgcccccatacaaaccaggacaagcttgtaaggagaaggagtaagacagccccaaggcacacgactctgatgtctgaattctggctggggagggggaggtgtctaaaatttcctttggcttgtattatcactatgtattagcctccagatgcttatctttaaaatgaggacgagaaaagtctctacttctagaagagctgggggactaaattacacgtgcagctttcggtcagcctgagccagcgctgtcactgagccttggatttgtaagtggctcaaaagtaaaaagacggaagaaggccgtgcagctctacttcccccaaggccaggaagggccaaagcaatgacttaggaagtgggatgtttccccaccctaggcaaaggggcgaattccgagttccccggaggaagcagcagctctgcagactcggaattacctcgtcctcatctccagtgaagggagggatggaagtgggggcaggggcacagaaatggtacaaatccttcctaatggtccctggccagagctctgcccattcctgaaagtgtgaccttgggaaagtgagaccttgggaaagtgacttcgcctcgccaagcctcagtttcctcatctgtgcagcgggcataagggcagcatctaaggtgcagaaatgcttctgacgggtcagataacacctagcccgcagccgacgctcacagccgccgattcagacccgcccgggttccgcaagccccaggctgcccctgagccaccgcccaggcctcagcctcgggccatgcggacctcgccgccgccacgccccggaccccaggccccgggcccccaggcctcgacggccagccgcacccgggctgcggactgcggcccgggccccctccccgctgggcccccgactcaccggtgtagtgcaccacgcaggtctggccgcgcttggggaaggtgcgccctgaggagacagagacgggcatgctgagccgatgcgcgcggcggcagaggtactccgagccgccgcgcgccactactcaccgtctcctggggagatggtttccacctgcactcccatggcggcggcggacgctgagcgggcgggcggcgcgacgggcggcgtggaccaacagcgacctggcggcggttccacggctctgcctagtacctcggcgcgtcgcctgcgcacgcgcacgccccctcacgcccagccctgcgtgcgcgccccacacggcgcgcgacgtcccggaaacccaggcctccggaagagggaccggaagcccagaagccccgagacctccggaagcccggaggcctccggatacagctgtgtttgccgggtgacttgcttcgttctcctgcccttcctctgtgcttccagccggttaagcatctccctgcccaaagaatgggagtaataatagggggtccgccagtcactgactgggtgactgtcatcaggtttccacttagaagcacacagttactcatcctgggaagagcatggttctgagaagacagcgcacaggtggtggtagtatgttagtattttataagtggctcaaggttgtaagttctgcttttcttcactggaggaggagttgtccaaattcattcactcacccatagcttacatgcatacattcttattgagcatgtgaaagttgataatacgaattgggtcactcttcttatgcccaacggaatcagaatccaggggccaggggaaaagcactggaggcacgcagcgcctgctccaagaaccaatatttccactaactgctgcggaaatggcctgctgtccccctgagaccagattcagctagtaactgctgaaacaacccgccataacctaatactagttttacttaccactgtcagtcaccaatcagagcttgccagctccctgaaactttactagtgccaatgcatttccctttctaataaaacgcccagccttctctttgtttttcggacataccaaagaccaccagatctgtgtgtatgctccgagttgcgattctcgcttccccaaataaaacattacatttagagattcatctccatattttattttgactttgacaagcaccttctgtatgtcatgtactgtgctaggtgctgaggatacagcggtgaaggagtcagacttagtccctgacctcacagaatctacgtatgatgtgggagagataatcaaataacctgtttaagtaaaaaaagatacggaataaatgtaaagtttcaaatctgtaatattatgagacagtaatacatgctgtgaggggcgtgttaatataacagagatgcctcacttagtctggaatgtggtcagatatttccctgagttagccaggtttagccaggtttagccaaggttagaaggccaattgtgtgtatgtgttggggtaaggggaggcagaaggagcagtacctgcagaggcactgtaacgcaagagaacactgtgacatggtctaggacataaggaggcacatgtgactaatctttctctgatctgtgtgtgtgtgtgcttctgcattagtcgattctcacactgctataaagaatacctgaggctgggcacggtggctcatgcctgtaatcccagcactttgggaagctgaggcgggcagatcacttgaggccaggcgttcaagaccagcctggccaacatggtgaaacccagtttctactaaaaatacaaaaaaattagccaggcatggtggcacaggcttgtaatcccagccacttgagaggctgaggcataagaattgcttaaaccaggaggcggaggttgtagtgagccaagattgcacctctgcattccagcctgggtgacagagtgagaaccagtctcaaaaaaaaaaaaaaaaaaaaaaaattcctgagactgggtaatttatggaggaaagaggtttaattgactcacagttctgcatggctgggaatcctcaggaaacttacaatcatggcagaaggggaagcaggcatatcttacacagcagcaggcatgagagagagtatgtgaagaggaactgtcaaacacctataaaaccatcatttctcatgagaatgcactcactaccatgagaacagcatgggggaaaccacccccaccatccaatcacctcccaccgggtccctcccttgacctcaggattatagggattacaattcaagataagatttgggtggggacacagaactaaaccataccagctcctgtagtgttttaaacatgacctcacagttttttgacaccccaaccctcatctatgtcccctttcctaaaatctcagtgagctcgtgactgctttggaaattttaatgtagtaagaatacaggctgtaacagaaccaaattaactgtggctgaaaagaggctgaagttgctgtctctctcatgtaacagttcagaggcaggtggttcagtgcaggtaggacttcacaggctgcccagggactcatccttcttctacttgtggctccccatccttagaatcctaccctcatatgcatggtccaagttggctctccaacatattttcatctcagctagtgggaagggggaaaggaggaatggggggtacattcccttttcctttaagggtacgacttagaattgcacacatctcttcccgttatacttcacattgactataacttagttatatggtcaaatttagctgcatgggaggctagggaataaagtcttcattctgggtgtacacacacccaactaaaatcagaggttctgtgctcatagaatggaagaatggagatcgaaagatgaaattaaaaagagggccccagcagtcgccaggacactgcttcacaccacctagagaaaatcagactgcagcgagaataaatgatggagaatgagagcaaccaggggcgagagagttcctggattccgttttccctgaagcctagcagaataaggcttgcctcacattcatcctgtggtctctctcatggctctgaattgggtatcggttcaaaacatagacctgcctttgagacagtggccatctcaatccatggatataagctttgtttatatagatgggggttccccaagaacctcacatttgcaccacttcttcctcagtgctttgggaaaacacaggaaagcatgtagctatcagttctgccaccagacctaagatgaattggacctggggacaaggggcacttattaagcatttatctgattttttgaagtaactgggagagttcctttctaaattaatttagattctgtttatatatagcctagttattaacaactctgttaagtagttaagttctttgggatcacccttagcaaaccagaacaaaaaacagaaagagtgagtgactctaagagatggaactgggagaaagagcaggagattctgactttcatttaatatcattctgaactgattaaatttattttcactctctttgtgtaacaggagacagggaatcatttcagtctgaagtcataagcatccctcatgacaaggggaagtgactccctccctgaagttctaaaacctgaaaaatgggggttggatttcctttggtttatcctgtttgtggtttactcagcttcctgagtctataggtgtatgcctttcaccacatttgggaagttttcagccattatttcttcagatattttcttctgctccattctgtttctcctgttcttctcagatcctggtaacacgaacattagatattttggaattgtctcacaggtgcctgaagttctgttcagctccccccagtcctttttctctgttgttcagattggataatttctatttttctatctttgagatcactggcatgtttccctgcaatctccattctgctattgtacccatctgttgggagctgaaaaggccaaagggattgtgaccaactcagcattccactgaaggatatatgatcaaacagcaaactgtttatcatgaatgcaggatgtgggcaaactcacaactgcgcctgccgccaggaggtttgctgagggccctggcgccatgctcattgagattatctactgggacatctagatcctattgttcaaagactgcagtcttgcaagcctgctgtaaatcaaactgctaaccgacaatcaccccccacttcttgctatctcttttgcctaataaatgtgaagggctctaaagctcaggccccctgtttaccagaagcaaggagccccctgaccccttctttcaaatatgctctcttgtctttgtcttttattcccatgtttgccccctttgttcagtcccccaaggtctgtgcaggtgacaagtggcgacccagaacagggactccaaggatgtcggacacgtggcatctgaacacagggactttgaagacgtgaatgaagaagctctgctggagcagaggaattgaaattgacaagatgaacggggaccccaggatgagtctgctggcagcagatagaaggtcagtgccctaaagaggtactgggaacgatataaggtcagtgctctaaagaagtacttggaatgggaagttttctgaatcagggtaacatgaagcagaatttgtctattgaagaaaaacatcatgtgcagttgcttaaagttctgttgagacagtctggagctcaggttaattcgcaggcactaactaacctcctgcagaagccacaaaaggttattacgcataacccatggtttccacaggcaggcactcttgatgtggaaaattgggatagaccaggagaaggattaaaacaggctcatcaaaaaggtcctaaagttgattcttctgttttctccacttggagtctagttcgtactgttcttctgctatctccttattattctgctggacagcaggctgagtctaaaaaatctgaaagaatctgttgtcccacccacagctccaattgaaaataaaaaatggagagggaggataaaaattggcctacaccgccccctccagttgcagaaacatctgtaccgcctcctttggtagcagaaatagtgaccccaatacaaagaattttatgctctgctgccatagctaaggggagcccttaggaccttgtacttttcctatttctgtaagtgtaacgagtgtagctaataatggggtacagagcccattcactttaggattggtagaatctgcatttggtgctatgtgtcttctaccctttgatgtaaaacacttggctcaaacttgcttgtctgctagtgcatatctgacgtggtatttaaattggcaagaactgtgtgcagaccaggctagacagaaccatattgctggacatggagacattacagaggatatgctattgggtaatggcccttattcagacctggaacgtcaaatggcactcccagacgctgcttatcagcagtgtgcacaggctgctaaacacacctgggccacaattcctgaagagggagtcccagtactgtcctttttacatatcatgcaagggtcacaggaaccctacgcgcagtttcttgcaagattacaagaggcagtgaagcatcaaattcctcttgccactgccacggaaatgctaaccttaactttagcttttgagaatgcaaacgcagattgtaaacgtgcactggcacctgtgaggtgtacaaaaaacttttctcagagcttgtcaggatgtaggaactgagcttcatgggtcttcaatgttagcgcaagcaatggctaatctagcagttgacaaatctaaaaggagccaaggattaagccctaaagtaggaaaatgttataattgtggaaaaactggacattttaaaaaggaatgctgccagatctcaggacagaaaggatcttataatgcagtacccctccctccatagtggaaaacatgccaggactctcctcgctgtaacaaaggaaatcactggggtaatcagtgccgctcaagatttcatcagaatggcatcccccactgtcgggaaacgagaagggggcctggacctgggtccctcaaacaatgagggcattcccagttcagaccacaaccccatttcaggggcgggtcccaggagaaacattgattccctcattccaggaacacccagaagtgcaggattagatctcccagtcagagaacaggtaatgttagttggtggagacaaacctatcaaaattcccactggcatctggggacctttaccagcaggatacaggggactaattttaggcaaaagccaccttaacttgcaaagcattactgtagtcccaggagttgttgactctgattatgaaggagaaattcaagtagttttaatgtcacaagatctttgggtttttgaactgggagaatatatagcacaattattgcttattccctgcaaattatacccttctccactaaaggagaaacaaggaaataaagggtttgggagcacaactacacgagaaatctatttatcacaatctatagcctctagtaggcccacctgtgtagtacaaattaaaggaaagaaattttatgggcttatggacacaagagctgatgtgtcagtaatatccagtaaggactggcccccagcatggcctctcagaataactgccacatccctagtgggagtaggagcagctaaaagtgttcaacagagtgctgagatttttatcttgtcttggtctggatggacaatcatgtacttttcagccttatgttgaaaatatagctatcaatttatggctataaattgatagccatatcagtttatcgagatttacagcatgggatatgagacttacatatgaaaactttgataacccaggatttaaaatgttgaaggacatgggatatcagagtgggaaaggtttagggaaatccctacaaggaaaccctaacccgatatcagtaactggaaaggcaggttaaaccccgcagggagattcttctttagattccccgcggcaattaaccagaggcagaagttgagttcggcaatggcatgcctcccagctacagctacagaaacctttgatttcattatccctcagacaaaattttgcagttttataaagtccattctttcattcttcctgtgattactcatcacaagcttattccaggtggccagacttattttactgatggctcttccaaaggtcatgcagctatttatggacctaaacatactcaaacaataatgacctctggggtttcagctcaacactcagagttgattgcagtcattcaggttttacagctcacagctgcagatcctatcaacattgtctgtgattcagcctatgttgtgaatgtaaccagtcgcatagaaactgctacaattaaaagtactctagaccccgaactgcttaatttgtttcacttattctcatatgctgcctgctacatgccaaacaggtgagacagctggtcatgtacggccacattgtctgtcatcatttgctcatatggggattcctaaacaattaaaaactgacaatggacccgcttatactagtcatgcttttcaaaatttcttacagctttgggctataacccataaaacaggaattccttacatcccttgaggacaaggcattatagagcgggtacatcaaacattacaatgtatgttgaataaacaaaaagggggattaggagaccagttaccacctcaaacaaaattacatttagctttatttactttaaattttttgattcctggtatggatggtaagactccagcagaaagacattggcaagtgttagaggaaaagaggaaagtgtatccaaaagtgttatggaaatccccagaagaaggacaatggaaaggtctggtggctttactgacatggggaagagggtatgcttgtgtttttacaggagatggacaaactgtgtggttgccctcaaggtgtgtgtgaccatggaacaggagactggaggaacccagggtggccagccatgggcctggcccctccagtataggccatgagccagctgagcttgagtgcgaagatgcggagaaggccgaccggggtcacgacacagtcttaatgttacatttgtaaagaatatcaccactcaatttatggtttgtgggtttttttttttttggttttttgttttgttttgttttgttttttttgaggtggagcctttctctgtcacccaggctgcagtgcagtggtgcaatcttggctcaccgcaaactctgcctcccgggttgacaccattctcctgcctcagcctcccgagtagctgggactacaggcacctgccaccatgcctggctaattctttgtattttcagtagggatggggtttcaccatgttggccaggatggtctcaatctcctgacctcatgatctgcccgcctcggcctcccaaagtgcttggattacaggtgtgagccactgcgcccagcacggtttgtgtttttaatccttatgtctttctggcagctaaaaagcaccagctccaggtaaacaacacccaattgacctgtaaatcttgtcagttatatcactgcattaatcacagcacattgcaaacacagaatacctctactttgatcattctgggtcgcatccctggactgtggattcctgttcatccatccaagccttgggctgccacccctgctttacgctttgtgaaacatcttctaactcagcttactcactgtgtccgtagagccttaggcatgatcatttttactattgtttccttagtcacactgataacttctgttgtgatgtcctctgtagctttgcataattctgctcaaatggctcagtacacagagaactggacacagccaaccaagtacagccaaccaagtgtggctacttcagaataaaattaacactgagttacaaactgaagtgacagtgttgaaatccccatggttaggggaacaagtgcaaaggttacaattgcaacagcaattgtgctgtcattttaatcacactcatatttgtgtagccaacttagattataaccaaagtgagtatccgtgggaccttgtgaaagctcatttgcagggagctttcacatccaacatcacctttgatattggtgaattataaaacaaaattcttgatttacataggcaaactcaagagtttcagccttctttagaagactggaccgaattccagcaaggcctggagagcctcaacccttggacctatctaaggccccacattaacatcttatatgtagttcttggaataatgttgttttgtctctgtcttctgttcatcgtctgtgaaatccgttggactgccaattggaaaatgagagctgcccagcctggccttacgttctttcaattaattcataaacagaatgggggaatgttgggagctgaaaaggccaaagggatcatgaccaactcagcattccactggaggctatgtgatcaaacagcaaactgtttatcatgaatgcaggatgtgggcaaacccacgactgcgcctgctgccaggaggtttgccaagagcaatcactccctggcgccatgctcattgaggttgtctactgggacatccagagcctatcgtttgaagaatgcagtcttgcaagcctgctgtaaatcaaactgctgaccaacaatcaccatcacctcttctcactatctcttttgcctaataaatgcgaagggctctaaagctcagggcccttgttcactagaagcaaggagccccctgaccccttctttcaaatatgctctcttgtcttcgtcttttattcccatgtttgccccctttgttcagctccccaaggtccatgcaggttacaagcccatccgggaatttgttcttgttgttctcattttattttttagttctaacatttccactttattcttccttatatgttctattttatttgcttcaactttccatcttggctgagtgtggtggttcacacctgtaatccctgcactttgggaggatgaggcaggcagattgcttgagaccaagagtttgagcaacagcaaaggtgtgtctctaagctaaaacacctacagcctcaaaagcagaatgtgcattctgaaagggcctctgcaaatctgaagtttggaaacatagctgagatggatggggtctgaggtccccaaggtggaactgccaaaactcccaaccaccttcttctccctttgagctcctatggctctcttcttttactcaatgga

SEQ ID NO: 343 - DNA, 34943 bp, Homo sapiens
aggctgcagtttggagaacagcccgtaggcgtggcagttcactcctgttgcattggaatttcatttccttttgatttggtttgtagtagaagtaatatctttcttcctgggaatacgtctctgacggacattttgaggtcattttcttaaatccaagatcctaaagatctgtagtcgaacagagaaaactggtttgctctctgtcttaaaggctgtccccacctttcgaggggcgagggaaggatcataaaatcatttatttttattttttaattaactaatttatctattttttgagatggagttttgctcttgttgcccaggctggagtgcaatggcgcgatctcgactcaccgcaacctctgcctcccaggttcaagcgattctcctgcctcaacctcccaagtagctgggattacaggcatgcgccaccacgcccagcttatttttgtatttttagtagagacgtggtttctccatgttggtcaggctggtctcgaacttctgacctcaggtgatccgcccgcctcggcctctcaaagtggtgggattacaggcgtaaaccaccgcatgcggccatctatattttattttttgagacggactttcgctcttgttgcctaggctggagtgcaatggcgcgatctcgactcaccgcaacctccgccttctgggttcaagcaattctcctgtctcagcctcccgagtagctgggattacaggcatgcgctaccacgcccggctaattttgtatttttagtagagacggggtttctccatgttggtcagtctggtctcaaactccggacctcaggtgattctcccgcctgggcctcccaatgtgctgggattacaggcgtaagccactgcgcccggcctattttatctcacaataagacatgaagaaaatggtaactataacacttgcataattcataaagtcctttctgttggttatctcaattctgtgcacaacagtcaaataagcagattttacaaacgaggagctggagccctgcaaagttaaaggactttcctaggatcctacagctaatatagagacaaattgaaacaagttatctgattgtgtattttgagttatttctactcccacaaaatgactgtgttcatttccctaaaacgtaaagcattatattttaagtgggtagagagggcttacacaagttgatgttccctcatttagaaggcaacttagaaatacattgatctgcccagcgcggtggctcacgcctgtaatcccagcactttgggaggcaaaggcgggcgaatcacgaggtgaggagatcgagaccatcctggctaacacagtgaaaccctgtctctactaaaaatacaaaaaaaaaaaaaagaaatacattgatctgtgtgatcgaatgtgaattaacaatgacgttgacttgatactacatttctgagtggttaccacattttattgattgtatgcttctcaccagactgcaacatcctggaggacagggagctaattcttaatcattttgtaaccatagctcctaatttggtggatacatagtaactatcaaataagtgaataataaatctatgggaagaagcagatggactccgtcttgaacccactcaatttttcccccatcaattacccctctctcgtttttcaatactgggtctcttgcagagttgcagtggcggccacctggtcagtgaaatcagcgaattgaaaaaccactgacttcattaacatgtctaaagaggcaggctgaaaaaactgaaaatctatcaggcatctcattccatagttccctgtttgacaagaagaccaaggtgtcttcaaagtctgccctaaggtccagatctcctacccacgtaggagacttctagtttcacaaatccccgatgtcggtttctctaaactattttattctttgaacatactctccagacaacatcgctatcctgaaaagcccttgctgcaattttgtttctctttcaaaacaatggctcgaaaatttccaaggaaatagcaagagggcgattcccttcttgaagtatttgagggagcagaagcttactgaagttcatgccttgggtcaccaaaggccaggggaggcagagcacggtgccagacttctccccatttttcgctgaactaagcaatcctttctcccctagaggtactgcagctgggagctttcagggcgtgtcttccccaccacccaacttctggaaccccagacttctcaattcctgtacccccaagaactgctcactttttgtacaaaaacctcaggcatagaggaaaggaatcttgcgcaaggtcgtttttcatttacaaaacaaaaaccccatgaaaaccaaaccggtacccacccattcgtcacttcattttgcagcatggacaacaataggggactacaactcccaaagaggactgcgctcgtccactggctcagaggccaatggacgcctggtacatgaccggcatcgactaatcagggccaggctcgatgaggctttgtctccctaccgcgcgcggggccgattctcccgcctcccagccccggcgcacgcgcgccccgcccagcctgctttccctccgcgccctcccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaaggtaagaattttacacctcttttatttctttttacaaggaaaaatccaggtaagttatgaaaaaatggttgtggggcatttgcacccgctatccttaatcaagatttgcccctctcaagtttgttacatttatatatataacaattgtagctagcatttgcctttggaaagctgggaatcatttttcttggcaggcacattttggagaaactagtaaaagggctcttcgggtttgggggcgggaagaccgaggacttataagatgttacttaaaagggcttctaacggtccgagaaccgggcagggagagagatgcggaaacggtcgcagacaaagcggggcgaggttttgcccatgtgcatcccgcccaacccccctgcggggtacttagggccaaaccggagcgggaaggggtgaggccatcgggcggctgcagagagctccagcgcaagggtggggggcgatgcgccagggtgggctgcgctgggcgctacctttcacaaaagaccagggaccccaacgcgcccgcgaccccagagggccggtcctgtatttgttcctgggtggaaggagaataagaacgggattaattttacttgctttcatggcccctaagagagacttttttagggcgtgaacagatatgtcgagaaaatgggggtgtgtggttttctttaatgagtccctcaggacttaatgggagagaaagaatcctttaaatcaaggggtagaaatgtagcgaaggaataaaaattccgaggccaagggggattttttttttttgcgcgcggttacagtgtagcgggggaggggcgggaggaagtgcggctgctacgttgtagcagaagggcggggccctgcggggcggggccggggcgccgtgggcgcgcggggacaatgcggcgttgcccgccggcaggggcgcgctaccttgggccccgcccctcgcgcgcggaatttttgtccctggccccgcccacgcgcgaagtcttttgtcggcggctcgacctgcgcgtgcgccgcagtcacgtggagggcggggggggtggtcgactgcggcggcagctctttcctcagacccccagccttttgtgcgccgcgcggtggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaaggtgggcggatcacgaggtcaagagatctagaccatcctggccaacatggtgaaacccgtctctactaaaaatacaaaaagtagctgggcgtgttggtgcgcgcctatagtcccagctactccgggggctgaggcaggagaatcgcttgaacccgggaagcagaggttgcagtgagccgagatagcgccactgcactccagcctggtgacagagcgagactccgtctcaaaaaaaattaagaaaaagatgaaataaaatggtagttggggacatagttggctgggacttgacctgttgtggtctcgttgctccccctcggcagttctgggaggtgatcagtgatgaacatggcatcgaccccaccggcacctaccacggggacagcgacctgcagctggaccgcatctctgtgtactacaatgaagccacaggtaagggcaggagcccgggcagctcaggttcccttccctgtctcccacttatctgggatctctttccatttctgggcacgccttatcccctttgggtgaatctgtcattttgtccctttcgtgaaccaccgtcggggccaaagacgtctgctgccacctggtggcgggacctggaatgacaagtctctgatccctgctgtctcccatttccagtatatctataaaccttcccttctgccagatttcacagctcttaactttattctctgtaggtggcaaatatgttcctcgtgccatcctggtggatctagaacctgggaccatggactctgttcgctcaggtccttttggccagatctttagaccagacaactttgtatttggtgagttatacagatgatattagcagatgatataccatcgtgttcaacttatttgggtgcaaggacacagcaaaagttaggagatgattgttgtattggagtgctaatacagaaatgtgttctgaaatctaacggagggtagaggtagtgcctactattgctggtaaattatggggcagtagggggagaatatatcacagtgaaggagaaagaagatacatccgagggaattatttgaaaagttgaaagatggaaacatcatgtatcttccataccctgttaattgagcttttctcctgactgcattccaggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctgcgagatgtgtgcttatttagggaaacacggctggctgatggaggcatggggcctgagttcagttgcactgctctccttaaattgacacttaatattgagtccctgtcctacggattcaaccaactggatattgggaaaagagttgtactggacatgtatagacttctcattattccctaaacaataatagtataaattatttacataatatttgcattagattaggtattacaagtaacgtagagatgatttgaagtacacaggttatatgcaagtactacattttatatgagggacttgggtgtctgccgatttggtatctcagggaggtactggtaaggacactgactgctttatagaccctcacatcattgtttctggtacccaaactgctctgagcaccagtcagtctttactgtagtctctgacagctcactacagccttgatgtcctgggctcaaacaatccatctcattctcccaagcagctgggactgtaggcataagccaggtgagccagtgcaccaggcccaccaatgagtcttaactggggaaggcataggcttagatgcaggatccagggatggaaaatggaagctgagaagaatgacaaatcacgtgtaactggtttccagaccagcatccacatcctctgggaacttgcagaaataaatgcaagtttttcatcccacccagatgtactgaaccataaatggttgaactggccttggccacccagcccaggattcctttgggttatgtgtacccatggccatttcctgtgatcctgtgggcttagtcaacctatgacaccaagataactagtgaagccctggtatggtggctcccacttgtaatcccagcactctggggggccgaggcaggaggatggcttgagcccaggagttccacaccagcctgggcagcagtgaaccatctaacaaaaaaaaaagctgggcatggtggtgcatgcctgtagtcccagctgctggggtagaggggggtggtggttgttgggggtaggggggtggggattggatgggaggattgcctgagcctgggaggtagaggctgcaatgagccctgaccctacccctgcaccccagcctgggtgacagagcaagaccttgtctttttttttcttttttcttgagatggagtcttgctatgttgcccaggttggagcacattggcgcgatcttggctcgctacaacctctgcctcccgggttcaaggaattctgcctcagcttcccaagtagctgggattacaggcacccaccatcacgccgggctaatttttgtattttagtagagatggggtttcaccacgttggccaggactggtctcaaactcctgacctcaagtgatccacccgtctcagcctcccaaaaagttctgggactacaagcatgagccaccgtgcccggcccaagcccaagaccttgtctttaaaaaaaaaaaaggataactaggcgggattgctaccttatggtcccattctaaaacaatctgtaccatctactacctcatacttttaagttcacaatgcaagtctcaaagctaccctgaaaacaataattccttttgccatgttttcaggaattctaggaactagtattattcccaacattccttctattttagcatgcttttctgactataatacactgttggggggaaaaattaactctaaaactcttgacagtatataagtaacttgcttttctcccattctagaaagcctattgtatgcaagaaagcctattgtatgcaagggaagaagctacattctagcattcattttctttctaatagagccaggatcttgctttgtcacccaggctggaatgcagtggtgtgatcatggctcactacagccttagactcctgagctcaagtgatcctcccaccttagcctcccaagtagctaggactataggcaagagtcaccatacctgagtctagcattcattttttttctctttttttttgaaacagtctcactctgtcacctaggctagagtgcagtggtgcgatcttggctcactgcaacctctgcttcccaggttcaagtaattctcctgcctcagcctcccaagtagctgggactactacttggcatgtttcaccctgcctggctaatttttgtatttttggtagagacaaggtttcgtcatgttggccaggctggtcttgaactcctgacctcagatgatctgcctgccttggcctcccaaagtgctgggattacaggcatgagccactgtgccgggccaagcattaatttccagttgcttctgttttattagtacttacttacagcaatttatttgggtagcaaagttgaaaacctccagcccatccctcagtcttggtcaggaaaatattctagacaacaggctcaaacagtctgatttaattaggaagttaaataagttgaggtggggtggagtgggatcatcagaaggctgacatgggaccgctggagttggcaatcatagcagtgtgaggttggcaaggggagcaacccccttcaagacaaggcacaaactatttggcaaggagagatgaggggtgggacctcactgtcaatggacatgctcagggaggccagtgggttacatgcaacaggaggatcattcaggcaacttcagctatgaggctgggcatctgtgagggctgaaggctcaggctgttctcaaaggcttgtgattcacctggcaaaaagacaacagtagatgacacttgggaacattcgggaggctgaggcccctactctcccgggccccagtttagacgaatgggctataggcagaacacacacggccagggttctttctggtgccctaccacctgtttccccaaacaaagacatcaggacccacatacaataaatcactgaagagaggagagggggcagagccttgtttgcacactctccttagctctgaatattctactgcaggcctccaggaggctccaaggaacccagcttgaaggtcattggtatgatccagtgcttttatttacatacgctttttttttttctttttttttttgagacggaatctcactctatcacccaggctagaatgcagtggtgcgatcttggcttactgcagcctccgcctcctgagttcaagtgattctcctgcctcagcctcccgagtagctgggattacaggtatgcgccaccatacccagctaatttttgtatttttggtagagatggggtatcaccatgttggccagggtgatctcaaacttctgacctcagctgatcgtccaccctggcctcccaaagttctgggattacaagtgtgagccacagcacccagcccgaatatgcatttctttctctttttttttttgagacagagtcttgctctgttgcctaggatggagtgcagtggtgctatctcggctcactgcaagctctgcctcccaggttcacaccattctcctgcctcagcctccccagcagctgggactacaggcacacaccgccacgcccggctgttttgtatttttagtagagacggggtttcactgtgttagccaggatggtctcaatctcctgacctcgtgatccgcccgcctcagcctcccaaagtgctgggattacaggcatgagctaccgcgcctggaatttttttttttttttgagatagagtcttattctgtcacccaggctggagtgcagtggtgtgatctcagctcactgcaaccttcggctcctgggttccagcaattctcctgcctcagcttcccgagtagctgagattacaggcatgcaccaccaagcctggctaatttttttttgtatttttagtaaagatggtgtttcaccatgttggccaggctggtctccaactcctaacctcaggtgatctgcctgcctcagcctcccaaagtgctgggattacaggcgtaagccactgcacctggccccatttctttaacatacacataatgcttactatataccaggcactattctaaacactgcaaatatttgctcgagcccctcaacaattcaacagggtagtttctaattattaacccaattttaagatgaggaaacaggtatagagaggttgattacttgtccaagattacagctagcaggcattgtagctaggattcgcaacaaaacagtggttccagagcctgtttgctgacttctaccatgatctacaggtgaattaactggggcgctgagaaaagcagtgatatgccctagaattaattaactgtcaataggctgcaactagttccctatactagtggggtgaccacaagcacaggttgcagagacagtcgacctggatttcactccagctgcactagcagaatgagtaggaacatgctggatgttgagtttctggactttgtaaaatcctatataccctaatggtagtttgatttaaaacaactcatttatgtagaagcttagcactgtgtctggcacacagaaagtgattaataaacatcaatgactcccaggcctggatgctggttaaatgctaggcatactgtgtcacacaacacaggaacctagcaattctcctcagctccaacctgagacctcacctgggagatgctcacgcctgtgagtctttccacactctctggcaggcgagttagaatgtccagtacttccccagtcactttggctgcccccatggtcccactgccgctggacaccagtgtgatcttattggctgaagtcaagggaccactgatctcctctgccacctggcaggagagagacacccactcagtgcccatgatctgaccacattcctcataaaacaacttactctgggttttaaggtcctcgttccactgatcatccttcctcactttggtcactaataattcccacccctaatttagagtccccctaggctgtttctccctaagcccctcactacaccccaccccttagtccctggttctatttcctcctttcttggtgcccacatgacctccagacctggggcagcttctctagcagcatgtccagctgagcagcctcttggtacagctggaaggcttctgccttcttggccatctgctcagcctcggctcgggctcgggcccctatggcaaaggcctcagcttccccacgcatctgagggttaaggatgcttgtgagattgacggaaatcattaagaacaagaaatccccgatcaagcagcaacccccaccctctccacaagccagcatggaactgcctcttaactcacccgcacagacgcggcttctgcctccgcctgcataattagttgggacctgtggacagaagggaagtggagggtggagcccagcagcccttactcccaggagaaaggcccagtgctgcagaggcagacgctcctgaaacctgaaatccataggagtccaggtggtgaaggcttcagcactccatcttggggtgcctaggtggcaagtgagctaggcagggtcagggaggggacatttacttctctgcctcggctaggcgctccagcttgtagcgctccgcttccgctggcttccgcacccgggcctccagctccttctcccgccgggcgatctcctgctcctgcactgccacctgctgggcccgctccaccacctgcacctgcacccgctgctcctcaatctgctgcttagtcttggccacctgggtaggagggtgaagtcaggttcacgctctgagtcagaggtgaagagcaagtgcccgggaaccagagctccagagtgggatataaaaataggagccggtggccgggcgcggtggctcacgcctgtaatcctagcgctttgggaggccaaggagggtggattgcctgagttcaggagctcgagaccagcctggccaacatggtgaaaccctgtctctactaaaatacaaaaaattagccaggtgtggtggcgaatgcctgtagtcccagccacccgggaggctgaggcaggagaattgcttgaacctgggaggcgaaggttgcagtgagctgggatcacgccactgcactccaccctgggcaacagagtaagactccatctccaaaaaaaaaaaaaaaaaaaaaggagcaggtgcatgaaggtgggttccctcctgtctgcttggccagtccagtggagtccagtgtttctctgatgagcccccgtttaatctatttttcccacgtgtgcccccttctagagtataaataccttgagggcactgagcacatgttggctttctgctatctccagtcttgctcaaatccccccactgttgctgcgataaccttagtgctagcctaggctactgcaatagctgacttattttttgtgggggtggggacaggtgatcttttttgtcttttgcacatggtgcagatttaacagaaaaaaaagtgaaccacgaggcttcttcctcattctccaaaccacctgggtccctttcccagagaaaccaccaagaccagcttcttgtgtatccttccagggatactctgaacatctacaagaatgtgtgtattcatagaattcctcttatttaggcagatttctttctttttttttgaggcagtttcgctctattgcccaggctggagtgcagtggcacgatcagctcagtgcaaccttcacctcccaggttcaagctaatctcttgcctcagcctctcaagtagctgggactacaggcatgtgctaccatgtctggctaatttttgtattttttttagtagagacggggtttcaccatgttggccaggctggtctcaaactcctgatctcaagtgatccatccgcctcagtttcccaaagtgctgggattacaggcatgagccatcgcacccagcctagatttcatcttcttattccttgcagtgtgagggaatcagaaggctcttatcaagatgctagtgaggagaggtgccaggcaaggaacacattttttttttctttttgagacatcatcttactctgtcacccaggttcaatggcgtaatcatggctcactgcagccttgacctgcctgggctcagatgatcctcccgcctccccctctagagtagctgggactacaggtgtgaaccagcacacccggctattttttgtactttttgtagagacagggttttctatgttgcccaggctgatctcaaactcctgggctcacgtgatccacctgcctcggcttcccaaagtgttggggttacaggcatgtgccatcacacccagccagaacacatgccttcgttgtcccattgctcaggctcagccatgcaccatcatcattgtaggtctcatcaatacatgtgatgcttcccctgcctcctaccttcccccgggcccatctgttcactccagagagaagcatagctctggagacggcactctgtactgtctttcaccctaaattttcaaacccgttccaaactggcctcgttgccctctacaccggtgtgcaggatcacctctctcctgtgtcccttaggcaaccatttgtctgtttctttttccttcctgtctatgcccaccttttggtgaaactcaacctccagaagcttcctcagaaagaatataaagacaatattttttctgaggtcttgctttctctgagatttttattctacctttttttgagatggaatttcgctcttggcacccaggctggagtgcagtgacgcagtcttggctcactgcaatctccatctcccaggttcaagcaattctcctgcctcagcctcccatgtatctgggattataggtgcctgccaccacgctcagctaatttttgtgtttttaatagagatggggttccaccacattggccaggctggtcttgaactccttatctcaggtgatccacctgcttcggcttcccaaagtgctgggattacaggcgttagccactgcacccggcctctacccttctattttaataccagttaggctgaaagcaggctgctatgttgggattaactttccatcagaattctgaaggcattcctccatggttttctagctttttaagaaatctgggcttgggccagtcatggtggctcatgcctgtcatcccagcactttgggaggctgaggtgggcagatcacctgaggtcaggagttcatgaccagcctggtcaacgtggtgaaaccccgtctctactaaaaatacaaaaattagccagcaatggtggcacatacctgtagtcccagctacttgggaagctgaggtaggagaatcgcttgaacccaggaggcagaggttgcagtagctgagatcacgccattgcactccagcctgggtgacaagagcaaaaatccatctcaaaaaaaaaaaaaaagaaaagaaagctgggcttgatgcagtggctcatgcctataatcccagcactttgggaggctaaggtgggaggataacttgaacccaggagttcaagaccagcctgtgcaatatggcaagatctcacctctagaaaaaaatttaaaaattagctgggcgtggtggtgtgcccctgtggtcccaactactggggaggctgaggtgggagaatcacttgagcctgggaggttgaggttacagtgagccttgtttatgccactgtattggacaacagagcaagaccctgtctctgaaaaaaaaaaaaaaaaaaaaaaaaaaggaatctgaagtcattttgaagcctgcctctttgagatctctctctctctagaagctttcatattttttgtcctcagcattcttaagtttcacagtgttatgtttcaatgtatatatttttcattcattgcattgggcacttagtagaccatttcaatctaaaacctcatttttatataatttttctcagaatgtttctgctcccaataagtcatgccacatttgcatgtgcttgacttttttttttttttttggagatggagtctcgctctgtcacccaggctggagtgcagtggcatgatctcatctcactgcaacctctgcctcccaggttcaagtgattctcctgcctcagcctcccgagtagctgggactgcaggcgcgtaccaccacgcctggctaattttttgtatttttatagagttggggtttcaccgtgttagccaggatggtctcgatctcctgacctcgtgagccacccaccttggcctcccaaagtgctgggattacaggcatgagccaacacccctggccctgcttgactcttattagtccctttcccttacttccctgcttctttctgtggggttttatttttcccctttgtcagctcttgccaggttaccaagcataccctgtccctggctttcttggttgctcccaaatctgtgatggcttgctctgttgcccaggctggaatgaaatggcacgatctcagctcactgcaacctctgcctcccggattcaagtgattctcctgcctcagcctcctgagtagctgggattacagtcaccatttcagctaatttttgtgtttttagtagagacggggtttcaccatgttggccaggctggtttcaaactcctttgtcatctgctcagagggaagaaggtctcaacactgaaaggaagctctgagtatgtgggtgaggcttgctgactttgagcttcaccctacggtgatctggataggccatgtacggagaaacatctgattcaggattttaagttatttctttttggattggtcatgttccccagagcagtcttctgatctcttttttggaagatggaagttctgggagctgagtggggttgagggggttggggttggggttggctctcagtatttagcattcatgaaagttatagtcatttcatgcccctgttactggtaaactatctaggtcctcacctgtgctgggccagcccccatcacatcctctagtctactctcttcagataatagacttccaatggcaggtatggtaactcacacctgtaatcccagcacattgtgaggctgaggtggatggatcacttgaggctagcagttcgagaccagcctggccgacatggtgaaacccctctctactaaaaaaaaaaaaaaaaatacaaaaattacctgggcgtggtggtgggcacttgtaatcccagttgaggattacttgggagggtgaggcacgagaatcatttgaacccaggaggcagaggttgcagtgagccgagactgcgccactgcacctgcactccagcctggacaacagagtgagagaccctgtctcaaaaaaaacataaataaaatagataaataagataataaacctccagatgtctgttggagcagggcaggaaccattacccagaggcagtgaggggctctgagaaggtgcttttcacatgttcctcttatttaaccagtctaccacagctggagaagcactgggtgctgccagctcctgagcctcagatcatttcattgttttcccttttgcaggtttcaagctcagctgtgtcatacctgcttagtcaattactactgacttccagtttccaaaatgatgctctggtttccgttcctattttctccatcttttttttttttaaagcctagtcagctgggcatggtggctcacgcctgtaatcctagcattttgggaggctgaggcgggaaggatcctttgagcccaggagtttgagaccagcctgggcaacatggtgaaattccgtctctacaaaacatacaaaaattagccaggcgtggtggcatatgtttgtagaccaagctactcaggaagctgaggtgggagtattgcttgagcccaggcagttgaagctgtagtgagctgagattgtaccgctgcactctagcctgggggaccgagtaagacccggtctcaaagaggagaggagagaagaaagaagagaagagaaggaaagaaaggaagaaagaaagactaatcaagtgcaatagtgagaagtaggtaaagagtagaacaaggagttcaatctgtaactgactgaacaatcaattgagataactcactacctttggacaagcctctatctttaccttaaaaaaaatcattttagatcgcgccactgcactccagcctgggcgacagagcgagactccatctcaaaaaaaaaaaaaatcattttggctttagtgaggttttaggagagagtaaaattagctacatttgtttaatccatcatctctgaaaaagagcccaactcatcttttgcttttttttttgagacagagtctcactctgtcatccaggctggagtgcagtggcgcgatctcggctcactgcaagctccgcctcccgggtttatgccattcttctgcctcagcctcccgagtagctgggactacaggtgcctgccaccacgcccagctaattttttgtatttttagtagagacggggtttcaccatgttagccaggatggtctcgatctcctgacctcgtgatctgcccacctcggcctcccaaagtgttgggattacaggtgtgaaccaccgcacccggccttgcttcctctctttgcccgttctccacaaggcaaccagactgatccctatacaaatataaataagaccatggcacctttctgcttgaagttctccaatagctttccactgtgctttcagttctcttctgtgtctccatcgtgaccacacaaaccctttgtgatctggccctgcctgcctttcctcctcactcacagcacaccagcgcccccagatcagaaacctcctttctgactccacctcacagcctttgcacttactggtcccctgcctagccacaagccacgtatgactgactgactgactgactgtctgtcgtccgtccgtccgtccgtccgtccgtccgtccgtccgtccatccgtccatccatccatccatatatctatcttagaaggagtctcgctctgtcgcccaggctggagtgcggtggcgcaatctcggctcactgtgccttctggattcaagcgattctcacgcctcagcctcccaagtagctggaactgcaggctcaaaccaccacacccggctaatattttttgtatttttggtagagacagggtttcactgttggccagactggtctcaaactcccggcctcaagtgatcttcctgtctcagcctctcaaagtgttgggattacaggcatgaaccaccgcgcccagccactttttaagtatgactacttaaaaagcacaggctagaatattcttggctcagaactgtacattgttccttcttatctccaagtctgatctcaaacaccacttcctcatagaaactttctctaccacccgctaacctaatatactaactcccctcccacagtttttcacatcaccctgtttatttccttcacagcacctaaacaagaattatagcctgggaaggtcatttacttgcttactagctgtttcctgtgtcataatgtaagctgcataagggcaggaatcttttctgcctcacctccatatttatagcctcacctccaaaatggtgtctagcacatagaaggcacttaacagatatttgttgaataaatccttctttcctgaacacctagcacactgcctggtgcataacgagaaactgataaaagttgaaaagagtccaaccagtccaatcccttaatctgcagacaagtaaggtcatgtttagaaggttaagaaccttatccatagcttcactgcaagctagcagtttccatcatggtaacccttttcaaactcaaactccaatgtgcatacaaatcacctaggaattcaccttgagattttgttaaaatgcaggttctgattcagctggtcagggccagggcctgcaattttgtatttctaacaagcttcgcagtgatgctgcagctgctgctgggtagaacacagtttgagttgcaaagctgtatgccatgttcaacctgtcaagtcacccaggaatttaacataataacaaaagatgtttttaccttcattatgctttcagcctgtaccaactcttggcaaaaacaaaatgcataatattgctatcctttgggtaaaggtctcaaagtacagttgattttcattgttcttggtagttctgttctataaagtagccatgaatgctgaattagttaatacctaatttgttcctagaagaaatacaggctaggttcccgtgagcctctggtcaaaacattttcatcaactgatcaacatagagccttgctttatatgtgtttctgtttaaagacaccttatgtaaaatatattgttgattcattaacactgaactcacagctaacagcagtataacttatgcatgaacgaagcttacctaacacatgtatttctcccataaggcacatcatagcccgcttgcactaaaggacactagacagcactacagcactgatgcttgggggccattttaaagagtgaattcaccaataaaaagcacaaaaatgcaaaaaacacggcagtaaatatactgtgaaaataacacggcttacggtatgagagctgaaacaaggcagcagagcatctccttgatcaacctcacctgggtactgtgcgtgtctgcaaaagatcctgaaagtgctgcgactttattggtaaccttttgaggttaccaatacattttagtgaataggcaaattctcagatacgaataatgaagaatgaagatcaactatacttcctggcaatatcaagggctgcccatatctcactttgcaggattcaatgtccaagtccatgttttccttcttcatacccttttttaattaaccagggctgccgctagcccatagcatgcctctgtgcaaatcagaaattcctctgtgtagatgcagacccatgtcagaatgcactgcttgattagaggggcatgggccggatctgagctcggatccactttctcagtcagatgcctttgcacgggcacagcctgctccaaacatatgatcagccttattgatcatatcccttcttggccttctcttttttttttttctttttttgagatggagtctcactctgtcacccaggctggagtgcaatggcgtggtctcagctcactgcaacctctgtctcccgggttcaagcaattctccggcctcagcctcccaagtagctgggactacaggtgcgtgccaccatacctggctaatttttgtatttttagtagaaacagggtttcactatgttggccaggctagtctcgaactcttgaccttgtgatccacctgccttggcctaccaaagtgctgggattacaggcatgagccaccgcgcgtggccttttttttctcttttttggacaggatttcactgtcacccaggctggagtgcagtagtgtgatctcgactcactgcaacctgcgcatcctggctcaagcaatcctcctgcctcataccccaagtagctgtgactacaggcccgagctgccatgcctggctaatgtttgtatttttcgcatagacacggtttcaccatgttgcccaggctggccttgaactcctgaggtcaagcaatcagcccgccttggcctcccaaagtgctgggattacaggcatgagtcaccacacccggctggccttttctttaaagcttttcagctgtaacgtctgagtcttttaaatctctcctcatatgggggagttggtccagagatggagagccagaataagaccaaagttaaagtatgagaaatagtgtagtggtgtcctgagatggacagcctgagaggaatggggaaggggcagagagtggcctggcagtggctctgacctgaagctgataggccaggtcagcctgtgctcggcgggtgttgacctcgatgtcataggcggccttcttcagttcgtaatctctctgtgccttggccatctcgatctcactcaggtactgagcagacaccttttcctgcttggctttagcttcctgtccaagcagagatcaggtaggaaatgtcagggcagggggagaaaggccacggtgacagcctgcttcccaccaaggttctctttctgcctcatgtattttccctgctcacccagcacccctgcttcttctcagttgtgccacttctatcccctttcccactaagcaacccccatctctctcacccggatcccagcatctctcttggcctctgcttctccaatccgtgcatctttttggacttgagctgttcgagccttccccaaagagtgcaaatagtcctgtgggagagatgtagaaattagtcctttggagggcttaagagatgggagcaaggaagtggggaaggatcaattgcctagttttacctggtcatcgtgaatgtccttcagagtgtagctaaccacactgatgcccatgttgaccaggtctgaggaggccactttgaaaacctgttctgagaatttctgcctgtccttatagatctcctgtgataacaggatggtggggagaagggatgtaagttttttttttttttttttttttgctcactgcaacctctgcctcctgggttcaagtgattctcctgcctcagcctcccaagtagctgggattaccgacacccatcaccatacccagctaatttttgtatttgtagtagagaaggggtttcaccaggttggctaggctggtctcgaactcctgacctcaagtgatctgcccaccttggcatcccaaagtgctgggattacaggcatgaaccaccctgcccggccgggatgtatgctcttggatccactgtctctcacagactagtgtgggccttgggcccccctcattttgacatccttccagatggttccctgcccctaggccaacctccacagtcatgtgggccatgatggccctctggtggccctctaacgtctccagggcaatgtgggcaatctcagcctccgtcttccccaggaacatctgacaggcggccgccaacatctccttgttctgcccctggatttttacctgtagccagagtaggggtaggaaaggtgtggtgggggtctcatgaagtcagagaaaaagcagagagagaagggagagccctctaagaaatgcttcttccatttcagggaaagaaaggaggaggaggcaagtgccttggggtgcctggaaaagatgagactagcagaggaacttctctgcaggcaagggttgagaagactgtggccagaagatgtcttaatgtctgggagagagggtgatggggaagtggactgtggggaaaaggctctgaaagcttcacctgggcaatgccagtgactgagatggggaccccatggcgagtgtaaaccttttcactcttgacattgagggtcagtgtgttgagagagatcctaggggaaaaagaagggacagacagtaagaagaggaggaaaaagagaaaacggaggtcccccttccctggttcccttcttgcctacctctggatctgttggatgcagggcaggacaaagacacgccctccagccaccatgactggggggcttcggcagaaccctgcaaggtgtggggcagtgaggaacggtggcagagcttgaatgtggaagactgaggaactggcgggggtgaggggacagcaacccacaggagagaatctgggagctggaggggaagcagtctgggccttggaatggtgggaatcaaactgggcagttcgtggccatcaaggggcagaagtctggtgctgggaagttggtagggagagggagaaggggcagaggccagactcacaggggttctggggtcactggctgggaagggaacaacagtacttaccggagaccaccatggcctcatttgggccacaagtgaaaaacatggttcaggctggagctggaggagagggagggaaagcctttgcggatggggaaggcgcgctgtggcgtccacaggggcccatcctttccctttcccgtcaggccctcccagtctgcatccgccacggcccgtcccttctacacccatgggtccgctaaggcttttccctacaaaatccttaagatccccagctacctcttctccgcctgcgtatggtccctcccttcccctcgccgctccctttgataaaggtcccccgcgcccagaggcctgcagacctttcccctctctccctgcttctcggcagccccaggctccatctcccctcccccactcaccttccgggacgcgggcggcagcccggctggggtctcgggaagggcggggtcgcgcagggacctgggagccgggcaggggccgctcgcagaccagctttcctgggagctggccccgctcccgcgttccccaccctgccgcaccccgttgctgcggcagacgcgaccccgccccccgcaacggactaagcacccccacttcgccccgcctcggcccagtgcgctcggcccgcccctttcccggcaggccccgctagagtccgcagcccgcccgcccgctggctctcgggcccagccgggctgcctggttagcccggggagggccacatccctgccgccccagtcaccgcccttcttgagccgggaatcccgcccacgccgcgccacgctccgcccccgggtgagggacttgacctccgcctggcaccctggcgtaagggtgattgccacatctcggattcgccgcggggcaactacctgggaaaaccgcagactgggcaatgaaagactacatccggcaaccggatgctgggttctgtgactccaggaaaaggggctcctgggcccagggaggtgcgcgggctggggactcggccacggcgcctcccgccggtccttgccatctgaaggccgggaggagtggggagtcggcgcttgcaaagatacactcaagactgcagacagtaaatcaattttatttgtgttcacagaacatactaggcgatctcgacagtcgctccgtgacagcccaccaacccccaaccctctacctcgcagccaccctaaaggcgacttcaagaagatggaaggatctcacggatctcattcctaatggtccgccgaagtctcacacagtagacagacggagttgagatgctggaggatgcagtcacctcctaaacttacgacccaccaccagacttcatcccagccgggacgtcctcccccacccgagtcctccccatttcttctcctactttgccgcagttccaggtgtcctgcttccaccagtcccacaaagctcaataaataccaagagacctgcatttacagcagggggaacatctcacacccttgcataagttaaaataaatattacgtacacatctccatcacctaggaggacgtacataaatacatataaatattaattaggagcaataagaaataaattaacgacgctctccttcccaccgggcctagccccagctgggctgtgcctcggtctctatgcgcctcggtctctgtgcgcctcggtcccgcctcaagcaccgggtggcgtctccgctgtagtgttctgagttcaagttgcctcggaagtcccagttggggatacgctctcgcgcaccaggtacgcctggtgtttctttgtggtttttcggattctttttggggagtgcggggagtcacagttagaaggcggccgggtgttgctggaggaaagtgctgaggtccagagcgtagtccgagggctccgaagtcagattaaagggctcgaggacggcggacacaggggtgggcgccagggatgcggcgttaggggcgtcctctggaggcaggggcgccggcacaccctcttcagccatcaggatctggcagaagacgatggtgagcagcagaaagagaagccttttggctgggttcggttcctcgactggcagctggcgccggacctaaggggagacaaaacaggagacaggtcaggtcgaggcctctggagtcgggtcgttccccagtgactccagggcagcgcaccccgcgaatgcccacttcggcgatactcaccactcgagggtagagaaccctgcggctgcgctttcggtgcccgcgagaggcgctggggcgcccggcaggggccgctgcgggctccgggagagggtcgaaggtgaagatctcaggaccggagccccgccggggtcccgggatggtggagggggccggggtcggggcctgcaggatggtcatggtcgggtggcagctgcgagagtgacacatggtgagccgagcggagtgtaaggccaagtgagggtcggctgccggcagaggtaatttatgtgctcctgaaaattgggcgggtccttctaactcctcctcccgcagctggggagcggttggcagcagcgggctggaaattccgacgattaaacaaagggagtgggtggagacttgacatgcacaatcctaggcgcccaactgcacgttgtgagtgtgtgagtcgtgagtgggggtgggtgagatcccgggctgcaggcacatgtcgaggcatgtggcacctggagaggggctcactttagccacaggatccctcacaggcctttttttttttttttttttggagatggagcagtctcgttcggtcgccaggctggaatgcagaggcgcgatctcggctcactgcaacccctgactccctggttcaagcgattttcctgcctcagcttcctgagtagctgggaatacaggcacgcgccaccacgcccagctaatttttgtatttttagtagagacggggtttcaccctgttggccagggtggtctcgatttcctgacctcgtgatctgcctcgctccctccgtccttcttctagtagtctcaagttgctattgttgccatctttacgtccacgagttcccaatgtttggttcccacttataagtgagaatgtatggtatttggtttgcccgcctcggcctcccaaagtgctgggattacaggcgtgagccaccgtgccctgccaagagggctttttattggagatcaggccatcctgctgcaatactgacccagttatatgcacgcattcatgcacttgtaggtatccttagaatataaactccccaagaaggaaattgttacagaaatagtcaagattaagggagaaatgaacacactagcacacacagacacaaacctgcctgcctgagcacacatgaagacacacaccgcgtagccatacaaaagaacaaaattatgtgctttgcagcaacatggatgcggctggtggccattatcctaagcggattaactcaggaacagaaaaccaaataccacacattctcacttataagtgggaaccaaacattgggaactcatggacataaagatggcaacaatagcaacttgagaccagtagaagaaggacggagggagtaaggcaaaggttgaaacactaactattgggtactatgctcagtacctgggtgacaggatcattcataccccaaacctcagcatcatgcagtatacctaggtaacaaacctgcacatataccccagaatttaaaataaaagttggggagggagggaaggatagaaagattaaaaaagtaatacacaatggtggggcatggtggctcttgcctgtaatcctagcattttggggggctaaggtgggaggatcacttgagctcaggagcctgggcaacatagtgagaccttgtcactataaaataacaacaacaacaacaacaatacacaattaaatattattcagccataaaaagaatgcaatcctggaaaaaaaggaaaacataccacgtacacctaccaacacacatgtacacagtaaaggtgcaaagactgtatagggacagttcagcaaaactactctcttaggagcgtgcagaaatattcacataaaggctggtgcagagggccacaaatacaaaggcaataggttagcagccacccagatttgccccttgctgtaagtcaaacaaccaaatttatgggacaaacattctaaattgtgagacattatacaaatgttacagtaatggtaattactcaacttaaagcagattcacatttccataacttccttacagacagctgctcatggacacagaatttaactttttttttttgttttgagacaggatctggctttgtcgcccaggttgaagtgcagtggcatgatctcggctgactgcaacctctgcctcttggctcaagccatactcctacctcagcctcctgagtagctgggaccacaggtgagcaccaccatgcctggctaatatatatatatatatatatatatatatatatatatatatatatatatatataaaattttttgtagagccagggttttgccatgttgcccaggctggtcttgaactcctgagctcaaccaatctgcctgcctcggcctcccaaagtgctggcagccaccgtgcagaatttaacatcttttgagcattcacctgtttcaggcgccctctgttgagggtactactgttgagagtcctgaggctagtttcagtataagtgctgtgccatgcagctgcctgaggaaagccagataaagctgatactccagccatgagggccttaccctccggcatgaggagggaaccatggccaggagagctctctatctgtctgtctctgttgctctctctctctctctttttttgttatattgagtttctgcctgaaggaaaggcaagctttcttgaagatcctaagaaaggccaggcacggtggttcacacctgtaatcccaacactttggcaggccgaggcgggtggatcatttgaggtcaggagttcgagaccagcctggtcaacatggtgaaaccctgtttctactaaaaatacaaaaattagccaagcatggtggcgcatgtctgtaatcccagctactcgggaggctgaggcaggagaatcgcttgaactcaggaggcagaggttgcagcaagctgagagcgtgccactgcactccagcctgggtgacagagtgagaccctgtctcaaaaaaacaagaacaaaacaaaaaacaaaaacaaaaacaaaaaaacctaagaaaactgaagactaagtgttaagggggggacccaaaagagctagtgttcacatctgtccaatcaatcaggggaggcttcatggaagagtggcactgaaggtgaccttgaacagtgggtgggatatgacaaattcagatgtggaggatgactgtaagaatggaattagcaaagaccttgagctggaaaagtacaggatgtgtttggggaatcacaagaaaaacaatctcagagtaagtttcctgtaacggagtagtgggaagtaataatggctggaaaggagtggaattgggcagagtggggagagcagagctgccaggtcaggagcctgggtttcactctagactgtagagcttgtgggttgctggatgagataaagggaggaaaattcaagcaggaaactgattgggatgaggagtgatgctctggacgggtagagactaaggcagtagacaggaggctattggaggggctcaggtagatgataacaagagcctgagaaggtggccctaagagacattcctagcataagataatcagaattgggcaatgagatggatatcattaggggaagggagcatgggagagggagagttgccgacagcaagaggatgaaaagatctgagatgactccagagatttgaaatacatctggctcagatctttctaccatcattttaagcctggtgcacaaagtgaatacatatatgatctcttccactggaggctgtgtcatacacatctttgtgtcctccagagaacccagcatggtaccttgtaggcagcagttgctcaataatcttgttaaatgccaggtgaaatgtacaactgtaagtgtgcatgtagtattcccaccttggctgggtcacaccaagcttctgagatgtggctacactcctccaaaccactcatacaaatgtacaacatctttagaaaagctgggacaattcttacacagacaccaaacaggaaacacttttctcccctcccacttaggaaacacttaaaaggatttttcaatcaagaacatgtaggaacacaaataagaggacaggccacaaccggctagaaatacactactgctctgtgtacaattcctgggcctacaagtcactttattttatactcactactcttatctaaatacacaagatcccttccacattacacacttcttcctggctggcataaaacacacctcctctgtaaacaaaggcgcattgctttcccacgcctgtcttcacacctgccatcattcttacatttacacccaagcacagggagcccaccacccccaacatccttattccaaggcaactcgcacgctacacaatgaccaacataaacccatgactacttacacatgtggacagaccctcacactcacataaacataaattgggagtagggggagatagtgatgatggaagaaaactagtgggtgggagagagagagaagcaccaaaggttaggaatgcattacttgtttatgatggaaaatttctctagggcattaggcagaggaggggaaatgaaggggatgccaggatcttgttttgccactacctcccacatctggaatctgggcctccagctgggtctagttatcctcgctgtcctcccggcacagagagacctttctttgtggcaagaccagaatgggacaaagagaagacctgagaacccggactgctcaccattcccaaccaatcccatccccattcctgctaccctcagagccctagggctctgctcctgctccttcctgccacacaggaagctagggaaatgttgggggtgaatcattaagccaataagggggtgggggagtgcaggctggggaatgagttaaggccagaaagtgccaggggctgagacgagcaactggactggctcccactgccctgatactggagaaacaggcccttagcctcctccatttccagctctcctcctcatttccttcccatcttcccccagatcaccatgttccttcatttccctcgtttgacctttgccttgatccatcaccactgctagcctccttctcagccccttgtttttcttcatgacacatatcacgttggggaatcattttatgtatttgctttttgctgttgtttgtcccgcctactggaatataatctccacgagtgtacagggccacatctgacctttttctcattagatctctgtagtatctccagtacttggctgtcacctagtaggaacttaataaatattcttaaatctgtctcctccgaggagctaaacctcatctgcagagaggtctgtttatctagccatgttcctttagaggcccccatgtttgctcttcaaagaggaggttgggggcactcaggtgtggctcaggtgatccgccgctgaatcaggaacaattgtgcagtgacgacagcgacagcaaagccctggcccgcgccctttacaatccctgacataggagtgagtcaggcctgctgcctcacctgggtactgctgcactgctgaccacaggcccagaacgggggacggcaagaatgggcactggcggaggcagaatgggcaggggaaagggaggcagagatttggaaatgggagcatctgagaaaggaaagcagggtgaagggactgcaccagggtcctgggggtagggaatgacaaagtgaaagctttttagctgcacctggtattcagtagatcctcaataactacttggtgacttgagatgggtttgagatagaaaggaaacacggaatagcaaaaagaacatattgtaatctagtggtgttagacgaaattgggtttaagtgccagctctgctacttattaactaggcaatattgggccagttacttaatgttgctgaaaatctgtttcctcaattgataaatgggcaaattgacctctaggtaactgcaaaggttaagaatataaatttactccttctgggcacatagtaggtgcttcttgcatggagcaggggcattattataattatgagaagagggactgctttggaacagggatgggcagcagtgagccaacccaggagtagggaactggaatgagaaaataacctctaactgctaacatcaccaggagatacaagttctttctctttttactctgccctccctccctctccatatcaggcaggttttgtggctctttattttccagagaagcaaagacttctgcattcctagttcctgttcaactaatgtgagtgattttatttttttatgtatgtatttatttattttttgagacaagatctcactctctcacccaggctggagtgcagtggcataaacatggctcactgcaacctcaacctcctgggctcaagtgatcctcccacctcagcctcttgagtagctgggactccaggaacgtgccaccatgcccagctaatttttatttattttggtagagacagggtcttgccatgttgcccaggcaggtctcaaaattctgggctcaagcgatcctcccgcctcaacctcccaaagtgttgggattacaggcgtgagccacaaagtctggcctttatttatttaaaaaatttagtttggctgggcgtggtggctcacgcccataatcccagcactttgggaggttgaggtgggtggatcacgaggtcaggagttcgagaccagcctggccaacatggcaaaaccccgtctctaccaaaaatacaaaaattagctgggcgtggtggcgtgtgcctgtaatcccagctactcgggaggctgaagcaggagaattgcctgaaccagggaggcagaggttgcagtgagctgagattgcaccactgcactccagcctgggcgacgagagtgaaactccgtcttaaaaaaaaagaaagtcttactctgtcgtccaggctggagtgcagtggcacaatctcggctcactgcaacctctgcctcccgggttcaggcgattctcctgcttcagcctcccgagtagcgcatgccaccatgcccggctaatttttgtatttttggtagagataaggtttcaccatgttggccaggctggtctggaaaactcctgacctcacgtgatccgccccctcggcctcccaaagtgctgggattacgggcgtgagccaccacacccagcaaaaaaaaaaatttgtttttactcaccactatactgacaaggaacaggtgattttaaacatcccctcccacctacattttagctggaacaattctccagaggcatgggggtagagtggggtggtgagttctaggcagcaagttaacaaatgacccctaaagatattcatctaggctctaggaggcccaaaatcaggccctggcagttcccctgacgcaaaaccatggcaagagttccgggagcaccaaggcaaggtcacaaaagtggcacgatgaccctaccctgggatgcagctcagcctgacccagcccaactcaacccagctaccctggaggctgctatgagctgagccgggagctgggaaagggcccagcattcctgtccttctgccaaagccggcttcttaggaccccagtgttgtggctcctcctttggtcttggtttctttcccaccagattataactccaccagagtaggactttatctatcttgtgtactgctctattttcagtgcctagaactgtgcctgtcaatcaatacaggctgctgaaaaggctagaaatacaggatcgttgatgtcattactgttacagtgctgttcccgtgggaagcagcctgcatctctctgtagacagctccaatgtcagccattggagaatttgatggagattgaagtcaaaacataatcataggggaaaaatgcacaacaaataaaatatttccccttttgtccagacttttcagacaccccgtatttactggatgagttgatctacaaagtgaaaggcataaattaaaggctctctaatgtttctcctcctctgaaaccccatgattcagcagcgtctcccatgtgtgctcaaaagttggacgtgcctccagcctaccctccaaagcagttgccataggctcttttcttccaaggttgggagggacagttcattccccaagaggcctctccaggggcggaggcgggtgctggggctggcctgtctgcagctccctggccctacccagtggggatcgcgtgtcagtactggggtttggtgggctgccaaggggtgagccctgaggcggttttctgggaaggatagatgccatgtgtgactcagaaccaagttagggaaaaaacaagctcactcaatctctagcaccctctgcctggcctggctttgcccatgagctcataaaagaggaagctgggccggccagacagt

SEQ ID NO: 344 - DNA, 436072 bp, Homo sapiens
agcctcctgagtagctgggactacaggtgcacacaaccacacttggctaatttttgtagttttggtagagatgaggttttgccttgttgcccaggctggtcttgaactcctgagctcaagtgatccacctgccttggcatcccagagtgctgggattacaggcgtgagccaccgtgcccagcccttcccagacatttttcttcaagaatttcttaactatttttgacattttaaacttccatataaattttagaattagcttgccaaaatcctttcttaaaattgtaattgggcgggcaactgtagtcccagctactcaggatgctgaggcaggagaatggtgtgaacctgggaagtggagcttgcagtaagctgagattgcatcaccacactccagcctgggcaacagtgcgagactccatctcaaaaaaaaaaaaaaaaaaaattgggattgcaattattctctaaatcagtttgggataaattaacattgttatattattaaatcttccaatcaacatggtatatctttcaatttaatgtttttaatgtctctcaaagttctagaattctctttagagagatcttatatatctttattgattttattcctattaaaaatgttattataatggtattttttttaaaaatgcatttaaactgttgctgttatggaaaaatataattatgtttgttgtattaattcttcatcatcaaccttgctaaactctgttgctaattttaataatgtatcttgtatattcattttaattttcttttcgtagagagagggttttgctgtgtcgcccaggcatgcagtggcacaattatagctcactgcagcctcgctgggcttaagcaagttttccaagtagctgggactacaggcatgtgccaccatgcccagctaattttaaaattttttgtaagactgagtctggctttgttgcccaggctggtctggagctcctggcctcaagcaatcctcacgccttagcctgccaaattgttgggactacaggcataagccacctagcccagccccctcatttgaattttttacatatacaattatatagtcttgtttctttccaattcttacaccttttgtttctatttcttactttattgatctggctaggactatagtgtacagtgtacagtgctaagtcaaagtggatccttgccttattccctgtctaaaaggaggcactctcaatgttttactttaatatttttacttcagtgaagcatgtttgctatagaccttcatctctaataattaagacaatttctgtttctactttgcttagaggaaatcatgaatatgaatgaatttgggattttctcaatgctttttctacatctcttgagatgctcatatgcttttcctttaagctgataatgtgaattacatcaatttttttttctaatgttaaatcaactttgcatttctgggattcatccaacttacacataatgcactatccttttttctaaattgctggatttagtttgctgatattttgtttagcatattggtatttacattatgagtaaaataggcttgtaattgtccctttctggggttgttcttattttctagtattgcaacctgagttggggatttttttcatccctttctattctctggaagagtttgtgtaaaactggtgttacatcttccttaaatgtttgataatattcactggtgacaccatctggccctggaggtttttggtttttcttttgaaataattacagattcacatgcagttataagaaatactatagcaagatcctgtgtacttatgctcagtttcctccaaaagtaacatcttgcaaaaccatagtacaagatcacagccaggatactgacattgacacagtcaagatacagggcatttctgttgccataggatctcacatgtcatccttttatagccacacccaggtccctcccactgcatcccccttctgcatccctgatgatcattaatctgttcttcatttctacaattttgccatttcaggaatggtatatacatatatacagtatgtaatcttggaatggaatcatgtacagtttgcaatattttggtattggctttttcactcaatttaattctctggagagtcactcaaggtcgatgtgtctatcactaagtcattcctctttattgctgagtaatattccatggtatgaatagactgcagtttgactcttcacccattgaagaacatctagattgtttcccattttagtctgatatgagtaaagctgcaatgaacatttgtatagaggtttttgtgtgaaggtaagtatttctgtgggataaatgcccaaaagtacaattattgaatcaaatgatagttaaatgctgatttttaaaaaaattgccaaaccgtttctcagagagtctgtaccattttttatattcccatctgacatgcatgagtgacccagtttttctgcagcctcagcagtgttttttgtcactatttattttatcagagtagtattttcacaattgtaataggtgtgtagtgatatctcattgtgtttttaatgtgcatttccctaatggctgataatgttaaatttctttacatgtgcttatttaacatctatatatcctctttggtgaaatatctgcttaagaattctttttgcccattgtcttttcttttccttttttttttttttttctgagacagggtcttgtgctttcacccaggctggagtgcagtggtgcgatctcagctcactgcaacgtccagctccggggttcgagcaattctcctgtctcagcctcccaagtagctgggattacaggtgcatgccaccatgcctggataatttttgtatttttagtagagatggggttttgtcatgttggccaggctggtcttgaactcctgacctccagtgatctgcccacctctgcctccaaagtgctgggattataggtatgagccactgcacctggctttttttttttttttccgcctatcttccaattgaattgtttgttattttaccataagttttgtgagctcttcatgtattttagatactaggcctttgttggatatgtggtttgcagatattttctcctagaatgttgtctttctgttaacaggatcttttacagagcaaaaatgtgaaattttgatgaggtccagtgtatcaaattttccttttatggatcatgcttttggtgccaagtgtaagaactctttgcccacctgtaactcttgcccccatttccctgtgaggccactggaaggaaagcccaagtgtgtgtggagagacaagcgctgttgggagagaagcagctccctgccctgcccctgtctctgggcgctcacttctccattctttcctcacctcctgtatgatgttctttaacattttttatttttaaaaaatttttaaaagtgtttttagtggtaaaattgttctgaatgatttaatcttccccctgaagaggaagggaaatctgaccattgtttctgaggtagaagttggtgaggcacttacatacttggtggtagcccaaggggaattcttgcctgggtgtaggaatgagtccatcttcttcggctcatctgttttgttttccttccctcctttgcgcaggaaggaataggtaggatctacaggctctgtaatcgtgtctcactcttgggagataacagtctcccctcagggtgcccctgttcaccaaagacatgagtccttgttcctgactgctgcaaagggagcaagggtggacagggaaccatgctgtctgtgttgcacctgtaccactcacgagtgagtgtcagtgtcagatttctcttaatcttgatcacagaagtgatataaacagtttactgtagaagttctagacaatagaaataaacatgtagaggaaaaccagatccacttataatcccacaacacggtgtttaacattttggcctattcccacttgcccctgacccccgaattctacttttttttttttgagacagggtctcactctgtcacccaggctggagtgcagtggcgtgatctcggttcactgcaacctccacctcctaggctcaagtgatcctcctacctcagctgggactacaggtgtgtgtcaccacacccagctaatttttgtattttttgttgagatggggttttgtcgtgttgcccaggctggtctccaactcttgggcccaagtgatccacccaccttggcgtcccaaagtagtgctaggattacaggcatgagccaccaggccacccacccccaactccgcccgcccccgcactccagtattcttttataaaatgagaatatacagcatgcattttcttatatcctgaagaaatgtgagtgagcttacctagcagtgcatcaggagatgctgattcagattgccctgcaggttccagagagcctgatcagtgggagcacagggcctggctccttttagggttccccaagggtctggtttataagtcacattctctgtcttgtgccccagggatgctgaaagtctccctgttgttgctctacctgggagtgcatcctccccattgcatacagggtgggtcctgggggtcgtcacttcccatcccttcttcctgggccgcccagttccactggtcactgctgaccaatatctcctgcttggtaactggatttcactttggcaggagactctggttcaaggggaggaactctgaacatggggattatggccagtggccttggataagtgagagttaaggaagcataaactaattttctttggatggaagtttacacataaagatgatactcacctagacttgcagataatatgatgtactatttattgcataaatacatttgattttaaaacaatattaattttagctctgggcatatccagccttagctaactgaaaattgtagctctgggaccatctgctggctactctccagactgccacactggtctgggaagctggctctcttgggatggaggttagagcaaagcccctgctataggtagcttttgcttcccggggtctgcagggaagtgaggctggagcagctgcagttcagacattttcatggtggtggatatctcgggcagcaggatcagcagttacagtatgcgttctgaccacagacatagattcgaattctggctctgctgctctgagcctcagcttcctcttctgtaaagtggggataataataacacgtaccttgttgggtggttataaggtttaaaaacaggtgcttattaagtgcttatcacagggctaggcacatgtagtagtttacacctccaggagagatggggagcagtaccttgtttatgtcactgtgatgattaatgttatgtcagcttggccaggccactgctaaagactgaatgtttgtgttccccacaaattcatatcttgaaaaccagcccccattgtgatggtacttggaggtggggcctttgcgaggtgattagggtatgagagtgaatgggattggagcccttagaaagaggctcctggaagctcctttgccccttccaccacgtgaggacacagtgagaagatggatgcctaggaaccaggaagtggcctctcaccagacaccaagtctgttgctgtcttgatcttgggcctcccaaactccagaatgatgagaaataaattagtttataagcaacaaagtctgtggtattttgttatagcagcctgaacagactaagacagccgtggtctctggtgtctagtcaaatactactctagatgattctgtgaaggtattttaaaaatgagattaacattcatttcttggtttttatttcttgagacagtgtctcactttcttacccaggctggaatgcagtggtgagatcatggctcactgcagcctcaaactgctgggatcaagggatcctcccacctcagccttccaagtagctgggaccacaggtgcccaccaccatgtctggctaattaattaattaattttttttttttttttgtagagatggagtctacctgtgttgcccaggctggtctcaaactcctgggctcaagcgatcctcctactttggcctctcaaaatgctgggattacagtcatgagccaccacgcccagctcagattaccacttaaatcagtagacttggaggaaagcagattaccctctgtgatgtaggtgagctccattcaatcagttgaaggccataatagaaaaagactggcctccccttaaggaggggattctgccagcaggcggcctctggactcaaactgcaactcttctctgggtctccagctgctgcctaccaggccgattttggccttaccggcctccatagtcacatgagccaattccttaaaatagatctctctttctgtctctttcttcatatatacacacgcaccctaggggccctgcctaatactgtcatagcatagccgtctttaagctcactgaaggcaggtgctgtgtctcctttgttcagccctctgtgggtcatacccggcacagtgctggctccccgttagtagcctggtgattactgggcacttcccactttctatgtctcagttagaaggtctgccccagtgagagccaagagtgggcggggtaatggattaatgtctggagctatagtgaatttttagtgcctgccagggcagatggtgggcacttttgaaccggatgtggttgtgcattttgggagctgaaacttccacatggagaagagagacttctgggtccagatgcctgcctttgtcgagccactctttggactgggccagagcacgactatcgcactgtgatgagcaggaacctgcaattgcgatggaaaggtgggagaaggacgcagagtggttttgccttaatcagttctcactttaacaactgcaaacagactggcaccagaaaaaggtgacttttctcaagttttattgtaaaatcctcagaaaaagagcatttacaatgacaatagtttatgataatttggagtcatggttataccaagtggtactgtaaatacaccatgtgttcaatactgtgtaataggtcaaagtaaacacaaacttatttcaaatgccacatacagttactgtgttggtacaaatttctactaaagttgatgtattaaaaataatttatatatattttataaataaggaaaaattcacatgtataataattacaggaagccttttgagaaatacaggtgattacagaaaatatattttggaggctagacaatggttcaaaataatgtaatctgccttgacatgagagatccgagagttttctgaggtggggaagcatgagactcgaataggacaaatgatgtgtgtggcttcacatcttgagggtcactcagctgcactacagcatgaaatggtgtgtgtgaccacgccagcaaaactccatgcccagttctgctttgagataatctcacacagcctttgggaagcatgagaagcaagggaaaggtaggaagccacagggccaggctaggaaggatgagggggccggccagccgcgggagccaggcagggagggagtcgggaactgtgggtctgtggtatgcggcttgcaaacctgtttctctcacctgtcccaagtagcacaggacccacaacgcttcaacctatggcagatgtcatgctgggcagtggataaaggtttagatttggggcattttctcaagttagagctcttgggcctcacaacccagccaatactggttgctcttactcagaaacaaagctctgatcctgaagagggtgcctctgaagggcagcaatctctgatctggccgagcacatgtcgccaagcttggtgtaggggtaagtcaatggttattgctttgtggagtgctggctgagccctcgaaagccctctagggcatggcccatgttctctggggccacatgagcaagggctggttccatatatgtaaagatgagcttggaaagaagcgtgcatgaattgtgtgtgttttttttaaagtgcatgctaaatactctggtgctggctaaagaagcctcgctatgaattttggaggataatccccactcttgtattctccataatttcatacgttgttatttagttaaattaggcttccccacttgctgcccacagctccaaaggaggatgtggatgcacaggacaatgcttgttggtgtcccagggtctgctgcatggctgctgcctaaagcatgcagacccaaataagatgctcaaatcctcatgtgacttagcaggtaacctggtatagataaaagcagggagtggattgcattccactggctacctggggtcttgtagtcacactctgaagataggcactgtatttttttttttcccttgaatttttaagcatctctgttttatgatctctataattttggagagaaaccaaggcagctagtgactttcttgaacaaaatttctttgcctacatgccagtttgggaggacatagtagtatctggcctatgaaggacttctggcttgtaccccaaagcaggaaagcggcacgggcaaagaccacggggtaggggctcgtgtagcggtcaggtcagttgctccttgaatggtaggagctgttgtggaatggctcatgagcagggggcctgagacacaggaatggaacaggaaagaggggagaataaaaagggagtcggagggaggctgcggggcttgggtcctctgagagatgatgcttggctgagatgtcgtggtctcgctattcctgctggacgacacctgacttccctgatggtttccagccagctctctccagtcttggtcatctaactccaaaggtctgcaagcgagggtttggagggtgtgattctgggcagcaaggggctgtgtccctatgggttctggctgtacttggagtggaacctggggtcctgggtgggggaggctgtcgaggacttctgtggcagtgcttcaatcttatgttacctgcctggcctcctggctgggggtggaggggagtagcattccgggggtgctgggtgcaggggcaagcgtgaggtagattggtggatgcataggaaggagctgggagtggtagtgtcaactctcctggaggcttgcttctgaaaaggaggtttgaagagtgggagagagagttgtgggatttgctagtgaagacggtttgttgtctgtaataatggaatgaaacacatcatgataaatgatcaactatactttttaagccccttgtagaaaaatatatccagagtgaatctgtttcacatctcagttctgaaatcttctttagttcacaggttattggtcgacagaaaacaagatgtggccgtacaaagccaactcctggctgctttcctaaatgaagactcagtggttgcaatctctatggcagcaggccgttctctcctttatttggggttgaaagccggcttccagtgcctacctggaatggggagccttgtctggacagatggagatggggagatgtctgggttgggggtgggaattgtaggggttgagtttctgtctctggtgatgctatctctaggtcaaagtacctgaagtttggtattagtagttggctccagccaggatttacagggctcttctagcttcttcctggagcttggggaaaagtaggacactcgaatgacttggagactgaagaaataagcctgggccagccccaggcagggtgggctgggtcagtgttggtgaggctgggatgatagctttggccgtgggtgcaatgcccatcaaccctcctcatgcaggcaggtcgtgccatcgtcccgaagctgacagtcccccttcctgccatccgtctggggctgcctgggtgggcttttggacccggagcctttatgcaaggttctgcccactggagcagaagaatgagggcctctatttcaaagccttcctgtcaccacaggtgcagattttttgtcattttgggaaaaaaaaaactatcgaatttttgtaaaattaattttatttcaaaatgactgagggggtttatataaatagctttcttgatgattcttttggtaaagtcagtacttctttaatagctaagatatcagttgtgaattgaccttgtgggttcattaggaggattaccggctgggcttgctacaggaggcccccctgtagtgaggcatttcctcccagtggctttccaactgtgtcccatgaacctctgctggggtgaagtatgggagaaagggcaggccagtctggccttcctcctcttcctccttctcctcccacccctgactccccacccaaccaactctattggttttcctgccaaaaggcatttacctccctgcattggtgactttgcctcctggggctggactcctgaaaccctgacctaggcttcaggcctgcttcgattcagttgtgtctggcatgctgtcagtgagacctaagcctgccgtctccaggaaatgcactctgaggacagcaaagggcagctatgcttttttagacacattccaagatggaagggacagtgggggagaagcaggtgctgcagaagttgactctgtcactcctgattattttaaaaggccagtttgggtcaaactggtctttgacttaggaatcctgctgcccagaggggctcgtgttctggtctggtagttggtgggacttttcctcctttaggctcagagatcctttttctgtcaggggctgatacaatggaaatttttccaaaaaaaagtttatgaaagttggagaattttagtggtaaaaatgggagattgggagtaaacataacatatcaagatattgaggcaggaaaaaaaaaggggtgagatgggtcatccatgcatcccagctactgtgaaactgcattctaggcttttgaggtgagcttcctcaacttatatctacatagcatatcttttaaaataaaaaacagacgtacctgtctaggcgcacccctaggagttacaggggacaggcgtttggtggaccaagttgcgtgagacatacaagtgattgatctcatgagatctggggcgggggatgcaggtggcttggcagtcaggcaggagtgaaaggagctgtgtgtgttgagagtgacacagagtctagggtttcctctccttgaaagagttcattccttaatggcaaaggaaaatcctggtcatgtcagtaggtgaaggtggccaaattagcaaagacgtctgtggtgagaccacctctcccaacccgtgtggcttgcaaaatgatcattcaaaccaggacacatgtaagttccactcatatgtgggagagggaaggcgagcctgtttttgctgagtctctgatctaggcggtctccagagggctatgtgggttgtacttcttcgatgcccatgtgagagtcaccacagcctgagacacataaggagaatgcagtagtgccagcctgtggccttctgttctgggttctgcagtgtgtgtgtattgattggggaatgtgggtaagaaaaccctcgccgaaatgtgttctctctgcagtgctgatgcggggatggggtaccagagaggagtggatgggccacaggtaggaaaacaaaatctgttttgaaaaggtatagcttcaggaactcacctggccccactcgtgtccttggggtttctgcattgagcctggaggccacccataccttgccaggcaagcccagtctgccctgaatctggggtaccagacctgactaatgagatgtctcccttctgtgctgaaaggaggcacacagaacttgttctggttttttggggtcccaacacagaaccgagtccttacggatgaggtggcctggtctgctcttggagaagcagggtggcaatagtcgacagggccagtattctcagatgaccattgttctttctggctgtgggatgtggggttgtgaccacccccgagactcggcctaaggcagggaaggatatagttggacctcggagagcatctttctgcttactagcatttgagattataaaatttttttttaatcaaaaatttccaaaataaagtgagtgatttccccatcccccaagatgcagtaagtcttgttggctctccctcaggcttacagcaagtcaaatggaaagaaaagcaagaagcagctgcgagggagaagatgcggtcccacgcgaggacggatgggctttcagttcgggagggaggcccctgctcctggtcagcctctgcttccgggccactccgtcagggcaaagtctggctgggtctggcagtaagggacaatgactatgtgaaggcaactgacagaggtgtctgcttggagagcaggatcccttggttccatgatgtccccaggtcactcggtgtgcagcttggcacagaaatgatccctttacacagcagcatatgttctcatcgtagctcaaggcataaatcatacttcctaacgaaaaaaccccaatcttggtagcagcgcataccttatactaggaaacttgcaaggagaccagtgttgaaccacaaagcgagtacaggtttttgcttttgtctgtaaaaatgtacagcgtacctgcttgaggctgcagtgtcaggactagggggtgttccttggcccagggctctgctctgggcccttcatacctcacccacccacaccactgtggtccccccctttatacctgacacctcacaccgcagcgtgttttgtctcccattgatgaggaacagtgactctcgggctggtgtgaggaggtactgtccaaacagcccactgtccctcatgattctgtgggtacccccccagggctgagctggccctgcgggtggctcctttaagttcttcagcatgcccaccttccccgtggacagctccaggaacagcaggtccggctccgtgtgcagagccgcgtagatgttgtattgattgctttcagtgaaggagcgctggaaggccaagtctgagatgcccgagtttatttgcaggtcatacagggtctggatctcgccccgcactgtgatctcctgcacgtgcagccaggggctgtcagctgcagcactgactatgaagcgcccgtcgggggatgtgtgtggggtgcctgttacatcaccattggggccaagcacagagtctgtgacactgtcaacgagcagctgtcgggcagcagaggcggggctgtcctgtcggcactggatgaagaagtagccgcccaggtgggtgtgtgccatggcctggggcacgcagccatggtggtgcaggccgatggtcttgaggggcatcattgtttccaggtccaccttgtggactgcaggatcagacttgttgaagatgaagccaaacctgggaggggaagaactgaggtcagaagttgcctccaggggtggggaatctgtcatttgtcttaaacaattacatcctctgccttttccctttattataatccttcagtgatctaatagcctagtaataagatctatcattctgcaggggatgtcttcataaacaaataatctatgatctcaatccaaacgcagtggagttacaaatgttcctggatttatgctcttgtaacatgcactcatcgttggaaatgattatggaggaaggcgagaggcgcttcaactgcttctccatttataatacttatgaactgtttccctgaggcccatgccagctagaaaggggagagtctgtgtctggatggtgagcatggaggaaaagggcaagagatccctgccccgattctgcctgttacaaagataagaaaagagttctatatccttgctgttttctagactaactggcaagttagaatttgaggatgcagatgcagctgaacaagtgcagatgtcctgttagtaccctcttcccctggaagggaaacatgtaggggcagtctcttctctgaccacattggtgatgcgggtaggaagaaccctgggcattggggttgaggacagcttttccctccggagccagatggcctggtgccggcacactgccctgctagctgcagagcctggggcaggctgcttgcctctctgagcctcagtgactgtaaccaggttagctccttcctagggctattgggaggatttgatctaagagggaactttagcagagggactcaggtaggtgggagttgctcaaatctggattttctaaaattcctctttggaggctggttggaagtatggaaaagcctgactccaggcaggacttccctttgatcttgagagcctgtgcctaaatcccttgctcacagaggccttttggtgctgtgtacacctgcaggaatagagcagaatctcttctgtagttttctctagaaaaactgtaccccagagtagaggaaaatactccctccaaggcacatctttaaagcatccttaaagaaccagagcatggaaatagcaagaaagaaaactctgctcttataagaaactttaagttaaaagccacacacaggaactgcagaacctctgagtgtgcccgaccctcagctgaatacagctgctttatgagggcttcatcatttaatatactcttagaggctcttgcacaggctctctctgcagtgggagggttcataaagtggctttcttccttgggtgagggtgaatgggtgcatctccagcaacaacttgcaaaaacgaatcatttctttctgcagagaggtgcttgatggcggattatagaaaggtataaatagtgctacaagacatttggggtcttgatggcttagagacaggcttggtcgtctggcagtggtaagtttacagaagatattgggggctctctgaagtgaatacggatggggactgaccatgctgggccgaggtctgcagttgaggccatggctcttattattgggtggttgttttaggtagtggcaaaccatggcaatcaggaagccttgtctcgttgtgggctccccacacagatgctctgggggttcctaaagtattatgggctgtggttagatgggaatgtggaagaatggtgcactgaaacaagacttggctttacatttagtctgactttgccagttcctagctgtgtgacattggtcagtgtcttcacttctctgatcctcatctataacataggggttaagaccactgggactagatttttgtgtctagcaagcagagggtgctcaatttactgctactgtttctttctttcctctgctgtctttaccttaaggatgggacttcctgacctttctgggccactgagggcattaggagctgggtgccttcagtataatagagttattgaccccaagcaatgaggactaggctctgggtctgttttactggaccttctctgttccttcgtgatggggtccaaatccagcatgggagtggaggagacagagaaatgagcaggtcccatgctgggcaatgctgccccttgcagggctgagctggagcggggagtgccttagaggcatcatgggccagtctcacctgatgtggttgatgatgaggtttgttgggggaatgaagaaatcatccactcctgcaaagggtgtgcggatgaggtgctggctctggccggtgctggcttctgtgatcacctacaacacagagtgggaatcctagtgagggcccatgcaggtgggggctgaacctggagacacctgtacgctcaggtggagtcaccccggcagaggggtgcttgggagagagatgactaacaaacctcaatctcagggaagaggcaggagcaaagtgggagcagttcaggcacatcctaggcagggacccattcttcctgaaagaggaagtggtgggacaggactgattgcccgaattgcttctgccccatggttaagcctgccttgctgcactttgtcagccaccatgatggcagagtgagaacctgaggggtggtggtggggtttccaagggaagtaagtctccagaatggaaacatcactgtggttgctcagagaccacctcctctcgtaatggggaatcctaccttctcaacatgtaagccaggctagggaaagtgggagagggctgtcaatcatgaaaatgtcacgtggtggaactgtctactgggagttcatttttctctggtgccagatgcctgggccagtttgttggtagtctctgtcggatgctgctcacaggcattctctgaggtgcgactccaggactgatgagagaaagcagacatcctacgggatgccactctgacatgctgggctgttgagatgtcttgcatttagaatgctgggaagaggtcctggtctcacacaggagacttgctgtagaaagtcaacaattaggccctgtgccttgtacaaattggtagtgacagagcacggctgcctctgtttccctggaggtaacgctttctcccctgtggacttggcaggagacaagagcctttccctggtgtgtgtcccagctgcactcatgtcagggaaggcacaatggcagctctgagcagaagccaggtggtgtgtgaagtcagataggatgagtgagtggtctggagtccctgccatgaaacccctgtggtcaggctgggcagcccctctgtcagctagtgaggcccaagccagccagactgtgtcctcctgccttctgcatatgctcatcagccttgaagttctaggccactgcccagaaagcagcagaccagtggtccgatgaggggcttagccaacttacaggccccgagaagcccagaccctctgtgcaggagaggaggcagatgctgggcccctgaacgggaatgtgagacactttttctaatcatgatattgtggccacatgtgtagaaaggagggtctagatttctgcagcctgaggcttggcctgcagggtgagagctgactctggtgggggcttgtgactcccatggctgagagctctggatgcttctactttttaggaatggagctgccttctggcttttacttttatgacaaaacaaacagcacctggcctgcctcctcaggcaggctggaggcttgtgtcttttttcgtcttgctttcctctgcagtcagcaggcagagtgctgggctggagtgatgcaagccatgattttcaggtttgaggcagtcctcatgttgcattaggttatttctctgtgattttttttaagaggccaaatgattacttctatggtaagctcataggaaaaaactcatagaagtgggtgttaagaaaatatcagcgttaggaaactggatcttagagagtctgaaaagaaaatgccagggaattccaagaagccatgcaatcattgcttggtatcaggcctgtcattttagctcatagtagagatggaaaattacaggctgtcattggtcaatgtcattcacgcttcactgctctgacaccctagattcagaggttacttcatcaaaacgcagtgccatgggccattgaactgatgtgggcatgtcagcctcgtttctctgagtcacgagttcctcctcggctttttcttgtgtcctgacacacagctgggcccacagtgccctaaagatagataactgtcaagcccctcacatttgctgccgtatgggcttggtacaggagatgcatgtatgtgtctgaatctcaggatatgcccatcagttggcagggtggggacagcaaggctgggcatctccctcagaggggtgtatgaagccagctgggaagtggcatgtggaggggtgggagagaacatggtatccagaggacaggctgggaggcagctaaaagctggcctgagaaagggggtgggccagagagtgctgggcagcattggaaaagatgccaaaccttccaaacctgggtgctgagggcggctttggtggagggagcctcatttgtacaaacacgttcatgtagtcttcccaaagtgtgttcaacaaatccttcagtgttggatatttagaaacaatattaggatattatttttaatctcttgcaaatacaaacaatgcagtaacaaacattgtatttgtgagagattaaaaataatgtcatagctcaatttttgtccacatccatgattatggcctttggaaaaattctgagaagtcaagttgctggatcaaaaattactctttcactggccaggcatggtggctcacacctgtaatcccagtactttgggaagctgaggcgggcagatcacttgaggtcaggagtttgagaccagcctggccaacatggtgaaaccccatctctacaaaaaatacaaaaattagctgggtgtaatggcatgtacctgtaatcccagctactcaggagactgaggcacgagaattgtttgtttgaacccgggaagaggaggttgcagtgagccaagattgtgccactgcactccagcctgggtgcagagtgagattctgtctcaaaaaaaaaaaaaaaaaatctttcaggcttttggttaacacttcccaatggctcaccacaaagactatgccagttgaatttccaggagcagtttttgtgagcaatggtttctttaatcctagcccacagtgatgaaggtaggtttattcaaatgatttcatactttttttttgtgataatgcatatcctagactttccagttatgagaagggaagcatcatgctgtaattcctggtattatgctttcagtgttttgccatttaggcaaaggtaaactattggttattggttttggagaagtagtctttattatatttaaagaatttccttctattcctatgtttaggctttttattaagaatgcctgctgtatttaattaaatgtcttttcagtatttattgaaaacgtcctacatgttttctctttcaatttgttggtgttatgaataatatagactgatttcctgacagtgaaccatcgttgcatcctgggaatgtgttccctgcttgagcatttagacacattcctggattctatgtctttttctttgcgtgtgtgtgtgtgtgtgtgtgtagtgtttgtttatacacatgcgtctctcctgtgaaactccctttttaaaataaattatccttgcataatattcctggatttgtatgttagacaaggacatgggtccaagtcatctcttggattccagtcattcctgtaaccaaaaccaattcttcacaatttattcctttaaaaaaatcataagccatgtggtttcaatgcgctttaatttgaattcaattaaaaagaatttaacaagtcagcttttcccaaacaaaactttatattctattttctttaggagctcagtgaatctaaacattaagtttcaatataaaatctttagaaacaccgtaaaactatgtaaacagtggtagtttgcatctctttgtttgtaatcaatcactgagcccatgaaattcaaagccagacaaatccttgtactactaagggtcataagccagaatgtcttaaaaaatatcctcaaagctttggaatccagtaagaattaggaaatgagtcggagtcagacaccccgagcacaaactagcgcaaccccacaaaacatgtttgagttttcatcctggactctatttttaatagtatgttagaattaaaaacagaattctgcctctgtatttataagtgagattagtctacagttttattttttatactattttaaatcaggttttataatcacaataacactggctatttaaaacaaactgtgcattttcaccctatagtcttgggatagttcaagtaaaattatctatattttgaggacttgacaaaactcagctgtacatttttctatggtagatttttctttaaaaaatccatggtaattgctctagctcaagtttctcttttcataagtcagtcagttaatttttttaaaacattttgcaagcattcactcatttcctctaggttctaaaatttgttgcctcagagttgcaatgtagtgttatttattttttgagataaaatctcattctgtcacccaggctggaatgcagtgacacgatctcggctcactgcaacctccacctccacctcctgggttcaagcgattctcctgcctcagcctcctgagtcgctgggattacagatgtgcaccaccacacccagctaatttttgtatttttagtagagacagggtttcaccatgttggccaggatggtcttgaactcctgacctcaggtgattcatccacctcggcctcccaaagtgctgggattataggcatgaaccactgcgcctggcctatttttcaagtcttttcatcctcctgtatctggaataaaattccctttctcattcctcattttgtctatttttgtttgcttttttctttattggggttgtgaaggattcatcttttttgttttgctttctattaattttagtctctattctttcttgcaagttttgttctctttcaatttcttaaatacttccttttcaggcttttaagacccaagaattccttggtacagctttctctgtatcctgtaaattttgatatgaaataattaatagtctctttttctttgcttttgagaccattggtagttttccttttaatttcctctttgatccaatagatatatccaggaatgttttcttaattatcagaaaatatagcctacaacatctacttttacaaaaatttaaagtttctttagtgatatacttttttatatggagacatactaaaaaattctatttgactgatgaaaggctttctatgtttttattaaaccaaacttcttgtttatattcaattttcctgtcatcttgtctcttcgtatattttaaatcaagctcttctatgttaatcactcttgttttacgtattcgttacgttgtttgtttgatatagatcagctgttcagcacctactgtctctcaacatgcttagtgctcttaaccctaaattccacattgcctgacgctaccatgcatgcatgcttttttgttcacctgtcatcactattctcacccctttaagggcaaccttttattatcactttatgtgtgtttcttggaaaaaagttattgctagtttttaaacccagtctgctcatctctgcttttaattggggaattcagtcatatttgatacgagatattcacttctcaactaccaatttcaaacaacattctctgtatcctctcttatcccaataaaatgaggtttaaagtgaagttttgagtatttttactccccctttctgcatactccctacttttgtttattttttgaaacagggtctcactctgtcacccaggctggagtgcagtggcatgatctcggctcactgcagcctccaccttctaggctcaagtgattgattctcctgtctcagcctatcaagtagctaggactacaggtgcgtcagcacacctggctaatttttttattttattttttgtagagatgcggttttcctaggttgctcctgctggtctccgactcctgagctcaagtaatcctcctgcctcagcctcccaaagtgctaggattgcaggtaagagccactgcacctggctcctactctttttactgaaacaatttatctttagttacagcttggtatcagaatttctttcattgtctctctcctcattcaaatgtcctcacctggcacttattgtacatttctagatagcctctcctcatccattttacttttaattttagatcttcctctcctggttcattacttgccactatctctgtccaccttgatgtctctaatctggctcatctgatgtttgtctagtatctttccttaggtgtggcccatgagtgatgggctccctgagttcctgcgtacccgtatatctttcttttgtcctgacaggtaaatgatgtcttgcttgggaatagaacccttggagcgtgtagatgggataccacggtcttccagctcctattgcaggtgagaagtccactgtcaatttgattagtttttcttaaaacttggagtgctggaactttatcactagtgaagagatgtgtcatttctcatcagtttagcctggacttgtagattccttttaatctacaggattaagtttcttcaacttgaatattttattggaaacttatttaatgtttgactccgttctaatagttatcttttctttctaaacttctgttcttcccacttcacggctcaacctcttcatgggtttgctctgtgatttgagagagcttttcttgttctttatctttcagactactattttgggtctcagtagaaaccatgcatttttctttttttgttttttgagacagagtcttgctctgctgcccaggctggagtgcagtggttccatcgtggctcactacaacctctgcctccagggttcaggcgattctccttgctcctgagtagctgggactacagctgtgcaccatcacgtctggctaagtttggtatttttagtagagacggggtttcactatgttggccaggctggtttcaaatgcctgacctcaggtgatctgcccaccttggcctcccaaagtgctgggattacaggcgtgagccactgtgcctgttcacatttttcatctattgcagttttaaactgggaaatcttttttgttctttttctagtggcccctcctcttgaattttctgaagtgctttcttattttttgttggtatttctggcagctgtatttctttgggctggtactctgttctgagtggcctttattgtggtgtccaggctctctgataggttattactattttttgtcacctcactggacccaagaatggttggtggcttccccagtgtgacagtggcctcagagtatagaaactgaagttgtgagtgatgcagaggtgcaggtaggtggtcagtccctagaaggaagcttctccagaccctggtctttctgccctcttgccagtcttggttccagagggttctacaggggagttagctccatttgcagcccttctcaccttgggttctgagagagagagagagagaccctaatctccagaggcatccattatatgtaatgaattaacttttctcctgtgcacccagaatggttctttgcaccatctttgggagaattgagaaaatgggcattcaaatcactttacagggctcattcctcttatggatccctgatgggcaaggctgggcagggcatactcaaattgctcaagtcagggttgctattgacctttcttggctgatgggggaagggatcccacggatctctggagcccaagctctacccaagggagtgctagatgtttgggctccagagccacactgtctagggtggactataggcaaattatggaaattttctgtaacctagcacactgtaagcacttggtaagtgggcttttgtttacagatataattgctgctgcttctccttcttcattggctaacatctgctgcttgctttgacactattcttcagcctcccttctggaccccagagcctcattctgttgggacccaggagctattggctcaagagaggcaggattgtggggctggatggggattgggtgccacattctgattgttgtgatgtcagaatcctattcatcatcattattgctgtcatcaattgcctgtgaggggcattggcctgaggctgtttcctactctctccttgagcctttatggatatattttggataaatgtaattagctacccggggaagcaggagatacttattttatagggagagagttcttctctcagtggagtgtgggtatcagcctccatgtgctcaacatacctggagacttggtcgggacttgtgcacgtccccccagctcaggacccacacttggtcatgtgacttgtcataggacagcttagccggcagagggtccacacctatggacttgaaaaaaaatagtgacatgttgtgaaagctgacatgatggtcatttctgggcgttgtatgcatgggcatcactcctgggcgaggggaaagccagtctagaagccttgccaatggttccatttgggaacccagggcagaagcttcccctctgtcttttttctcagaggcattattattattattattattattattattattaatttttgagacggagtcttgctcttgttgcccaggctggagtgcaatgatgtgatctcggctcactgcaacctccgcctcccaggctcaagagattctcctgcctcagcctcccgagtagctgggattacaggcatacacaccacgccctgctaactttgtatttttagtagagatgggatttctccatgtcggtcaggctggtctcaaactcccgacctcaggtgatccgcccacctcagcctcccaaagtgctgggattacaggtgtgagccactgtgcccggcccagaggcataaaattagtggtcaataatgttccttattttcctgcatgttacttaaagggacctagaccaacatggcaaaagtctgaacacagaggctaagtttttcactcaggaaccagctccagggttccttcgttcttcctgaaagtcttggaccctcagcatccttccctagactactctgtggcctagattctggtgagttggtccttcctcctaggtcatctgaggtggactttgagatcatccattatcacccctctctatctatctttgttctactctgggcagtttctatcttgcacagcctttgactggcgcctctgggtctcagactatggcatcagcagacgtgctcttttttaactgcagtactgctatcccctgatgatatagcttctcctatggccctgtcaaatgaaagctgttttctacttcttatagattacaagctcaaaaactctgttctataatgctcatgccactagactatggccccctgctcttcttcttgtcactggtcaacattctagtcctccctttgctgtcttcctctctactactcacttggtcactaagtttggtgccttcaatccacatggaagagtcatccaaagccctccttttcttagttccttcttggtttcaatgatcttttcctcctccccacctcagccaccttatactttgttttatttcacccactcatattctagtattctagtctctccgatgagggggagaaaaactgcatcatctctgcctccactggtcaaaacttttctaaagaagtaagcatttctccttaactcactttcaccaagtttctgaattcgtgccgaattcagagaccattctgtaatcctatttgacatttcagtaagattccacatgattaaacccttacatacccttccttacctcacgtggcctcccgcctccctggcttctcctcttcattctgacttcatctttgactgtcttctctctttcactggaatgccatggcttctaataaccctctatactctgatgactctagaattcattcatctgttgatgatctcaacctaacgtatagagaattgaactcttgatttttcccaccctgctgaaatatatctcttctccactcatcaccatctttgaagtctccctttactctcttgctttaattactctcttgctttaattaaaaactcttgtcccctgagccttaagtagaggctgctttttattttctagactttacataccccgaggcctttgtagcctccagctacctgtatttgttcctgccagtttctcttcattcaccaaaggctttagcacctgacactgtcttcctctactgagagcttcctaacccatcagtaatgataccatcttgacaacacattctcctccagctatcctgttaaacttccctcaagtttggactttagctgttctctctcctttctgcttaaccttctcccattggatttcatactcttattctaaggtggtatggagcaggagtccagagaacttaagccaaaaatcatttaaattgaggacagaatttttcacagtctcaatgtgctgagcagcaaggctatggcagccaagagatctgatcctggcaaacaagccccaggattaggggcaaatcagaggcaggctgagccctacagaagcttcaactcagtctctactctctttgcctagcagaggaaagtgtaatcttctatatagagtgtttgccattaaaaggtttattagaaacagaagataggttgatagaacatatccaaattgaagcagaaagagacatgtgagacccaatggaaagaatggaaagtcctaacttttttttttaaacagagttcccaaagaagaggtgagagagaacgaggcagcagaatatatgaaaaaatagtggctgacattttttttcaatcttttgaaagatatcagtatacatattcaagaaatacacatattctttgtaaatcccaaatcataatacaaagaatgccatatgcacacacataataaactgctaaagatcacggagaaaaatctggaaagtagagaaaaatgatacagcaccttcaaaatagcaacaataagactatcagcaaaaataactgaagataatgaaatgataccttaaaatgctgaaagaaaagaatcgctaacatagaattctatactcagtgaagaatagaaagtaaagatttttttttttttttttgagacggagtctccctttgtcacccaggctggtgcaatcttggctcactgcaatctctgcctcccaggttcaagtgattctcctgtttcagcctcccaagtagctgggattataggcctgcaccaccacgcccagctaatttttgtatttttagtacagacagggcttcaccatgttggtcagactggtctcgaactcctgacctcaggtgatccacctgccctggcctcccagagtgctgggattacaggcatgagccaccgtgcctggcctgagaaatacaaagtaaagtaaagatatttgaaaagaaaaactgtgagaatctgtttccaacagatcttcaagcaaagttggtgttagaactattcaggaattaatggcaaatgtgtgggtgaatataaattaatgtcctgtggggttaaattacatatacagataaaattcattaccacaacaatgcaaaagtaagggggaggagggttgaaggagttgaagtgttttatggttctagcattattggggatattaagtaacaatttgtatgagactgtattgatgcaatgatgcatgttataatcactattatgttaacaacataaaagagtgcatcgtcaacaacagaataattaaaatgtttggcaaatccacaagaaagcaaaaaggagaaaaaagcaacataaacaggtaggtcaaataacaaaagtaacatagtagataaaaatcaactatataattaattatgttaaacataaatgtatcaaatactccaagtaaaagactaagatgattaaattagataaaaacccaactacacgtggctttataaaagaggaccttaaatataatgacatagaaaggttgaaagttaaaaggagggaacaattataccatgagaaaacgaattaaaataaatctgatttagctatactagtgttagacaatagattttcaggcaagcagcattaccagagataaagagggatattttgtaagaataaaaggaaaatgatataattttaaagcaaaaatgagtagaactttgcgaaatatagtggaagatgttaacacacctctctgcagctgatggactaagcagacaagaaaatcaccaaggatagatctgaacaatacaatgaaccaagtagacataattgacacatatatagaatacagtatctaacatcagaatgcacattcttttaaagtacacatggaacatttaccaaaattggtcataaactcagtcataaaacaagcttcaataaatctcaaaggatcgatattattcagagtatgttctctggccaggggaatcaataacaaagaggcagttggaacatgtcccattgtatttgccaagagaaacacgaccctggctatttccaactttcttcatataacaagcctttactggggaaactgagcattgttgaagagatccaactctggtctcactttaaatttatacccacaattcttaagtgggccctcattgttgcccagcagtcctatcagatttgcctggccagttcagtctcatgttgaacttttacctctctcttcaaacctccaggcttgactgagaaaaaacaactcaaaaagaagttcatctaactaccacccattgcatcacctattgtacttgtgcctggatgtaagatattccacttcctcctgttataatgaaaggatgtgattttatctggggctagatctccacttgtgtgctttggatttcattgactcctgcctagagtcaatgcaggatgaggatgcaggagagaaagagaagaattgtgggagtagttattctcagtagcatatagtgctgtaatgtcacctactttaaaaagttcttttgtcattcccttccaggcattgcctcatttctttacatttactcacctttacagcaaaacccttccatatgattgcctgtattcaccatctccatttcctcacctacgattctaacttgaatccactccagcaggcttgcattccaccattatcctatctgttcctgccaaggtgatccatgactctattgtaccaaatccaatggtcagtcctcagtcttcataacatacacatgctcatcacagcacaactcccttgaaacacactcttcttttagcttcaagaatatctctctttatcctaattttttcctatctttcaggttattcctccttggtctcctttattggtttcttctctccttactgatctttaaatgttggagtgcttcaggactccaatcttgacctcttctctgtctataccacctcttggtaatttcatccagtttcctggattaatacagttcatatggtgacgatacccaaatcgatatctctagcttaggcctctcctttgactccagacctgtttatctaactgcttacttgacttctctacttacacatctaacagtattttaaacttaaatcaccccccaatctgctccctgccttgcccgaagtctcttctcttctaacagtattttaaacttaaatcaccccccaatctgctccctgccttgcctgaagtctcttctcttgtagtgcattagtttcatattgctgtagtaaccaattattagagatttgatggcttaaaacaacacatttattctcttacagttctggagaccagaaagccaaaatcaattgaaaccagcactccttctagaggttctaggggagagtatggttccatgcctttttccagtctccagagctgcatttcttgtatcccttggcttctggccccttcatcccatcttcaaagacagcaattcagcatcttgtttcagttctcacattgcctttttcatctttgcagtcaaatttttctttgcctccctcttataaggacatttgtgattgcatttagggcccatccaggtaatccaggataatctcatttaaaaatccttaattgaaacacatctgcaaagtcccttttgctatataaggcgacatccacaggttctgtggattaggatgtagacatcttgggggctattatttagcctaccacacattgtaaatggtatcacccttctatagttgcttaagttaaaagacaacttaaatcctttttacctcaagccttatattcaatctgtcagaaagaatctatcagaaagtctttcaggcttcatgtttaaaatatgtcaagaaactgatcctttttcaccactcccactgctgttgtcatctcttgcctggattacatcagaccagatccctgctccatcttcctgttcttttgagacagagtgttgctctgctgcccaggctggagtgcagtggtgtgatctcggctcactgcaacctccacctcccgggttgaagtgattctcctgcctcggcctcccgtcaagtgattctcctgcctcggcctcccgtcaagtgattctcctgcctcagcctcctgagtagctgggattacaggcacctgccaccacgcctggctaatttttttgtatttttagtagagacggggtttcaccacattggccaggctggtctcaaactcctgaccttaggtgatccacccacctcagcctcccaaagtgctgggattataggtgtgagccaccacacccagcccgtttgttaacacaaccaccaggttgattctttaaagatctaagtcagattggatcaatcccctgatgaaagcccttctgtgactttctcactgaaatgtcctcactttgggctttgttttagctcctgactggcctccgaggccctgtgtgagtgggcccttgcttggcctgacttcatcctcccactctacccttcatcactgtgccttctctcagagtctcggtcctacctggcatctcattcaccttgagggaaaaggccaattgaaaatagtcttcctgttcctcttttgcttggaacctggtttttcatagtccttattacttatagttctctaaaattctgatttatggtccccaactagaatatgagttctagggaaattattgctcattcatggctgtttccctacatagtagacaatcaatacttcacgaataattacacatgaatcttttctcccttcagtctgaccacctggcacaggagctggggagtatgcagaaagcaaagaagaatgtggcaggctgtgccccagaatttgaagttttcctcactccattaaagaggtgtacctgtaggactttctgggcttggatgtcgaccacaaggactctgctcagtgctggctgggccacatagatgtaccggttccggacattgactgcagatacccactggcagggctgggttgcatttttttctctttgaggacagatttcttcctgcaaaggagataggctgtcatatatcttcttaattgccctttccctccaacatctctaggtactctctcccctgaccctcctctgtgcctttcttcctctctcttagaatcctttggatccatagaacagggcacccaagccctccaacatcactgacttctcacttaacattcctttaatcttttggggctaaaactccctttgcacccgctcagttagcagcttccaggttcatgttcttctattcttacgctatcttctccctctcctcatcttcattttaaaaacttctgttcatggccaaacttctgaaagagttgcctatactccttctccacttcccacctcttgcatgctccttaacactctggctctagtcctcagagctgacgttgttctccccaaggtcaacatggactccccacttattacattaaacctgtgttgactccctctgttccctcccctccatcctccctcggcggctgatcctctgttgctggactctgctcagtgtgctgatctctatatgctagggtgtccagggttcacgcctaagtttcttctctaaaatccacccccttgttaatctcattgaaacctatggctttaaatacattctatgtgctcacaactcccaattcatacctttagcccaggcctcttccccgaactctagacttcaataaccaactgcctagctccacttggttgttcaaaatcaactcttgattttacttcttaatcctgctcattctactgaaaacctggcaagtctgctgttttacttccataggccaaaaccttacaatctagtgaagtgaggccatccttgatgcctctaacctcaggccccatccaatgtctcacaagtcatttcagatttaccttcacaatatatccagaaataggctctgaccatttctgctccatcaccctggccaggtcacactacctgccacttaggtgactgctatagcatccgtgtatgctcctggattccaccctagcctcccaacctgttcttgacccagcggccacagggatcactgtaaaattcaagtcagatcatgtgactcctctttctcaattccccctcactcccaataacattatttcttgttcagaataaaatcccaagtctttcctacaaggccctctacattcggtctgctgcttttctctcttacccaccctactccatgccatgggcgtgctcagcactcctcaatcacgccgctctcctgcaccagggcctttgccttggctgttccttttgcttggaatgttcttccccagatatctacagggtttattttctcatttccttcaggtctctgcttagtatcaccttattgggaggtcttctctgacctcgtctatctcagctctccttgtacccttactctcttaccagctgcattttccatttaccacttgactttctgcattcatttgtctacctgggcacagcctttcctccttcactagattgtaagtaagttccttgagggcaggtctttggttcactgctatatgattagcacctagtacagtgcctggcacagagtcagtgcttaaaatgtatttgctgacagaataaatgagtgtaaaaggggaccttcttttcctttgtcttacatgatatacagtctcatggttttccttgcgattgtggcccaactctgtctgaatcttctttgtggttcctcttagtctgcctgtccctgaactgttggtgactccagggttctgttccagatacccatctcaaatcacttgcacatgcccttgtctgtcccatttggccaacactcacatgctaatggcacccagatctgtctttatctcagaaccttctccagctcctgcttggttctctcatgccaccccccattctctcctaggtgactgcaatagctttgaaactagtctctctccttttactcttgttctcatatttaatccttatataatcccaacttgcctatgagacaactgcagcttagagaggctaggtaacttttctaaagctacttagtctacagaggtgggatttgaacccaagtctacctgactctgaaggctatgcctttatctgtgacatcacgctgcctccttctggaaaaagtagacatctaagccagcagagaggcctgacgtgggatgccccaatctcctactcaccagcccttcaggaagaggcttgtcccattgtaattctcgttaggtgtttgagcattttctagatggaaaatcgttctttgggatcattccccagctcaccacagtcttatattgcctgaaacaccttcaggacctctctgtgtcttgtgtctagcttcttatccaggaaaactgaatcccggttaggatttgagagagtccctccaagttacaggttaggttactacaaatatatgagaaatttgtgccaatgtgatggagtgcaattatttaaacctaattgctggaactctttctaactggcttcatagctgttattaatatatggaaggaacattgatgggaaataacacttctaaaaaataatgaaataactcaaatgaaacagcctggaaaacagcttttcccaaagccacaaatgagagaaatggaacagcctgagatataccaatagctagcacagcaatgctttaggaacttgcctgggccaagcccacttcctccatgggctccaagcccgtaactattcactgagtgaattgtgcacagttatttcattctgtacaactgaggacacactgtatcctcaaggggaaggcatatggggcattgacatgaccctttgggattcaacactatagtcctgtcctcaaggagcgcagggtatcctgcaaggccaagtgggaaacaagccagaggaacagaggcctggtgtgggggccacagccctgggggaggcctcctaaggctatcctggaagggctttcctggatcctctatcagcaatcatgctcctgcctctgcccactgaatgttccatcgttattttctacctggccttagtttcctgaaggctactgagaaaacacatgtttggcagctgtctgttcacattgctgtctccatcgtttgactgtgaatttctggaggccagaaacccatttgtaccacctgggcctcacctgaggctcagtgcagagaagtggcttctggatgaaggaatgagaattttaaattctcagcctcatctattcctctcttagcctgggaaaaaatttggaaccacaccacatatagcaaatggaattttagaaatcaaatggcatgcctggttaaagatagacttttaggattttgcctgtgtatgatgtagaagctgccccaggcacagttacttacatagctcatgaaaatcttttccgtgggtttgaggtgcctctggatctcacagtccacaggatggatgacgatgataccgtcgtcggagaagacatagaacatgtttcccacgctgaggcctgggaggagcaaatggaatgggcatgccctccaagcagtcggcccctgggcagggtcacacgcagcattgaacacacaagaaaccggccacgtggatgcatctggtgcaggcacgagatgcaattcctggtcagggtggggtagaatgagcagccagcttgtagctggatgggtgcagagagggccccccaggactatgaatcagtaaagcatgtcacaggctacgtacagctgccctaagtcatctagagttggccacaggttttcagataaaagccttggctttgatgtacatttgacctttcctgttctgaaagggaaagcctcccttgattgtttataatatactagtcacatcaggatggatcagtggatgccaaagtagcaaaggctttcatttgcttttttaaacccatgtatgtacagtgtcacttcctggaatgtggagtctaagaatgctgccctttgcccaaactctgtcctggctgtgctggccaacccctctttccagacagcttgctcttacttctgttccctgcccccccaccgccccccaccgtttctctggcagcccgtgccaggcagcagaacctacactccagtcatgcccccctgaccccggcccagggctgtagctgtctggggagaaggtctaagcaaaccagctgagaaggggccttggggaccagctagctcagcctccttattttaaagacaaactgaggtccaaggagggaaagggacttgtctgaggccacccgtctctgtgccagagctggagctagaccctgggccctgcattctggcctctgtccctcattctgtctctataaagggggaacaaggtacaaggagatgtaagctctagagtgctccttccctctccctgtctttctgtctcctcccgactctgtctccttatttctatctcccctttcccttcctttcttcatttcttttaaatctagaacattaagatctctgtaaattctagggtaaatatgtagaaaaatctcttttctagttttttttttttttttttttttttttttttttttttagcatgctgagaaaactggtatgctggtttaatggactatctgggcaagtttttagtgagttagaaaacaacaaaacaggaatcactgttttacttttttccaacaactctgcatgcagttttctgggccttgggtccttggcacccagaggcactaatgtgagtggtccttgctgttgaacaaggggctgactctatgataaacctcagccgcctccagcgtctgtgctgagacaggctctgggcaggagggctcctgccaccagaagcagctggaacccagcctctcagaagctgtgaacaccagggagtatccagcatagctctccataagcaatcccgggggaatcaggggcgctgggcagcctgtttctcaaaaaccagatgaagctcagctcccgccaagagtcagtcttagctccacagcatctcagtgtttggagccagcactccagcacacacctgccctgaccccatctatctcacccacagcgggaacttctcttctgtactctttcacctgacaaactgcttccacgcaaacctaggggccagaggggtcaaagtccccactaagccacaaactccaggaacagcctcccaagtctgcttagaaaatcggtagttggaagaaccaacataagattgaaagcataatagagcccacatggggtttgtggctgtagctacattctgggctgagtgcagtaccttggccttgctcacagtcggccctggaatatgaggctcaacaaacagtcattcaacaagtaattgacttcacgggatacccagcctcctgatccagctccctggaagctgcctgagtgtagcttctgctaagagggcccgaaggagctgtttttgcttttgtctgttctcctctcatttctcctgttgagacttgtgtgtcccctgaggcctactggcctcttcattttggctccttatccctatctccagaccttgagtttcaggagtgaagggtacaagctacccaggcagtattgaatttgttcactgctcaattgttcaatatacctaccaaccctatgccccaaggcggctgtgggtctttagcgggcactggggtctttgtagctgatttcacattccatggggcctcttgcattcgtggtaggtctctacttctgaaacttgagaccctttgtagtaacctcccctaaggaaaacaccacctcttaaacacttgagtgactgtgcatctcagcctagatgctgctagttcagcagctgtgagagcctaaggggccgctgtgatcagcgactgttgctattgacagcagttcctcgttttctgggctctgcctttgttttgttcccagacttatcatgtcagctttagttcctgacgttcaggaaattgttctgagtatgtgtctgcatgcatatgccagactgcaggtaacaccgtgtgaagttcttgaggaaaaaatgagatgggaaatgtcttggttttcaaagagggagattttgtgcttaacccatcaatcacatggtacctcctgctgctgcccactgagctggagaatgagttgccacaaggggatttggactcagatctggttgtggggacacagtggggactgggacccgggcatgcacctgcaccccacacagtgactcaggctctgccaccagctcccacacatgcccactatattttcagccatatgaaattgtcaatcttagaccactttgatgcacaaaaatggcaacttcatatggctcaacttactaaagatttgcttgataaatatgtttctaaacatctatacatttaaaaatatacattggcagaaatcatggcagcttttttcctcgggttttcctcaatcaaagcatatttaaggtacagtgactatctagtagagatctacaacttgttttgtctttttaaaaccacacaagataggcaaaacactaaacccaacaccagtcagctactggaaaaaagtttaaggcccagatctgaccaggaacccttaccaactgttctgcttcagcagaggttacaagccacttttaatgaaagctttgcatttaaaaatttctcattaaagacaggagtacattttaaatttgattcaatgcatatgccacttgaatttgacattgacttcctgctcccatagggctgctttgtgtgggaaagctggtggcagatcatggaaagacggcccatcatagaaccaaacacacgtgatcacaggcatgacgcaaaacaatgaagcttggtaccttcctctcgccacaggatgtttgcaactgcagcagcagagaatgaggaaagcaggagtgtgatggagtcaaggaaaaagaagaaagcagtgttaaaccgtcactgcagtgattccatttatgaagatcctggtacctagtccatcacttacagaatctataccactcattgccctaggaacagtatcttgggggaagctctggacatgaacaaatgctttcaggtctccagaccctttgattcttaagtgaatctttgaaatcatgccctaggaccacagaagctaatggaatttctcacatttcatggatgatcaagagtaagcaacatctctcccagatttcctggacaaccagcaggagaagtgactttcaactaggattctcctaagatgaccacgtgaaatacttctgattatctactttgatgaaaatggcttagcctggagtctttgaccatgattaacacccatgtctatgaaatcacacctgcaggcctacctggggagcagtggttatgaggagagcacgcttagcacaccgatgggctggacccctagtgtaaaggctaccacactcccaatggtgtgcatgtgtgcacaggtcaggttctgggccactgtgggacatcacgtggatgaagggcagaggttcagggcatacagcaagtaaaaagcagagctgggactcgactatttgggtttccttgtgttcctgggctctgtctgctgtccagggaatctccctgtctgtttccagagttgtctaggttgccagggaaggcctgctcacctctgggtgccctccaattccagctttatgcaaagagggatatgaggcttacccctgtcttcacgggctcatggttggcagctgtggccctggtcaattggtgccctcccttgccacccaacacctcccagccagctcagtgagaagcataaacgcgtgtcgacttacgggtctttctagctgagtcttcaatgaagagcgaggagatatcttcatccacacccacttcatttttggcaatgcaggtgtatgcccctgtgtcttcataccgaacactgctgatgtggagttcgctcccattggctgcagacaggacagtgctcagggtggactgctcagctggagacccactcactttcctttatggggccattgagagtgttagggctgcccagcccctgggcagccagcagccctgattatacgcccaggaagggctggcacatctgaaatgcactgagggtgagctggacctgagtgacagcttctcatcattgctgtcagaaagccccaaaagatctgtgtgagcccagataacagggaaatttgggagccatctgttcactcctaacctgtctgacttataaacaaattatacctctcgtttccattcctggagtctcagcttgatttgaatgggaatatcgcatagacgtctaccaagggcagttcttacctaaaagggagagctgtttggacatctgagttgagacatccacgccgtttttcagccaagtgattctgggcatgggaatgccctcagcatggcatcttaggctggctgccactccaggctcctgtgcctggctctctggatagacacggatgactggcggcactgtgggtgagagtcagtgctggtgagaaagagacggccctgacctggacttgggcctgtggcccaacctgagaccctgctccagagggggtgaacccaagtaggtgactggagttctgtgtttaaccaaattataataatcctgtccagcaacgcaagctctaaaagaaagggctataaaatagattgcagataataaacatgtcagactttgtaccctatgactcatggctttcatcattattctaaatacgatcagaaggccatccaaatatttaatgctgttcagctgctacatgtaaagagcagcagccactgaaatttatttctgaataaaatttagatacattccctttctgttatcagaaagccattggataggggttaatttcttgcaggaaatgtatcagaaagcacttatggcactgactggcagggcctctgttctggggaagttcattcattttccagtgggccattctcatttctccacttctcaacccctggaacatgggtgaaaggccaggtgtgccctcctcagcttggagtgactcagccatgggccctggcagtcaggttcagggttgggggtgtgagcctgcccactcaccagacgagcatgggtgggcaaggctccagcaccctccacagagctctggcccttcctacccagcctggctgtggggaggggcctggaagaagcaatgagggtctggaggaccctccctcttacccctagctctgggtccaggagataagtatcatttttagtggaattgagggttcttccttatctataacttttactttacacactttcaaaaaagatttgtgagatgtaaacatacctgcatattaaactaaactaaacacactgtccctggagatgggggagatggattcttcttgaagtggacagctacattttcctagagttatctggaactccctgttgttcagttaaagaaagcatcccagtactttagaatagagaagatttttcttggaaccagagcatagaacaaattggtacttatgtacaaaaggcaatggtgtggatcccgggacctgagtggggtagaatttttgtgatgcatgtggggtgggcagaggataaaagaaaaactccacggcctccctgtgagaaatgaactctgtagctcctgtcacagctcctcaggggctgctcataattccatcaactcagtctgaatttcaaatcttttcttgatctgtgggacacagttggaggcagaggtgaaagctaaatggacaactgcctagggagacaatcccatcctccaatggtccagagctgtttcaataacatgagctcagggcacccaatgccaaaccacacagagacccaaaacaataaagtcagagtccttgcctcagtttttctttgtttgaagccctgggggagaatgccagggagtggcagaaaagcctgtcacaagtcaggccactaggggtggaggaggtccacggagctccagcggaggcatgtctggaggactgcttccaacataaatgtgtagctctcttctctgacccgtttgatccaaagaggaaagaaggaaacttccctgcttgattcaaagaggaaagaaagaaacttccctataccttgccttgggtagagggaggagtggggttccctttgaatagatagaattttggtcggaattcagtaacgcagagagagaaccaggagtactggccttgggggtggttggagaaggtggtagcatagagccaccagagttctagaataggaatggccaggacctggggttaataagcttgggttcttactagatcactgtctatttctacaagcctgcctggcaaccacagaataaacttaaagaaagaagaagaatcaatggagacagaagcataaatgaatgaatcaaccagaaagctgaagaacagaactggtaaagaaatctaagagctgtttgtaaaaaccaacaaaacagccaaattcctgggatgtttgatcaataaaaaaatagaaaaagaacacagaagggattaaaaaatatgagaatgctgtattcaattattggtaataaatgtgaaagtctcagtgaaatggatcatttaaaaggaaactttaggccaggtgcggtggctcatgcctattatctcagcactttgggaggccgaggtgggcagatcccttgagcccacatgttcgagactagcctgggcaacatggcaaaaccccacctctatcaaacatacaaacattagccgggtgtggtggcacacacctctggtcccagctactcagtaggctgaggtgggaggatcccttgagcccggaaggttgaggctgtagtgagccatgattgtgccgctgcactccagcctgggtgacagagcaagaacctctctcaaataataataataaaaataaaaaaaaggaaacttggaagtaccagcattgagttaaggagagaatatttaaaacaactgtaaagtactactaactcaaaaggcactctgacaagttttatcagacaattccttcattcatttaaggaatgaataatccctagagcatggaacagggaagatgttccaaattacatcatgaaggtagcataacctggacaccaaaacctggcagagaatgcaaaaaagactacacactgatctcacttaggacgtgatacaccaaaattctaagtaaaatatggacaagtcaaaactagcatggtattaaaagaacatactgtgggcaagggtaatatgtttcaatggctaactattaggaaatctaccattaatcattccaaagtcaaggagaaaaaccatttgattctcttgctagacactagaagggcctttgaaaaaagttcaaaatcaatttcttggggaaaatccctcaataaaataggaacagaatgatattttcttcgtgcaatgcagaatatctctataaaaagaagaaacgacaccattctttttcaaatggtgaaacattaatttgggaaaaaagaaaaaggacaaaggaagagaggcaataccagactcccaatgtcacactggatgttgtcaatggaaggcaagaaatgagaggcacaaatagtacaaagatggagaaaaatcatatgtagttatatccaggtaatgcaccaataaagttataaggattaattggtacgtaacgaggccagtactaaaatatacaaaattaacagcttgcttatacaccagcaatggccagacagaaaatataatggaactcaatgaagaaaacaatataacctcactgatgacattaaaaaaggcttggataattggagagagatgctcttggatagaaagacttaatatcgttaggaaacaaattcaaaattaagccatatgtttaatctaactccaattaaaaaatcagttggtaggtgccaggcaccgtggctcatgtctgtaatcccagcactttgggaggctgaggtgggcggatcgctcgagtccaggagtttgagaccagcctgggcaacgttgtgaaaccctgattctaccaaaaatacaaaaaattagccagatatggtggcatgcgcctgtaatcccagctacttgggaggctgagatgggaggattgcttgagcctggaaagttgaggctgcagtgagcctagatcatgctattgcactccaacctgggcaactgagggagaccttgtcttaaaaaaaaaaaatcagttggtcagggcttgacaaaacaattctgaatttagaagaaaaaatatccaagaacagctgaggaaattttgaaaaaagggagtgattgtcattttgctatatcagatattacaaagttagataataccaaatgttgcaaagtggggtgcagggagagaggactgaggaagagctgagggcgttctgagtgtggcaccgccttaatgatcttgatgcattttacaaagctgtcaattcaatactgtgcagccaaagtttactaaatgccagccaagtgtcaggcaatgtcacacatagaagtggggagatagcctcaggccctaccctcatggagctttctgtctgggggaagtgattcaagaatgaaccatgagtgagacagtcacttccagagggagctttgggagcacagggacagtggtcccagaaaattgtcagaatagggaacagactccaccctctcacttcacccaggaagtgcttcctgatgtctatggtgcctgtccttttactggcggtgggcttgtccagtgaactggaaactcaaggaatgagcttgcctctgtatggtgggtggtacaccggcccctcagtgaggtggccagcaccagggctggacactggcctgtgcctcagccctggcctctgataggaatcctgcagacccacatgaatcgcataggggcaggtcgggggagcctggtaaagcacgatgctgggctcacccccagcgtctgattcctaagatctgagatggggctggaggatgtgcatttacctaacaggttccaagggagaccctgagtcagtggtgacttggaagctctcccagaccaattcagggctaattttgaaccgaagtgcatgccagtgttctagaacaaaatgaaacctgcctgcaagtcaagggtgtggaatgaatcattcccttaaaaatacatgactaaatgcaagacacctgggtctccattagcaggggcaaaaagatggctcacatgtgcttagagtgagatgcaccctctgctggtcttgaggtttttttgagccaaagcgggtaagatgactcctcactggcctccagcccttcagcaggactaaagagggggcctcagatctgcctgctccacctccggtgcccctgcgtctccccagttttgccccaactctctactggggatcactaggcctcttctcctcctgcgccttatcccagatcatgccaatctccactagaagcctaggcctctggggcatccctcctccccagaaccttctgtcgtgccttctggaactcatgttctgtcattagcaacatctcccacatcctcagactcttctatgagcactccttcaccttcttgctctagtggaaacctggcttcctcctgaggacgcagcttctcctgcagtggcttcaggggcggccccttctcttggtaccactagggtgggaggtggggtaggcgtcctcctgggcccacgttgccacttctagatcattctcgtgtcacacccacctcctacctagacaccaccccagctcggacatagctcccacgcctctcactcctgcatcctggtccccttttctactggatttttcctgttagcccacagaatgcttttatttctcctaccttggaaaaaaaaaaaaacccttctctttatcccagtttctctctcaactatgccccatttttctccttgaaaacaccctgaagtgttgtccatactcaaagttagagccagctctgggcagctcctacccgtgccagagctctggatccagcctcccaccaggaggatggagcagtgtggacagggagggtctacgtgggtgtgtgaagttcctggggccctgccaggaaaggtggagaccaagctctctgccagcaatgtggcagagacccaactctttcctttggccctgatatcctcttttgcttttgtgttaatccacacattaaaaataatgtgaaattaatatatcctaggcacacacattcattttcttttttctttgagatagagtctccctctgtcgcccaggttggagtgcagcagtgctatctcagctcattgcaaacttcacctctccggttcaagcaattctcatgcctcagcctcccaagtagctgggattacaggcacgtgccaccacacatggctaatttttgcattttttgtagagacagggtttcaccatgttggccaggctgggttcgaactcctggactcaagcgatccagcctcaacctcccaaagtgctgtgattataggcgtgagccagcacaccggcctcattttctcttaaatttgaaaatcttcaagtgaaaatatttgcatccataacacaaaggcccgctgtctttgggaaacaccgaccattcccaatgtgaaaggcagcgtaaatagatccttaagaggcacagtcacgaaagtagcatgcgggagtaataaacagattcaggaggttattattgtgtttttgggaatgaatcgctacttgtctgaactgtggggaggtcaagggtgtttttaatttaatggattaatcatttatgtctgatttctttttccttcctatgaaagcaatgcaagaggtttacccaaagttataaatcacgtcagtgctcgggccgcatctctgggaggtctgggctatgggcaagttatactaataatttgagagaggaagtagttgctggaatggtttctttagtcaaccaaatcagggcagagtcatggaaggggaagtcccagaaggtggtggccccgcctgtgcatggaatcttgaccccactgctggcagtgtggcagctccagggagaagcagcctatattctattcttggcttgaacgttttctctgggtcttgattttccaaactgtataatgggaaggaggctctctgaggggccaccagctctgaccatctgtgtccaccaaatatagctaaatttggcttgagttacaccaacaatcacccccgtatctaccctaccttggactgtgaactacatcctctgccaggcatttcccaagcattatatacatattctatttcatcagacgaggttgaggcagccagcagtgtgacctagaggtcagagtatggggtctggatccagagcaacacccagcagttgtgtgaccccaggcaagtgaccttttttagcaaatcatccatgaactggattaagatacgtggatgggaaggtccatgtgaagggctgagtacagggactgaccaaggcaagtgctgggaaaaccctggctactgtcatcaggaggcagtgaattcttcagtttctgggactcctggcaacacagggcctgtgagaatcaaggaaaagcttccaagcctcagtttctgtcctggcttggctaagatgaggctcattgggcctcctggggagggagacggacacaagcccttgtcggaggaaatagagcctcctaattgaacaagtgatatggttccataccacctggaaggagtggtggatttcagtttctgctcgcactagacccagaggccacagcggctcaccagcactgtgttgcctaaggggcatgctccatgctccacactgtctgtggcagccccagctgctgagcgtgactggcctgaatggctcacgccatggcacttggatttgtttcacctgtggaggctttgggtggagccaaatatgaaaattggtcaacagactttgccctttccacacggttcccctttacttataagagagatgatatattttggggttagatatttctttaagaagacagaatacaggagggggcgagggttgatctgagcagcagtttggggaggctatgaggggacaacatgcatggagccatttactaaccattcacctgcaggacgtgggtctggaacagctgctcgtggccggaagcatggcaggtgtaattgcccatgtggatggtggtcaccttggtgatgtacagggaatcatcctctccaaagtcctgcacagggcaaagatgacgatgagactggcctctttattgaacgggctggaaaccatagctgtctcctggttttccagaaatcctgcagctgggagagagttcctttctgcctggcccttgctcagccagagctgtctgcaggggtgagccgtcctgggcagcagcaaccccatcttgcctccacattgtgggcccagacctctgcatctgtttaaggccttgtgtacctggcccctcctccacgaggcccggtttgaacacatcccccagcacacgccctctcaatttcaagcaactaggcccacgtgtccccccatttaccggctgcctgcttgattctcaggggtgttgctcacctgatgagcagctctgtttccggaggccaggccttgtttagagcgggggttagctgactttcttaaggggctagcgagcagatatttttggcttcatgggtagcacagtttctgccaaatacccaactccgccactacagcatgaaaatagccttcaagacacataaattaatgaacgtggctgtgttccactgaagttttatttaaagttggtggcctggatttggcccatgggctgcagttggcctgcctatggtttagatcccacctcaatcccagcatgatttcaggctgcttgcagagatcttggtaacccaagggaagggaaatagaactaaagggaaaatggggcaaacaaaaaaaccagggcaggaacatcaaagagcactaggaagggcggatgcccatgggttccacaggaaatggctcaataagcctcagcactgtcatctctgcagcctcacacgatggggtcttactgggccagtgcacagaggagggatgggcaggaggggcttttggctgcatcagagtcccctgatgagcactgggcaccaagcacttgcccagtcagctgcattcccttttgcagacctgtgcccaatgctggcccttccaggcaccaactacagacatgccaggaattggaattacccgttttctacagagagccctcatcaggttgggccttggctaccaaacatttcccaggatatggtgctcagagctgatggtacagagaaggcccaggctcactaatgagcaagggggttgtgcactgtcatctgtggggagtgatgggaactcaggacatccaggatttagcttgagctctgccattgaccaatgtacccagtctctctgggcactggcttctccacctgtaaattgtggacaatatatacggcctgcctgccttatgtggtgttgggagatccggtgagaaaatgcatgtgagtgtatttttgaatgtgggatgcatgatatacacaggggatgttatttttcttgttattattagcagaagatgcaaaactcctcttgacccctggagaaaacaccaaatcatccctcctgcctttccctggccctttctgagctcccttttcccacagaagcattctggtggcaggagagaaggccgtggtggcatgagggctaaaagcagctgagggcagctccctgggtcctccgctgatactcatgtgagctcctgttcctgaaatgctgatgttctctcttgctaacactccagagggcccggccacaatggtcccgaaaccccttaaagacactttctgagccgggcatggtagctcatgcctgtaatcccaacactttgggaggccgaggcaggtggatcacttgaggtcaggagtttgagaccagcctggccaacatggtgaaaccctgtctctactaaaaatacaaaacaaacaaacaaacaaaaaaattagctgggcgtggaggcgggcgcctgtagtcccagctactcaggaggctgaggtaggagaattgcttgaacctgggaggcggaggttgtagtgagctgagattgtgccactgcactccagcctgggtgacagagcgagaccccacctccaaaaaaaaaaaaaaaaaaagacactttctggctaattagctggatgaaggggtgccggcccagagtgaagcttggggtagggcaaaggcaggaaggtagatggtgagcacatgcagcctgcttgcagggagggtcaggataaaaactcctagcagtgctctcaaagaagtaaaatgttgcagagggctgcggaaaccctgagagtttgttgtgaaacactgctctgcttcaaagagcccttttctaccattctgcggaagcctccatgataaaataaaacaccagatagctgatttgtcctgtatcataagagtcataaaaggttcatatctaagttgtttatgaaaagttaatgactagtcaattctgggaccgacatatttctagtctaagctgtttcctgtgtcaaaacttaagtctggaggaaaatctgtttagcttggagtctcagtggtgagatggcatcctgaaatggtacagccatttcaaagggaaaagggtggcagggcttggaaactcctcagcgtcccagttggtgggtcccagggcagacaccatccgagagggcaaaaaccagagctgcttgcagggagcctggcgctgtggacctgctggcattttccctccaaactgccttcctgagccttcacatccacagccccttctcatgatggcccttgaagctggcctcaggctctggcaggccctgccctcatcaccacctgtgtggtggtgtttagtcatcagcaccaccacattcctcaggttgagatgggccctgggctctgagggctgtcccaaggccactgttcccagatatcaacctcaggttgatacccattaataccaacatacggtcttcaagaggttaccgtgtgccgggaacttacacgtcaccttgtatgtatttaatcctcaggaaaaaaaaaaccctgaaaaccccaatccagaaaacaaaacaaaagcccagttccccaggggctgagacactaggctctccttgcagattcattcagagtggggtcttctctcaccacctccatcgctcctgctctggccagctgccaccttcctgggtgatgccagggaccccggcttccggcccacagactctgccctgagccagccacatcacgcccctcatactcagagccttgtttgctgggggccagcccctctcagaccctactgcctcgcacactccccttgctgttgctctagtgtgccaggcatgctcccctcctcccaggctgtctgtctgtctccctctcctgcaagtctgctccaaccttgtctggcagccccatttctggagcctaacctcttccccacaccctgcttggcgcctcctgtggacgcactgctgtgccgcctgctgctttctgtacttaccttgtttgctgtctgtcttcccctgcagaatgtgagctctgcagaggagggcagggaggcttgtgccctgtgtgcctgtcacagtcctggtgcacagtgggccctcaaaaaatagctgtcgaggggactgtacagggcaccgagctaggctttctgaggggattctttcagtttgacagccgaggtgcccacctgccttcctgtccactcaaatattacccagccacacaggctcaaaatgaggcagctggcgggaggagcagagcactggtctcaagtctcgtccccacttccccacttgtccccttctccgtcctgcagccctcgggagaactcgaggctcttttgcactcctcaggctggggcacgctggaattgaccaaagctcagagcagcaggaagagatggaaaagcccatcgcgcatggattcccacccgctactgatgacttgtgctgtgcctccaacacagtcatttaacctcactgtctgtttctttcctgcttaccaagtacacatccctgctccccaggagcagagacttaactcttgggcaatcactcaggtgctgaggggtgtgtgtgtcagcccttggaggacttgaggggctcctgggtgtgttatggctcttccgtgagaacctaagcattacctgtctgtggcttcagctcggaggagaagctgactctgtaataagtaaaataacgtctctgggtgaaaatgataggcatcatataattacagaacaaagcgcatattgttttctggatatgaatactggctacagaaatcaaatttacctcattggatgtgagaagagaaaattactttaacaattgatttataagaagctacataaaactaagcctgcaatccttcctctcctgaatgttctttgagatgcatctgaatactgctatcaacgcttgattgcatctctgtacttgtctctttatggatggcttttttttttttttgctctgatgcatagaactgtattagcaaaatcaaggttccttacagaaataaacagatgtcagattagaccattctttgtattgatgcatatctgttttctgggaaagagacaattttaaagacatggttctcaccttttaaaaagcgattttctaagtatctgcccttaataaagaacacaattaaatgagacttaagtattaaacaatagttaagcagagatgagatgggggatgttgtcatagtgatccatgggagtcaggtatatatggaaatgagtcatcaatactgaatatttagagactaaatgttcaacgcaaggactccagagtaatattagagtttaggttaatgatactgtcaatgttacaagttcagactcagttgagaaacaattattcagagcttttccgacattgccctcctcaggagcacccctggttctctttgtgggaggagggagcaaagggggggtctctcccccaacaatccttcaattctggcccccagaatgccactaactgtagcatctcacctgcacagtcaaatgcagcaaacttaaacacagagtgacatgtggtgcctcggtgatggccattcctcgaacacgtctagacttccctggcccttatccagaccaagccaggaccacatgcacatgtgggtgagcacacacaggcatccacatggacacatgcagtacatgcgagtgtgcacatgtgggtgagcacacacaggcatccacatggacacatgcagtacatgcgagtgtgcacacatgggggagggagcgcacccaaacatctacatggacacgtggtacacatgatgatgtacacgcatgagtgcacacacgtaccaacatactggctccctagtgctgaccttcccgaccaacactgaggttacggcgacattcacttcattctagtccctcatagtgagagatgacagcatgctggcagccctcgcagcccttgctcgctctcggagcctcctcggccttggttcccactctggccatgcttgaggagcccttcagcctgccgctgcactgtgggagcccctttctgggctggccaaggcgggaactggctccctcagcttgccgggaggtgtggagaggcgcgggcgggaaccggggctgtgcgaggggcttgtgggccagcgtgagtttcgggtgggcatgggctcggcgggccccgcactcggagtggctgccagccggcaagccccgggcagtgaggggcttagcacctgggccagcagctgctgcgctggatttcttgccgggccttagctgcctccctgcggggcaaggctcaggatctgcagcccgccatgcctgagcctcccccacccccacccccctccctgccaacgtgggctcctgcgcagcctgagcctcccagaagagcactgctccctgctccagggcgcccagtcccatcaaccacccaagggctgaggagtgcgggcgcacggcacgggactggcaggcagctccacctgcagacctggtgcaggatccactgggtgaagccagctgggctcctgagtctggtggggacttggagaacctttatgtctagctaagggattgtaaatacaccaatcagcactctgtctctagctcaaggtttgtcaacacacgaatcagcaccctgtgtctagctcatggtttgtgaatgcaccattcggcactctgtatctagttattctggtggggacttggagaacctttatgtctagctaagggattgtaaatacaccaatcagcactctgtatctagctcaaggtttgtaaacccaccaatcagcaccctgtgtctagctcagggtttgtgaatgcaccaatcggcactctgtatctagatactctggtggggacttggagaaactttgtgtggacactctgtatctagctaatctagtggggaccgtggagaacttttgtgtctagctcagggattataaacgcaccaatcagcaccctgtcaaaacggaccaatcagctctctgtaaaacagaccaatcggctctctgtaaaatggaccaatcagcaggatgtgggtggggccagataagagaataaaagcagacctccggagtcagaagtggcaacacgctgggattcctttccacgcagtggaagctttgttcttttgctctttgcaataaatgctgctgctcactctttaggtttacactgactttatcagctgcaacactcaccctgaaggtctgcagctgcacttctgaagccagcgagaccacgaacccaccagaaggaagaaactccaaacgcatccgagcatcagaaggaacaaactctggacacgctgcctttaagaactgtgacactcactgcgagggtccgcggcttcattcttgaagtcagtgagaccaagaacccaccaattccggacataatagacggacttgccatcctgcaaagacctgaggaaccatcctttttctcagagtcctctcaagaaaaagaagtctctgcaacttggagcaatctctaagtagctgtctgagccccctggaagagggctgttgtgggcagctgcattcagtgtgagcaacctggagtgggcctgtcctcctgctcgttcccaggttcaggcctggaagagggagttggaggcatgagagaagccactgtggggagagcacctggttcttccaaggctcggggcatgtgtggtccctggctgacttgggtgtcctctggtgtgtgcggtcagtcttcttctgactgtggatgccaaaggggaggcccttatctcttagcgcatgactcatctcttcgcgcatgactcatctctttgtgcatgactgtattattctcagcgtgtcatgtggttcctgtgcataactgagctcaatgaatatttgctgatttcagggagtgtgttagcctaggatgctacctcctgggaagccctgagaggaaggatagttaagaattcatattacccagggaggtctggccttgccctctttggctacagggaggcaatctctaggctctggaatgtcatgcctcataggggtctctttatttgcctggggtctttgggccaggtggtaccagttctgtctctagaggggctggggacgagagggcagccatgtgggcagtatttgaatgagctccagcaaaagctttggacaccgaggcctgggtgagcttctctgggaaattgacactgtgacagtgacatgtctgtgactccactgggagaggagaacagagattccacgtttagagccctcctgggctctgccctttgggcttcatcacttggctgactttaatctgtactctttttgctgtattaaactttaactgtgagtataacacttacaatgagttctgtttttccagcaaattgttgaacctgagggtggttttgggaaccacctgacttccagtttatgtcagaagtgagggtgtcttctgtcgaagagccaacttcagttggctcaaaaactcaaatagggaagttctgacctagtggtatgcgtgttgaaattgcgtatagggacaaacctgattatctgggtatacacagaggcccaggcacctgcaacagaaggctcatgccagagacattgctctgagccctccacttgtccacccttagaggccagcaggcaaatacctcttgacatgccaggactccagagtgttatgtagtaggggtggcagctaatggggccctctggtgaggtgcaggcctgagcccttgaatggggctttggctccttggctaattagcttggcatccccagctggggcgggaagggactcaggttctagactgcactgtagcagtcatctgaagttccagaccacctcacacctgctgctttcctttgggaaacctgcaaccctcttcctggggatccttggatcctgaatccccaggctgagaaggccttaccaagggtttcagctcctgactctaacttggaccacactcacagccatgacagctgattcctgtcgttgagacactccagagaggatttaaataaatttccttctatggctcatttcagggaccaagacgactttcagttaggaatttcctcctgacactgtgttcaaaactcttacacattgttggagagggcgtagactggtgcagccattttggagagagatttggcaaaacccatcaaaactgaaaatgcatcacttccgagaacttatcttacacgtcaacttacacacatgtgcaaagaggtgggtataaggatgtttactgcagtcttgtttgctgtagacaaaacctgaaacagctgcatggggctggggagggggagtccaggaagagcagtgcttgggcatggctcatgggctgcaggacctcctggtgactcccttgtccttgcttagtgcagagagtgccttggaggggtaggctccaatctgtagtggccaagagaggcaccaatcggcctccttcattgactgggcctctgtagggaggcagtgaggctcagggaggaagagactctgtggggagttcctgggttctgcaatcagggtatagaagctgaatcagaaccttcctgtgggaccctgtaccttggagatggggccggaagtggtcactgagtacaagtcaagccctgaggccagggcttcccctaaggctttcccctaagaggggaaagaggacctcgaaagaggcactgagaaagcaaaggccagaggagacacttggcagggcagagtcaccccacaggttccacaggctggagtaccataggccccggcccccatatcttggagatctctggacactactcccaatggtttgagcacattcaaaactctaaagaactggatgttcagatgtttttgacacaagctacagagaattggccaaagcctttaagtgcttcaaatgtagtgttttctaagattttaaaacaaaatgtacccaagcatttaatgagattattttaatgcagagcctacaaccactgtctatcgtggtgcaaacagctctccatgctaatcaaacgcctctcatctttttacaatgaattcatgactggttcatataaagacaataaaaattaaatgagtcatgagctcctaaatcattttcttttggtctttttaataactcccttccaaagaagagctagctgagagcatacgcttcattagaattatttgttcctggttttataccatttaggtatggggagaaaagtgaacattttaacacatccttcaaacactgccacaaatactttcttctaatgggttttgttttttgcttttatcaccgtactctgcctgccgacattagaaagccccaaatagcgagattcagtgaaaaaaaaacccaaaacaaaaaagagtggctctttcaagtcatttgaaatatactgagtttgttgtaggcctttttgttttttctgtttttttaaaaaagaatacaatagaaaaatgttttctctccctgagaatatcctggctaaacaattccacgtgctggtctcagagcatgttgcttccttccttgctggggccagaggccagcagccagtaagaataggagctccacacacagggacccatatccaatttgatacattccactggggcctgggaactacagacagccccacagcaaagatttggaattgctgggggctagatattatgtcccacaagcaagaaacccagagagctctgggccagggcatgtaggtggctgtaggcccatgggcaagttctccactcatctgaatgagttaaccccacgtgcctcatggggcaggggtatgggatgagctgatgcttatgacctcacaaccggcacggagcctgcaccgtgtatgaatggtaacaacactggcaacaacacttgtgatggttcaacccaacagccattacctgtgacttttgagatgccctgtccctgtttctgcccgttcctgtctcctggccctcaggatcataaaggacagtgaggaagacagttatgagatgaagggtgggtgacattgttgaggcaggatgtgccgactaggtttggggacagtcacttcaccctccgagtggccgctgtgcaggctgggtggtcagagaagcagagggctgaggcccagaatgggtttgcatgttctgtttctgcagaaagtgaggcagcaccccatccttcccaaccccaatacctagaatgggggccagagtagggagggaatgtgtggatctgcttctgagatgggtctcaccccagcccccaaagcctggacctgagtccccaggagacaggggctacaggggaatctcaccagggaatggccccttgtgggggccccacagcaggggctgggggcaaagtctccccttctaccagacacaagcacaggcacactcctgggggccgcctggcccaggcccaggtcatgccgagcacagggtgctgctggtggccacgcctctgcttagcttctgaggtgggggcagtgggctgtgcctcctcaaggactgaggtgagtggggacacagggccaggtcagaagcacatccagacacacagctgcttcagtaacgaaacccacagtcagccaggaagtaaacaaattacaggctgcactttgttagctctggggaacatgaacgtgagcagacactactgatttctcatcaaacaaacagaaggcggcgtcataatccagagacccactgccaggaggggctgcagcatgtgccctgggctgctgatctgctggggtgcacctgtctttgggggccttacaccattcgtccataattctagcctctgctcagtggtggatttgttttccctcttacaagctgggctgggtaaggctaaagcctcctgcaaggcagtggctcaggtgtccttaggagacataccaggtccaggcccaggctgaacttcctgacaaccttaagaaggcaaaggccaggtacggtggctcacacctgtagtcccagcactttgggaggtcgaggcaggaggatcacttgagctcaggagtttgaggccagcctgggcaacatagcaacacccctctctacaaaaaaataaaaaaattagccaggcatggtggtgcatgcctgtggtcccagctactctggaggctgtgatgggaggatcgcttgagctctggaggtcgaggctgcagtgagccaagatcatgccactgtgctccagtctgggtgacagagagagaccctactgcctaaaaaaaaaaaaaaaaaaaaggcaaagtgaagacatcatgaactgaaccactgccccatcaggggagccttgggtggaagccagggagaccctggggcactgctgcactccagatgtgccattggggaagttagagaggaggaagactcagaaaacatcaacaaggctcccctcacttctggaccctctgttatgtgaactccctcttggatgcatgtttaatcttaggctggaaaaggcgctccagactcttgcagcacacacatctgaccctgtcactcccccatcaaacatctgcgcttccccactgcccacagggcaattgctaagactcttaatgttaatattcaaggacctttatgttctagccccagtctgtccctatacacttctttctcactcgcttattcctgtctcctgaagccccagtcagaagggctcctttctcttgcccccagaacagttgttagtggttacttcgcctccctggaggctgcggacagtgtctttgttctctactctggtacggagcttgtgactctcaggcacttagcaagtgagtcaacccaaatgatgactccccatgtacgccacctggatgggccacacacgattgggtgactcataagtgcttctgagagcaacattactcgctgcaaaatctgactggctccttcttacttggctccaggcgagaggggtacatttactttctgatcaaatattattctgatgctcagggcatgcttgatgtttgcaagtcagaaaagtttaattacatgtgtcattagaatggcattctgtaatagctctgtgactgaattcattaatagaattcttaacagataagacaaattaatattttgttgctcacgaaagcttctcattaagagagtagtgaaaaagtggttaatattttgttgccaatcaagatgtctcatacaaacgacaaagaaaggaggcccacgctccttcgtgctctgtgatctccccgccttgggttttgaaggccgatcagcttgcccccgtgcagccgtgtttgggagtcaccactgattacaatgccggtgatcgtatttcatctcccactgccgtggggtgaacgtggccactgagacacctcaggctgagggactctgggagcctcatcaaccccagaatctttgctgcatcagtgttgcactcctgggctgttctcccctaattcttgcttcaaaaatgcaagtgaatcccgatgacctggctttagcccccttcagcctgatttcttctaaggtttgctttccacaccgtcccaagtgggcctactgcttatgagcacctcttgtgtgccaggcactgagctgggtccttggtacacttcagcctgaaaatgcccatgtaaggagcacatcatgctttttctccacaggctcagagaagtccaacagctcacccgaagctgctctggatttgctggaggcagagaagcagtgcctccctccctgcgtgagtcaaggctgacgtggacagtgagacctccgtccccactgcgagcagcggggggcatgccaaggtcctatctgcctgactagggagcctcacccagctgttgctggctgcttggtggggactcaggctgcaagctgctgagaatattatttagcagcagcaggaataataatacaataataatattaatgatagtaacaatagtaatgatgacagtgataatagcatttatagaacaccatacgtgaagagccttacatgcatattgtcatttagtccttactggaaccctatgaggctggtaccattatttatccccatttcacagaagggaaaactggagcttagagcagtcaaggttactagactagtaactttccaaggttctagttagtaagtggcagaccccaggctcatgcccttccctaggaagctgtgccgcctccttccctcaggtaggggaggtgtgcgtgtgttttgtgtgtttgtacacatcgggcttggacccctgcggggctggtgctgccctgctccctcgtgtagggggttctgagaagcactgggccctgcctatttgcgggctactgactcaaccacgagcagcaagtgtttcctgggagataatgaggggccattcatctctggttgcacccacaattacccaaattgctaaccttattgtgaaaagtagaaatgcaattgagttggtgctggaggcatgtttgagggagaggaagaccactcaaagtaatttaattaactgatggcaagtacattaagtggagttttgcctctgcttttatttctgatgtctttcagtggagcgccaagtaatgcacatgaaatgctcccacagacacaggtggagctgtcccagtactgatcaatctttcctggccaaacatgtttaaaagctggcactgcaccttgtgagcaggtacagtagaggacatcacactcacaaacatgcaccccaacacagtccagtctttacagataggacactgctctttcttgctaagttctcagacaagccctggccatcgcaggcccagaaaatgaagggttctgcccatccagcatctgtccagcaagcacccaccaggattgtgctgcattgacattcaaaattgtataggatactggctatgttcaccatggtgggaaatcacaagaaaacaatcctgtccagtgtgacaaggctaggggaagggcactccttggcagctctgcccagggtagaacctccagagtggccccctctttccatctgcttcccccatgacccccagggtgtagctgaaggggcctagagagtaggagaggactaactttggtggttcctgcagcatttcatgctgggtctctctccccacaagtctcagagttggaagggacctccaaggtcactgggtttagctgccctcttgtggctagcagcattgctgaccacagtccctgcctgagcttgcatatgccccttgggataaggagctcagcgcctcctgtggcggctctgtctccatggtggggcaggtttgatggctggaatggggttccatctaaggagcccaaattgatctccttttgaggtgcaccttgtgctagtccaactcagggggtcacacagcccaggtcagctccctttgccccagcccctaccccaccaccttcgagatgttagcaggaactgaccattcatcccatgggtctttcttttctgggcaagcatcccactgtggaccagctgtcctgtcctgagccaacaaggctaaggctgccctctcttctgcatgaaaattatattccagttactgtaacctaagacccgtcagctgtcctggcagctcactacatgggtgacatcactctgtcttctcacatgaacttctgggaagccacatcacctcttgtgccaaacctggaccaataaatatccttgaattatgccacttctttaagtctaatagaagggaagtattgctaacgtttttcttatagattaattcattgaggatcggcaggttaagaaattactcaaagtcacaaagctgacgtgggtgatgctgggaccccaacggaggctgcctggttcctcagggcacagacgtaccccctgatggccacactaggctgcatgagctcagttgctttcttcttccacacagcaccacttaactcatcacaccctcattcccttacccagcaatgaacgtccccaaggtgggtcccctctggcctgacctggtttccctctaccttctcatctggcacctggcatttgtcttccagccaacccagcccagtggctcacctctgccctccacagggaccaccccttccctgcacacagctgtctacagcctacccagcactagggcccagaacctcctcctaaggtcccccagcccactgttctctcagctgtggagcctgctgctctctctgctggcctgtggtccatctctctgagccctgtgagcaggcccacacagtctgttctcagggtcacctccaggcctttgctaatgcagccccgttcagaggcctcctgtcccacccatcgcatctctcttctcttccttagccggacatagcatggccaccattcatctattttctgctgtggtgggacttggattttctgatactgccaagctgacaacaggctagaaaagcaccaaacacaggatgttaaactaaaactctcccgtcctgccactgtctgtggcatcttacccagtgtactctcccagggaggtgcgcttgagctcagagtgaattccaggtgacttacattgatgtcttccaagtccaggaagttcagggtgagcccgttgcgcttccagatgattggtggcctcaggtctccatggacggcgcaggtcagcactgtgctcagccccacggtcactgtggtcacactgaccctgtcctcgggggcgaggctgagctgaaccacttctgcagagggaaaggaggaggcacggtcaggtgcaggcccagggattggagtctcaactcaaggtgaatagccatgaatttcctgggtggaagaggcccagaagggcttcacgactccctgaaaattgtttacaatgtgctgactaaatgtagagatagacacttttgctgggcgaggagccaagacttaggtcaaatgcccaaaaggctatgtgagtccaaacaggtcaaaaaccataagtaatgtgctgaggacaatctgggccatagatttgtgtcaagccaagaatgtgggctgcgaaggccagggggcccaccacagagagaccggggggcaggggtgcagcgccctgctcacagctcccctggcctattggagtctgggccttgctaagtgcagacaaggtctgctgagtgagctaacaagtttctcatccatctggggtcagttttaaaggttgcgctgtctgaagtctggggaatgaactggctgatctttgaaggtttgtttctgtctaaggattcgctgaacttggatttggatttctgtcctatgaaaatgcactgtagcttttaattttttgaagaatacttcaggctgcagaaactattaatccttgccattttgaacttgataactggcattaggactgatcattcttcaggcaaatgggaagaatctaagatagttctctgcaatcacaagctttttgaaattctcaggatttatgaaaaaattaatcaaactcaggctgctcaaatgaccaaatgggatcaggctttgggggacagtcagcggcccactgatgggactggctcccttttgctcttcccccaaatctgtgcactcagggaggctggggcaatagccagaggtggcatgagctgagggaagcaggctggctctcggtgcagtgggtactattttgtctattccctattcatgcttacgactctattgggacctgggggaccccaacagatgtatccccctgaactggaacgaagcagagttgggagctgagctctgctattctgcgggacgcttgtgagctgtgaccaggcagcagcagccccgcaggcagcacatctgtgctcacaccctcttgcccgtgtgtgtgggagaggggaagagggagcgaaaacagccgcaggtgcaaggcacagcagagcagctgaattgaaacagggtcctgaggtcagaccctgagcagcaaagccctccttcttccacagatgctgagtggctccgccctgggctcacaaagatgaacaagctacgctaggtgcttcatcagtgctgttggatggatggatgagaaatggagaaaatgaaataaagaagtaaaagagccaataggccggtggggaggggacaatcacacacaggaaaaatgtgactaacggtgaaggaaccctcaaggaaagatgagcacccagtgatggatgcagacgcaactggcataatattttaccaacaataaagtgatgcatttcaagttcccccttaaatcaagttctgctcactaccctcccatctccgagtcatgaggcttattgcccagggcaggagagagaaggcactaactctgtagcatgacccggcctttggagaggggaaagagagagaatgagaatttgctaaaatggtttagctcccaccgtactctgcgggtctgtaggactcagacctcagcattctccccaagagtagaggaggcatcctttcctcatcagatgaccacgaggctcccctgggccacgaggctttgtgccgctgctcctgccacctggggcaaccgcatgtgtctgggcagagagccagaaccaccttggctcctggtatggaaacaggcccaattttcccagataactgaagcttgagaaacttaaatttgtttcatctgagttcttttaacaggaaaccaaacaccaggcctcctagatcactgcatccggacaatgagacacacctgctgcctattgaccatctcctgtcttacccctccctaattccctgctatctaaaccccgaactttagtcagagagatggatttgcaaccggtctcccatttccaggctgatgtcattgagattaaagcctttcttccctggcaatattccatccactcagtgatggactttctgtgaggtgaacaaccagacctagaccgaacccctggtgttcagcaacataatatctggacctgagaactgccttgggctgccagaccaaggtccaaagggaagtgctcctggcctcaaggggcatggaggccagtggtggctgtgggaggccttgcttgggggaatatcctgacccgcgagtacaccagactgtgagcccagatcatgagcacacccagggctgagctcagcttcaagtgacctcagacagggcaactcagagtcccttgccgtgggaagtgaggccgcagtgcaccaccacgctgcttccctggacactcagaagccagccggggagagcagctgggacgtggggtggaagctagagacacagagcagtttttagacagagcactacttacgtggactgttaaaatcgtcagctcgtgctaatctttacaatggattgagcatttagttgtgcttttctcccattggggtgaggcttgtaaagtcaggttagttacaaaaggaatcagattttccctgcacgtctgatctgtggtcagactagaaggaaaagaccaattgggccatcggggaggggctcttggaggcagcagcagggcttcccctgggccctagagatccgcttctcaggtgcggctccccagccacctgtatcatatctctgggggtgggtaattaaaacacagattcttgcccctctgcctcaggctgatgcagatgctctggtgggctggatggacatccagattttaacaagtgggctgggtggacatccagattttaacaagcatcccaaggggttctatgatggcctgagaaccactgtgttacaagatgagaagggctctgggtacatagagagggggaatgcaggtgggagacagggagacgaggcaggtctggtaggctggggtttcctggggctctagatacaaggctaggagcatggcccctcatttggaacataggactgatgtgaaaggtaggatcccttcctccatgtggccccaaagtcatatattccaagcggctctagagaaaggtctgcaggagcctcaaacatggggctaataggaaacaaaaatccaagtgggagacggaagtcttctgtgtccctccggtcctctgctggctgggataactggctgctgcatcctccctgagttattcccagccatttgcatgtagaagatgtgcactttgcgcaggaaaaactcgtgcaaaattagaatgtgtgaatactgatagaaccatcgtagttctgctcctgtcagctacatgaatattaaccaaacagcaaatatttggatcacttaaaatttaattaaatgaatgttttattggatttaatttgtgtcaatattccccagctcctttcacagttctgaagggatttatggctactgagccctctccttccaccctcactccccgttatttcctggtcaacaagcctccccctggcgggtcctccttccttgctaaatggaaagagtaggactaagtggcttcccagggtgacttccagggagagtaaaaaatgagacagcatcatgtgctaggccccgagtgagcagggcaggccacctggcccccaggcctggctctgctgctgacaagctcagtggccttggcagctcccttcctgtcactgggcctcagtttagacatggatacaatgagggcttgggcccccctcgcttttgactcggagccgattattctatgttcatgcccctggagaccccctgagtcttgcaagtgctcccactgcatcttttcttgcccctaagtgtcatctgcccctgttctttgcccacttacccatgatggtaaaagtgacgcctcaagtggcagcaccaatgggtgccaagtcccactaaggcttccctcccgataccctttgaggactcccctgccccatcccaggccccctatagcctccttcatggtcacccctccagtttgcccctgctgcctgcaactgtcttgttgccactggcagaacaaggtacatctcagccctgctcaacagctgtcaatggctccctattacccacagatcaccacatagaatccagaagagtccccagtcttgaccctgctgtgtctccaacattatttaccactgtgccagctggctccccatggcatttgtgtcttcagacctcagcgtgggcctgcttggcacctgctgctcatccattctgagctcctcacactattggcccctacctccaagatgacctcatgggatgtttctgggaccctgaagttttaatgtaaagaaacacttggacagatattaggtgaagaagattgaaagagactgtcctggtgaatttatcagaactttttcaggcttagtaacagaaacactcagaaatgctcaactattaatagcttagggggaaaaaggtggtttagttcccacaatgggaaatctaagggaggtggaagaggttgcaggcatccagggccttcgacagtggcattctctacttggttgcaagatgtccattggtggccccacactcacattgtttctgtatgtgggatcccagaggaagggaacaaatcttgcctgagagccctggaaaaagcatgggggagctctgattggccacatacagctcctgtgttcttccctgaagcaaacactgagggcaagaggactgagtattgtgcaggtgtgggactgattggcccatcaggcctgggccgtgtggccacctccaggggcagggactaggtgtttgggctggggtaaaatggctaatggaaagggtatattgggcagattgacaccctatgaccatcatagggatgcagagagggccccctcccttccccctatctgcatcacaactgcatcgggaagcctgggcatcgtgcgtgatcagggcagatagccgcagtcatacagtgaagacggtaagaatcgtcagaactgaaacctgatttaggctactacagtcttgcctccaccctgcgccttctctggagagtgatgggggcagctttcacagggaggagatgtggcccaactaagcaaaccccatcatcctgttgagcctcacatcctgatggcgagggtctggaatttgtggagatggccttctgtgttcagtgatcacacatctcctgaacctcacctgcgctggccacatctgcagggctgtggaccagttaagccccaggcctggtctctgctctggtggggagccaggccacatgagaggaagatgaagatgccacatgcagccctctagggggcaacgagtggtccttctggctcctggctgtggctccaatgcccctgtgttgactgaccatctgtgggctcattagccactatgtgggaaggtttccaaggtccctggacgaccaaacgtgatatgcccagcactcagagtgtgatcaggggtcagtgagagagggctcagccagacgctgtgtctggggtgagaatgtgtctacacactgaggctggtgtctttggaaagagagggctgggttgggggtcagagcagcccatcagggagcttgtctggcactactgggcagaagtctgtgcccacagagggactgacgccctgctatgagaactgacattggagagctgctctgcaagtagggaatctgaggagggcaagggagttggggggttctcaaagctcagggcttcccatgatatccccctgggatgaaaacaaatgggtcacactgcagtgatggcccaagtcagtgtgggttggttggcacaagacagagcttcctggaccactagctaggctgcgtgtcccacagtgggattctgggcagggctgtctggcactctggtgcctagcacaaggcatggcacacagtaggtgggctcaaggccatgacctatctctctaggcccttcaaaccagtgcagtagcatacccttggttttccagacatgagatgccacaaacacccgtcctcacctttctccctgagtcttggagcttggagagaagaggcagtcacagggaattaatgggcttaccataagcaggctaacaaacacccttcctgaaagcaggaggccataacatttcagttgttggagaactgggttttagttcctattacaggtttcccttaatctcaggcgctatttctcacactgacttgaactcgataagacactcataaacccatcagcaccctctcaaacaggattctggtgctttgtagtgatagaaattaaatttctcaaattcttgtcaagctggtgttagttttcttatgtcagaaacacactaatggaacacattcctacttggatatttgccatttttcaaatgatgccattggtgaaaaaaaccctgtcaaaagctcagtaacctgcctgcacatcaatatttttgactgagcctcggagggcaaactcaggctcaggggcctgcttgggaatgagggcaatttggagagagcacaggccaggcgcttagacacatctctctaactgcggcctcttcccacattattctccttctaaattaatgtgctttcctgaaacaaacccctcaggtgacctaggtgccaccaaagaagctggggcattggagtgacaaagtctattgatctggtcccatccctgtgaccagagtcacactgtgaagttggcgagtaggggaggagccaagggggagtgcgcatgcccagtgtctcctgaacaaacagggcaacatctcccggaccttgtgactttggctggtgtttacagagtgaagctgctttggcgtatcctggtgagccgggcaaggcgggtgggagggatggtgtgctttttgtctcctctgttccgtctaccagagattgtcactctgggatcctttcaaataactgctgaatgtttgtggatgggaggctggggacaggatgtcttaaagcctttcatcttgacattcctgtttagagcaccagggtgcatccagcctgcacaggtggctctgtattagccagacttgctccaaagccacacaagagagcacttgcatctgtcccaaatctcctgtttccttacgtgtaaccagattcaatcttcctgccattgtcattccctcttgcttgcttcattttggggatggcaataaaattactagttaattacctgcgggtcagtgggtaatttactttttcaactggcctatgttgcttgatgttgcttcaacttttattacagtttagttatcaagttctgctctctggtgtgaacaaacacctttgtaagctgcataaaggcagagactatatctgttttatttatgttgtatccccagcacctaatacaatgcctaccacgcagaagggacttaataagcagttttaagcaagtgaactattaggctagtgctcagtcaacaattatttatggagctggtaccaggagccaggatacagtgggaatatactggcaagaaaaacaggcccagtgcttgctaacctggagctcatggcttagcagagaagacaagtgttaagtggggagggagagcagaggcctgaacctgtctacagaccccaggttaagggcccgtgactcctgtaaagcctggttgccctctttcttggtagagccctccctgtgtgcctggcagacctgtgtcctgctatcgagacatcctagtctgatgtagtatcctccttgtttgcaggaggggccggcctgtgcaggggcagggttacctgggcatccctctaggctctggggttccatttagcctcctctggccaatacacctttttagttttgagaaaactaaacctcaatgtgactgctgtgtgcagacgaacaggaagttagagcagaactcagtgcccaggggctgtgagatcaccattctgggtatcatggggtgccacagtgtggcaggcaggagaggcatccatcagaaggagcaaagggtccttgctgaggtggagagcacagggcctcctggtcagcaggagcatggctgtcacagtgctgcataccagctcttccacctccgctggttcctgtgtgtggggtagccttggtcagcttggccactctatgggtctctcccaccctactgagtctacacccaaagatgatgggcatacctctgctcaagatatttgcaaaaggagagtatcctaactgcctattactttggtgtcttaagggggaaaagaatgtattaccttatgtaattatacagagctactcagaatttacaaaaattcatacagatctctaaggttggatccagaatctcctgagcaagtcagtggagaagagcaaacagtttttacctaactagcaagagggggccatgctgtgtgtttccaaatgccagctcatcttccaattcctgtgcactcattatgactatttcgtggcctctcttggagccagaatggggccatgtcattgggtttgacatggtaggtgataggaggtgaccaagcctggccacacaacctctgtgtcattgtcttggttagttttatgtgttaccttgactgggccacaaggcacccagatatttgttcgagcattatcctgggtgtgtctgtgagggtgtttctggatgagattgacatttgaatcagtagactgagtagagaagattgccctccccaatgagggcaggcctcatccaattcgttgaagacctagatagaaaaaatgagcctgggtaagagggaaaccctcctgtctcactgctgagctgtgacattggtctttttcctgctttcagactgaaactgaaacactggcttcaacagaagccaatgttttattggttccgtagaagacatatacatcttctgttggttttatttttctggaggataacacagtcatcatccatgctctcctctcctcgtctttggaggtcatgcatttgatgagagtgaagaacatggtctagtcactgtttagggagagctgcctgaccccatcggacttgatgaggatgggaaaccagcctttactatactacactactgagattttgggatttctatagcagctggtgttaattacataacacaccccctcagaagggaaagaaataccagttaacgtatttccactgaagaagtcataaggaaatgggaaacagtcttttgacaggccaagtcatccaggtcaggaaccttctgagaatgttctaacaagagtaggtccaactttggctccaatccccagaataccttctgtacagggagctcactccttcactccacatctgtatctgttgctacagcgtccaaactgctggactgagggagcaagggctgggggtggggggtgtctcagaataggctggcagagaacatgcaaacaaattacacagtacaataagcattacggatagaaagaacaagatgagagaataccaagagagtagcaggggagggctattaaggtgtgtgtgtggggggtgggtgctggtgtggcggaaagcctctttgagtagagaatatttaagtgaagatctttaaaatgagaagaagccagccaggccaagaatgggagcaaggacattctagttagagaaaacagcccatacaaaggtcttgaggcagggtgggggcttggagtgctctgggagctgaaatagaccagtgcagctgaagcacatggcacaaggcaagggcatgtggcacagatgcggtcagaggcaggaaatagctagttagagcaggcagagcaaggtaaggactgatggctgtaatttaaggagatgaaaagtgatcagaaggatttttttttcttttttttttttttttttgaggaggagtctcgctctgtcacccaggctggagtgcgcggcacgatcttggctcatgatcagaaggattttaagtcaatcagggatgtgacatgatttgcatgctaaagggtcactccggctgttgtgcaaataacggactggtgggagagagggaaaaaatgcagggggaccatttaggaggccaaggcagtagttcaggagagagacaggtggtgactgtggagatgaagaggaagggacagggctgggaaatagtttggatggggtggggataaaagaggtgtcaggaatgactcccgtgttcctgacttgatcctcttgcataatacggtgtgatttcctgtggtgaagcaggctgggaggggaggtccagggaccccacacaacattgaggtcccatctttgtcttgatgataaccccctaaccctcccaaggcatttgatttgaaatgtaatttgggatcactttcttggcctcctccagtgaaagagatttgaagatgatttctaaactgtggcattcttgttactaaaaaccctcctccaaggaagcagaatagatgcaagtctttatcatctgggtccccgtcgtcccaagtttcctggggttggactgtgtccggcgggccgctcgagcagccgaaggcagacacagagcctcccctactgcatcccttcaccatttccaccccacagcacaggctgtgccctctccaaatgggggactgtgcttcacatgcagggaggggagaagccactgggtcctgaaagaacatgaataaatataacttgttttctgtttaattatccagtctcctgagaatgctctgtcatggctgtgttttgtaaacaggcatctgcagaccattttgaacggtttacatcagtgtatttgtttttgattccaatttcctgagcgtgccacagtggctgatgaactcctgatgaggggttcctgtgccagccgtcagctctgctgctcccagggaccacagagctcctgctgccttctttttgtagaggaaacattgctcacagcctcccggcccctctctaagcacggctcccagggacctccgccctccacctcctggtccaggggaagccatgatcagactctgtttcccactatgagagactcctggtatcctgttttcagggctcacctgagaagctcttacagcttgtttgctgaatatttagtaacatggcagggagctcagctgagcccaattgttggaagggcaggggcactggcccctgatggcctgatttggactttggcagaggggttcaggagtggggtttggaagagcctcatccctctccaactggtgacactgtgggcacgagcagaaagtggaaacgtggagtaaggaagccctctgggggcagtggtaagaaaggaggctggagatgttgggaggagggctggcggggcctgtggtctggtaaggagtctatgtttgattttctaagaagctgttgtaggattctaggcaggagactaaaatggtctgatttacacctttaaagaccatctgtgtattggttgagatggtcttcagctgcattaacagaaaatcctgactggaaatggggctggctaattcggaaattctatctccatcacgagaaggccccactgcatgtttcctgggcaggttaattccatggttcccgaatgtcaccaaagcctcaagctctcttttctgcagtcctcagaacgctgtcttgatgcccgtcggggttactgggaagcctacaaacaggtggaggcatcacacgtaggtacatatccggtggaaaggatgtgagttttaagaactataaactaaaaataaaatcctaagacatcccccaaatggatggacccccctcttagccgagaagaccccagaaaactcttaaaaactgacttcccagccatgatgggataaaaggttggacacgccttgttatatccactccgttttgcagtttagacacaacaatggaccagcattcatgttaaaacagagctcatgagagtgacaggccaggcgcggtgctcacgcctggaatcccagcactttgggaggctgaggtgggtggatcattgaggtcaggagtttgagaccagcctggccaacatggtgaaactccgtctctactaaaaatacaaaaattagctggatgtggtggcacacacctgtaatcctagcactttgggaggctgaggcaggcggatcacttgagctcaggagttcaaggcctgcctggacaacatggcgaaactccatctctacaaaaaatacaaataattagccgggcatggtggtgtgtgcctgtagtcccagctactcaggaggctgaggtgggagaattgcttgagcccaggaggcggaggttgtcgtgagctgagattgcgccactggactccaacctgggcaacagcagagtgagacctagtctcaaaaaaaaaaaaaaagtgacagaatagactctttgtggtaataaaatacccaattataaatgggacctaacgccatgtcaggcaaaggttaagtctcgcaccccctatgcttgaataaactgcgctctacctgccactaggcttttcctttcctccagcagctaaacaagcactggccttgagataagcaatgctggaacaactgcagctcccctggaggccgactcactgccccagcccctgttctacaggtcgcaactacagcttcgactggatgagagactgatttcagtaactttctcctgataagaggaccactgaccctggactgattctgtctgctttacacaggctgcacacttgagtgcctttgcatcctgaaaagaccttttcacctaaagggcctaattgtaatagagtgaaatgttaactttccactccaaagtgaaaatgggtcatatgttacatgcatgcttgttcaatacccatgcgccaggaccaccttcctaaatgtccacagctcctcctgtaacctgtagaatatgtctacttggccaaccacattcagcataaagctccgaccacaatcccttctccttccaagcgcctgtctctggtctttgctgcaggctgcactgcccagcctgcgggatggtaaccttgcaggctgtaatcctttataagaaagaaagtctccttttctaaattgacacttatgtgattttttttaagttaacaaaacaaagaagcttctccaagaggcccccagctgacttcccctcaggttctttggccagatccgtgtcacatcactcctaaacaaatgtggaaaagccaccctgactggcatcaggtggtgtggggggaggtgggcaaacaggttctgtcaggaaggagggtggggctgagggtgttgggacaacactctgttggtttgggtgtcggggggtgggtgatagaggaggctgccacccaggcatggcgctctggaccgagcatggctctgagagcaggtgctgggggcagactgattgggccacctgctggaagaggggccaacaggcttgactggatggggagattgagggaaagggaggaatccaggatgaatactggggttttggcctgaaaaactgtgtgggtgttggttccatttgctgagaggctgagggttagggtagacatttcagctgagatgcagagttctgtctttaaccatggaaggtgggctgaggggtggtcagttggatatgggagtttggggctcaggagagtggcctaggctaggtgtgcaaccttgaaatttattgatgcataagtaatacttagaaacacaggatcacatgagatccctggggagagagtgtggagtgaggaaagagatctgagggtggagttctgggacccccaatgtttaaaggcgagaggatgggcaggggccagtgaggagggtagggctgaggaagaagggccaaggagggtgtggctcacttgtgcccagtgtggccgagagctctaggtggataaggagtgagatttgactgtgggcttggcaacacagaggtcatttgggacctctaatgtttcgttagagcactggggaatgaagccatctttggaatgggttggacagagaacgggaggtgagaaggtgaagaggcattctttagaagggttttgtcatgatagagagcagagaaatgggatggtagacagaaggtcaaggatattggcttgttatgtttttaaggtgttgtgtttgtgtgctaatgggagtgattggatagagagggagaattgtatgctacaagagagagaagggagaatttcagaagaaaagtctctgagtgggtgaggcaggggcacggagcctgagtgggggcccagcctctgatggggcagagaccttgtgcattgtgacagaaggtgggcagagcctggagtataatggggatgtggggaactgaacccaatggtggaaagattgggtaaaacccatttggtatacattagtgcctctcaaacaaagtgagttttctcaagagacatttggtaatgcctggaggtatttttggttgtcacaacttggggagggggtggtttcttactggcatctggtggacgcagcctgaggatgccatggaacagctcaaaatacacagaacagtctccatgacaaagaattaaatggctccaaataccaatagtggcgctgttgagaactgtgctatatattaataaccacaatgctagcaataaaaatgtgacttgcacacccttaaaataaatacttatttttcgtatgttgggagtggctgcccacccactgccctgcccgaggcaggggagatcacctgtgtggatacatccctgtcctaactcacccgtgtcttggtggttacactctggggaggccccctgtcattcctcatcctgagctcgacaagcccaaaccttgcccgggggtgtggctatcacactctcctgcagacaccaggcttggggggctcacctgccgttcctggtggtggagggtctctgtgcaggcagctgactgggagggagactcagaagagtgggtgtcaccacaatttgcctttgccaaaaccttttctgtgttaggcagacgcatggcagcaaagttttaaagtattgggatgcgagaaatctctttcccttatatgggacatttctctctctcttcgtcttgggtaggttctttaaattatcttgcagtgagaaccctatcatgtcatgtatgctttgtccaaggacaggtcttggtaagaaaaatgcctcgtttcctctccaaagactcctctgccatctgtcagtttggaaatctccacatcttgacccatggcaaattgcttctcagcagcactgatgtggggcttgccttaggaggcacaggcagaggctgccagctggctgagtgaatggtccattttagggatgaatgaaccaaaatctcgtccactctccccatcttaacaattacagccaggcaccctcccactcctctgaagccacacttttctcttcatcccctctgtgctgcttccagtagggactgcagcatttggtggcaggaggtggcctcttccctgggaatgctggccatagggtgggtctgtgcagcaccacctcctaggccccgtccccccacatcatctcggagggagcgggctcctctgcctggcactgaaggcctgccagcacctgatttccagcctcatctcccacaactcacactgagctggacacaagcggaactgccggccactctccaaatgtcctgggccttcccccgtcgctggccaccagggagggcaccacctcacagaggagctcaaaactatgcaaatatgcccagatcatctcaactcaaacttggcagctgaaagtcaatgtgaaagttccaggctttagtgacatctctgccctgcccttaccccaccctgcctctggaggtgacacaggtgtggtgactgccctgcacccagtaaggatgcctgtctggggcctctggggcaggggtggggcaggacacaaacccacaaaaataaatttcaatgatcacaaaggtaggggtgaaactaaacgtttgaaaaagtatcctttgacaaatttgccatgtggtgggttgggttttggagaattggcctgtagtctgaacgcaggggagtcactccccctcccactagggacccacaggctggcaggagatgctccacaggctgcccctcccccagcacccctgcacggctggtcatgctggacctgatgccactgacaggcctgtcccatgtggggatgtgaaagcggagacccagagaggtactgtggtactgtggacactagggtgggggccctctcctaggggcctcatttgctgtgctgagtgtggttgggacttcacagcctaccacccacacgatgggggattgtcaaatggctccaaccaaaaggtactctccctagaggctggtggcagccctacaagtcctggtcatgttgtccgcacccaggcccacatagagtggctaagccctcgctaagggtgagcacaccatgactacacagctggcagccccgaatcccactgcctgagcctgagcactcccaggaggccctcactggacatcgtgagcccagccagcgctggccagacagttctgagcatgcagagcacagagcccaggcgtgggggcccctgtgggcaaacccagggtacacagaccacagcacgcacacccaacatggctgctgactattttcaaggtcctgaccttggcagcttctacagacggattaggaagttgtgggcagaacggctttgtgctgtcctgaaacaacactctggtttaatgagctccttgtacacgcagggcaattgtcagtgaaatctgcccattaaaatgcatgtggtttggaaggaggcttggccctctcccggctgaggccgaggccctgcccggctcctgcctctccacccttccccagggctgccgtccacatgggctcggaaagaaggtggtgagccaggaatgctgtggagcaaatcgctgcatatcagcagaacctgggcttcaggatgcctctgtccctctgtgagaagcaggtgaggcagctgcctagctctgcagtctctcactgattaaggagtgggggagtctgtggcagcagatggtaaaggacactgtccactcctgtcctctgcttgcctggtgtcctgggagccaggaaagctggatcaggcctaggactccctcttggtcagcctgcagcagacaaagcagcctctgctgccctgctcagagagaagcctgggcagtggaggtccggagcagtgaccacagcttcccccttgtgggctcctcactcagtgtcctcagctttgggagggtcctgacgtttctggatctcccccatgggaaccagaaaaggatgtgcacgtcgctgcccccagtgccttctaagagcacaaaggtccccacaagtcacacaggtggagggtctggcctgccagttgggcagggtgggctcctgtgctgtgtctccacacgtggagtcttcccaatcccatgtctcaggaccacttttcccgggaggaggaacggtagtaggaaaaactgggtgatgattcaacaggttctggggataggggaagaaaagggaggagatggggtctgggaggaggaggtgcaggattctggtagggggtggtgaggaggcgggcacaggacaggcccaacacctgccatctgaaagctgcagactgtgtttgcatggggctgtgagggcctgtccctgagccctggcttaggagggccccaggacccatgagagggcctggggctggggttaaacaggcaggggcagtaatgacaacctgttcttcacaaagcacgctcatatccacagccgcataagccccacagggaggccgggtgaggaacatctgcccatcacacagatgaagaggctgaggctgaatgaggtgaagcaatttgccccaggtctcaagtggatcctctcccctgatgcccaggctggtcagagcaagggaagcaccatggccatagtgctcctggggtgcccttgctaaaggggggacttggtgttgctctcctgccagtggatacctgagtccatcactgaagatgtgtttcagaaactgagacacacctgggaaggaactgcctgccatgctgtcagtcattaacacacaggcagaagagactgctagataggttccaagtgggggaggtgtgatttgcttggggcagaggtcagggtccagagaacaggaagaaggtcatgagacataggaggcaaaccctcctgacctccacatttcactggcttggctggggcaagaagggctgcatttagaaggcacgtgagctacacattcaggctcagcagaaatgaacagtatcattgaggagctgtgtctgccactgactctggaggaatttgctttcaatagcattagccatttaactgaaattttaccttaaaaaaatgccaaaactaatgggctcaaataaaatgttagctattatgtagtagtttctgaaaaatccagctggtcacaactcaagctttaaagggagttcacttggaaaatcaaggagccagagacatcaggtaatcagaacagaactgataaacccactcaacaggctttagcatgagcactgtcttcaccaagagcggaggctagattccccttcctgggagcttcatctattgtcgcccaagctcccaggtcatcagtttacagcacagaacactttgggtccggtcaactttggtctgtgccttcccacaccacatgatggagaattctatgctgactcccagggctccaattcctccctggcctgtgtgctgtcccctactttgagtgagacaagtcactacccccctacatgggtgttgtttgaaaggctgggctaatgcacatttgagttcctgggtgactgaggagtcctggggagttctgaggactttgcaggtcaaatgggaggtggtggaggcccggctcatttgtcttggtagcccggcttctgcaggagcatggtccaagtgcaaacctcacctgccttcctgctcatcctgagacagggaggagggagtgagctgtttcattttttttcctaactttggaaaccataaaacatggagacaagagccagtcacttttggaagagttgtcaggaagcctctagtgaaggtatccgatggtatacttgcacagatgtgcaaagatatctgtgaccaacgacgccaattgcagtattatctagtgaaaaactaagaacaacctgaatatccatcatcaggggattggttattatgttttggtttcaaatagaatttgaaagagccaggcaggctgggcgcggtggctcgtgcctgtaatcccagtattttgggaggccgaggtgggtagatcaccaggtcaggagatcgagaccatcctggctaacacggtgaaaccccatctctactaaaaatacaaaaaaattagccgggcatggtggcgggcgcctgtagtcccagctactcgggaggctgaggtaggagaatggcgtgaacccgggaggcggagcttgcagtgagctgagatcgtgccactgcaccactccagcctgggcgatggagcgagactccatctcaaaaaaaaaaaaaaaaaaaaagaaagagccaggcaaatctatttgtactgacctgaaatggttttaaatgagaaaagcaagttgcaaaacaatgtgtggagtctgatcccaggtcacaaaaatacctgtgtggtgtttgtacatgcaggagagaaagcctgtgtgggtccaagcaaattgccagtggaatttatccatgaggcgtgagacgggggataagagagcagtgggatttgggaggggttatctttcaacttcttatgtgcagtagtgtacaattagcatgtattactttgaacaaaatatattccagaagaaaggaaagaaaaccgaggaacatccgtgtctcagggtctaacgatggccacatacaggcagctggacttgaaggatatgttcttaggaactcatgctcacttgggttctggagtttttcaatcagcccaatgctctggcccaagccctcactagagatggtcctttgtctggtcctttgtctgctccatgtaaggggtgctggacctgttaatcctgtttgcctttgagctcactttggttggggtctggaaagttctaccagtcccatcagtgtgtctctctcatcttacatgctgactgcagacttcactgcagctcggacccttatgaatatgggtttggtgaacactgtgcttgtaaagcttagagaggaggtctcaaatttgacggcatctgttgctgcctatccagttccgatggaagcctccatgcccacgcacctgctctgcttctctctctctcctttcctctcaagtttctttaattcagatcaaccttccctggtagcccctaactcaataaagtacgtgtgcctaacatggcccttcctgcagggttccacttcattatctccataatcaaacctggggctgcataagaagagcacaaccactctccaagtgatttaacaggatgctttaatgatgtattgagaatgaacattgatcccaggtaagaggtgctaaactgatactttaaaagcacaccacccatttcgctctgatggactctcctccttaaatcaccgtgttgtcatttttacgatgcagatctagctattgaggctacaggactgtgaaatgtcatataaaaaagccaataagaaaaaaataaaattaagttgcggagagcgtgtattagcatttcaaaaatgttctgttgcattatgctattattctctctctgtcaaggggcactgggatcctttcctccccataaagagactgtgccacagaatgtattagcgctccgttcctgaaacggcgtggcagctgaagggcatagttacaataatggcaaaatacattccggactaaatttgataggacgtgggggcagtccgcctcctctgatgacaaagtcctgattgcttctctccttgttggctcagtcctgtggctttcaaagttttgacaaatgaatgttttcagcatttctgccctgcaagaaagtgaggaatgagatctgctgaggtgagggtctgactcttgcatttcagatgacaatgcggggactgggattttgtaaagggcaggtcacccctactctatgctctcctgccccatagcttgtatgataacccccacattatccaaagcccagaactactccaattgctgggtctagggttgcatagtcataatccgctgtgccatctggaaaggacgagtttaataactcacaatgggcctcagtcttcaggactggaagcctttgaaaaactttacctccatccttggaactcaaacacttggctctctgaggttccattgtaagttggagttcagttagagctacttcctgagctctgcttccaggcctgagttgggccagatggagggaagtggctgcagcaggaagaggctctgcttgcccgtcttgaagggccctctcagtctcctgggtaactgtgggaatgtgattcctttcgatggctcttaatttgcccaattggggaagatgaatctagtgcccctggtaggtgattacattaagccattgagacaattgtagtgctttatctgggacttttcagaaagctgacttgttctttaggagccatcggcttaatggaattccactgtgttattttccagtgtgatgtgctgcaagatgggtttgatcagcactttggtttggggaatatattttcatttgagaagatgcctctgctgggcttcttgtggcattggttttggaagcacagattctcagcccagccgagggaaggccacgacacatacagggtgtggagagcacagacctgctttaaacttcttgccaggagtggctagcctttcctgccccccaccgccccagcatcaagcccagctagtgagattctgttctgaattgaattttagccttaatgagataccaagtcccttctgttctcagtaacagagaccttgagagtttttattagagagtgagtgagacaaaacttttcactgtttttcatgttcctaataacagcctaagtcgtaacctgaatttttatgtaactaattatgactgtgacttgggtatgaaagatttatacaatcagaaaagaaattacctgggttatctctgagcaggcgggggatgaactgcataaggaagttaatcagttttctaggtcatacaaaaggcacctgcacggtgctgggtggcatggccagtggcagagggagggagggatgcaggggatgccctcctgggacctcaacagagctgcttttcctcctccaccctgaagagcagccagctttgaccggggggctttggaatcgacactttctcccaacatgactttctcacccccagcttcctaagagcgactcatggtacgcaacagttccagggaaattaaaacacagtgaggtgagtggcttaatgggaaacaggagacatcccaacaaggggaatgtaccaggaatgtcaattcctacaatcagaaaggaagccagaattctattaatttttgcaccttaaagtttcatttcagttaaaaacagggactgaaaattaatgacacggccatttcttgaagccaacaaccaaaggaatgagtgtttgccaagaagcaatagctcttgtaacacttacactcactgcattcttaacgcattgtttgtctgtggaaaaagcagtttgcccagcgtggtggtaaggagggcatgatggaaagccggcgtggagggagagaggaggcacgcgcgtgcagcgccgtgacgtgcatttagttacacgacggcttctggaggcccacaactgattaatatacacgggcttgttcatttactcagcattatgtttaatcatttaatttcgcaagagtttttagatcttttaatcatcctaatattcttcttattgcaacatattactaagctgttagttcagttcaattaaaaagtgtcatccaaaagtaatttattccatatgcgtcattaagtggataccccagatatgtctgcattttaaaggaataataactcttccgattttattagtctgtaaatgagtgcgctgcattagcactaaaggcagcatcgcgagtggtgaatgtttgtaggcattgatgtggcaacagatctataactgtttctctggattttgtactaaaactcagaagagaagatgaaaacttgggccatctgttaggacttgtaattctcaggtggcccctgaaacccagtttgactttctgatgctgataatatttgtcatagaacagcccttcagttccccttctgggagcttcttgccagggtttgccatcccctgcaggagcaggacggattgggccatcaagggccagagttgcatgtgctgggggccagcgctgggcatagggagaggttagtcccttgtcacagttctgaccttcctggttgactcttgtgatatttcctctgttctctccagggaagtgctgtccaatggtatggcaatgcaagccacatatctgatttacatttcttgtagccaagtaaaaagaagaaacagctgatagtaatttaataatatctaaactactcttttaacataaaatcaatgtaaaaattagttaatgagatatttaccttctttttccacagaaggctttaaaatctaatgtgtattttatacttacatctcaatttggactagcctaatttcaggtgctcagcagccacacatacctaggacttgtaacatagccatgttggagacttagctctagagtcctccagcctggggccctgtgtggcctgtggctgtggcttacctgggcctgtggctcctcttaatggaggagggagctacttggggtcagggttacctgggggatcttactgaagaagttggcagccctgttcttcgagcttctcccaaggggtgcagaacagtggatactggctactgatgacctctgaggcttgacttaccctgaggtttcaggaacccagcaggccccaggctggtggaaagaaacagctgcaaagatgcttgtgaccacgtatctgtgttcacaggcctttgcgtagctgaagggaaacctacgtttgcaggcagcggaaggagtaacccactccagggataacagggagctctgcccagggagggtccatatccgcctctcactccaccgtccttcccccaagcatgagtcagggcatgcaggaggtgctgacacacagcggagttcccttctgtgcctccagcaggagactagcctgattactgagctcagagagtcagcttggtccttagcctgctgcatcccacaaggaaagatttactctccttggggaacaaagtcttccatgatgagacacttaggatattaatgcctgcactttgaggcccaagtgttcatttttctttggcaaactctcaacatggccagggcggtggctggggctgatggagttgcttgcagagatgtcctctgggcaggcagggatgttatttaatacttgagtctggtgacagcagccaaaggtggttcccatttcctgaactttaagcagttaatcccctcagcctgtgtcctatttgggccagcagaagagccttgagaagtgagggacaaatagagagaccttgcaaaatcttaatgcccttctctacttttgcaaaatgctgtgcttattaatatctcattctcagaaaaagggcaatctgtgcttttttttttttttttaggagaacagcaataaaaaaggaaaattaaattagcaactctgtctgagcttctcatccattcaagtgtcttcaacttcataacctgttaacttacttaaactctggccacctatttaagaggtttcaagaagacagcagtattctgcctgaccccattggaatgtcagcctaagagacacaggtctgaagcctaggggctggtcccgagtgagagggctttggtggggtggtgtgctcagaccgcccacgtgacccagaaagctaatccttccgtcaacacagcagtcctcgctccaaagcacacactcaactccaagaattagtcaaatacaattacacacatgaggtggcctctccacccctattaaataatgggaagataaaactgtcatcagaggaaaacatcacaaagaatctgtacttagtaaccaggacaaggtaccagtaatagctgctaacagttattgggtgccaactgtatacctgactttgtcctatgcataggacctgctacataatttacagggccttgtgtaatataaaaatgcagttccctttgtttaaaaaattataagaatttaggctgggcacagtggctcatgtctgtaatcccagcactttgggaggccgaggcgggtggatcacttgaggttaggagtttgagaccagcctggccaacatggtgaaaccctgtctctactaaaaatacaaaaaagttagctgggcttggtggtgcacgcttgtaatcacagctattcgggaggctgaggcaggagaatcacttgaacccatgaagtggaggttgcaatgagctgagattgcaccactgtactccagcctcggtgacggagggaaactctgttatgaagttcaaaatgtggccaggcacagtggctcatgcctataatcccagcactttgggaggccgagacaggcagatcatctgaggtcaggagttcgagaccagcctgactaacatggtgaaaccctgtctgtattaaaaatacagaaattagccaggcgtggtggcgggtgcctgtagtcccagctacttgggaggctgaggcagaagaatcgcttgaacccggaaggcggtggttccagggtgccgagatcgtgccactgcactctagcctgggcaacaagagaaaaactctgtcttaaaaaaacaaaaaaaaaaggaatttcaagatgtcgacagcagagcattaaagcaagcatgggccccttctgagtgtggacccctgtgtgactacacatgtctcaagccagaaggctgcattgcatcaactggtttaattctcgtaacaaaatacatacgaataccctctccattttacagatgagcaaagcaaggcttaaagagctaaggagactgtgggaatgaaggtttcgaagtggtctgaatggagaaagaagcggtgggagagctgagtcatcatgcagcacacggcaaggtagcagaaaaccctggagaacaacagcagcctgccccagagtcagccgtgagcgctgatttagtttcaggaaaacaataacactttgtcccattaaattaatgttgttaatttgaagtttattggttttgcagtttgcttttatttcatttataaatttgttttagctttatggctgtgagagagctccctgcataaggaacgtgtacctggttttatgtttgtacatatttaagtaacattatactaaatataactcaagtcaacagagagcaatcacaatgtttcccctctaagtggggtctgcaccttccttaaggagggaaatacatctcttgtcccccagggtggaagccatagagggtgctcacaaccctgtcttcagctggctgccagcagggctgtcctggcttgcttggggcctgtgatgctggaccccagtggagagggagggcacgcgtaggtggctcctctgagcaggtggctgtctacaggctggggatggcagggccccggaaggtctgtcccgccctggcctccctcctggctgctgccctacattcctttgtcttggcccagggagcccttagccttatggcaaattcttgaaaagtgtccctgacccaaaggcagggagggccctgtaggaacacccagggtctcaaggccatggtgggggaaataataatgacccctcaagactgtgtcccaagctggccctgaatgggtaccttggggccaaaggccatccctccccactccccaccatggttaagtgtctactcttataacaggagcatgtttaaaaccaggcatcaatatcttgttactctgtgcatattctccaccagcaatttgatgcgaagagatagatttctgacagagatgcataccaaaggcttgcacaagaacattcataggaccattatttataattttcccaaactggaaacaagctggtacatcaacccaggtggcatattcttacaacagaatattatcatcaatgaaaaggaacaaactcctgctataaatgaagtgacaataggcaaatctcacagacatagtttgaagcaagcagccaggcacacagaggtcattctgtatgagtccgttgatacaaagttcaaacataggcaaaattactctgtgatattagaaagacagggtaataggctgggcgcggtggctcactcctgtaattccagcactttgggaggccaaggcgggtggatcacctgaggtcgggagtttgaaatcagcctggccaacatggtgaaaccctgtctctactaaaaatgaaaaaataaattagctgggtgtggcggtgtgcccctgtaatcccagctacttgggaggcttaggcagaattgcttgaacctgagaggcagaggctgcagtgagccgagattgtgccattgcactccagactgggcaacagagcaagactcggtctcaaaaaaaaaaagaaaagaaaagtgggatgataattgtgtcaggtaggaggacgggtatggggattgggtgcaggcaggaaggagggcgtctgaggtgctggcggcactgtatttcttatggggacagtggttgcacagcatgctcttgtctgcttcattgagctgtgcacttttctatgtatgctgcactccacttactatctaaaaaataactgaaatattatcatagaaaacatagggctaaacagcaaatagaatctttacagaggaaagaatgtattgctattccccatcagcttccttctctctgcccctgggcaagtcctgggaggagcctgcaggaaggctggggccctcctagacctgacttgccccttggggtggcccctgatgctctggataaagcagcctcacgagtggggctgactctgggggatcctggggccctgggctttcttcccccaccggcatgatgtaggaggaagccctcttctgaactgtttttgggggttcatgccagggacacttggtgctgatgtgaagcaaaagataaagaacagccagtccggagtaggtgggggcctcatagcaaagacgccacgcgacaagggatttcatcaccctctgcccattcttgtgaccagagccgtgtgctcttctgagctcagtcccgtggcctggaacatgcggccctcaccacaatagcaggagggtgagcctaattcacaggtgggaaaactaaccccaggaaccttaaaagatttgcatgggtgcccccaggatcacccccagcacatcagaggtgactggtctcatggcctgtacaaagggctgctgggctgacacagtgacattcagaagcagagaggtcccatgactggctgcaagaacggccagtctataggagggctaggcatcctgtccagaggcctgtctccctagagctctggggttccatgtggcatgtctgtttggagcaaaggggtcttgtgaagccctgtgtaactctctcagctccccaggccctctgccacacctcggctgcagtcttggcttgtgttcccaaatcctacttgtcctccagccacatggagagcccttccattttcaggagtcccagctcccagcagggctctgtctgtgctggaactttctttcccacgttctgtcagggctgataccagcgtatgcttcctgttctctcaggagttgggtgtgtcttagtgatgactttttccctgcaacacagtctaagggagctcagacctggtctcctgcctgtcccagaaggccataccaggtgaggtggcatcaggaaacctcttggcggacatgagaggtgcaaggaagacctcagtggagcactggaccctaggagctgagctcagagggacatgttcctccctagagagggttccaataggtctgcaggccactgccatctagaaaacgccagccgcttcctcacagctatgcaggggcatttcttgctccagaccaagatattaggcaggcatgagcccttcaagacaatctgatcccctgctcctcccacagacgaatcaactaaagcccagatggcaaggtagcctcaggtatacagggtagtaacagccttcctgggcctgagtagctgaagatgtagctgcacatgtgttttgcccgccctgcactgggaggccccagcaacttgccagccctggccagcaggcttatactgtgtggttgcaactcaaatgctgctgtgaagctgggggttcgtgcaaaagaatgtcagtttctatagagaagttctttagaactgactgtgtgttctctgtactcctagtgccctagaccaggggttcccaatctctaggccgtggatggtccatggcctgttaggagccgggctgcacagcaggaggtgagcggcgggcactgagttctgcctcctgtcagatcagcagcagcgttagattctcaaaggagcacaaaccctatagcgaactgtgcatgtgggggatttaggtaatgtgctccttatgagaatctaatgcctgatgatctgaggctgaacagttttgtccgaaaccatctctgttctgctcccccactcccagtctgtggaaaaacggtcttccaggaaaccagtccctggtgccaaaaatgtttaggaatgctgccttagactgttgccaacaggtggggcccaggagcctggcaaggagatgcaggctgagtctgggttggccacgtgcacacatctcctaggatggtccaaggggaatgtgagcacggggagggtggaagccacaggatcggagtggtcaggtggggtggaggggccacagggctggtaggcctatgagacccacgtcagggcatgaggcagggtcatgtggcaggggcatcctccttggggcctatggtgggttgagtagtgtccccaacccctcaccaaattcatgtctattagaacctcagaatgtgacctgattggaaaataggatctttgcacatataattacttaaggatcttgagatgaaatcatcctggatttactgtgggcttgaatccgcttactggtgtccttatgagacgaggagaagacatgggggacaaagaaggaggccctgtgaagatggaggcagacactggagttacattgctgcaagccaaggaataccaggagccaccagaagtggaagaggcaagggcctggagactttgaagggagtgtgatcctgccagcaccttgatttctggcttctggtctcctgagtggtgagagcacacgtttacgtggtttaaagccaccatgtgatcatctctcatatcagccctaggaaacccatggaaggtccttattgcactcagggagcaaatcaacctctagtaccctctaggcctcaatgtggccacctgctctgacccctggccaatcatttcattgccaaccccagcctcattacatggacaggatttaggtggcaagtggcaggtgggtatggggagggggtgaggggagagaccttgaaatggcaggttgcaggctcagttggcccactcagaccctctgcagttagcacagagctcgccacctcagagcccaggcataaatatttgtgagttgagttattcccagtcaagactgatgccatttgggacatggactgggccaggggtgtgcagatgaggcataaaagtcatccccaagctgctctgaaaactgctctcaaaatgtggcagcaccaagtccccagccccaaagcaggtctccaagatactgaccacaactgggaggctcccctcagctgcctggtcttgctcctggtgttttgccagggcttagcaaagagcctgggaacacacatcctccaaaaccaaggcccactcagagccacagggtagccactgaacacagagtaaagaccaccctccttctgtgatggcctcccctacagcttccctggccctccacattccagccacgctggcctgcctccagcccttgattacagcaagcgcctccctgtctccaggtctcctggacatctggctagttcctctcacctccctgtctcttcctttacattatccctcagacaggtgccctacccataactaccctatctagagtagactgccgctgttttcctatctttctccctagaactgtaagttctccaagggcaggaaccacatctggctttgcttaccattaaatgccagcagcctgcccagtgccccacacatggaacgtgctgggtaaacagttggtgggtgagcagtgagcctgcacaccggtccctgtgtctgggacaccccctggagttgcttttgtcctgccccttccaccagcccaacctccttggagccctgagccagctggttctctcctttagctcaaatcctgggcctggtatttgtgatctgcattaatggccttgagggacacttcaaggtcttgagtccagagacctcagaaggtccctgctgactgttgcctgaaacccttttcctaggaaaatatctctgaaataggtgggacttaggaggcagataataacagtaataaaatctgacattccctgagcaccctgcctcgcactctgctaagccctttacacacattttctccttgaaccctcagaacaatgtttctgtacaattacttccattgtacagatgagaaaactgagactcagagaggtaaatctgcccagctctgcaggattcccaagctgagctccctaaaagctgctgcagtcctgggccaggactcttctatgatttgggctgaatagctggaaccagagaataaaagtggaaggctgtgatggacaagcagacggaaggggagtggccagggaggggttttcttttctcctgagctaccagttgagggtctgcactggcaaggccccctgttctggactagggcagtcccagcccccaggacatgaagaggggatatagattttggaggatttggcttttccagggcatgggttgggtctcaaaggagcaggtcatggggtttgggtcaggacttctggggagtgtggtggctgaaatttcactagatgagttgttgacaaacctgggtctgaaatccaaggttctaggctcccagactagagaccaggccagagcctggcctatcaggtgggtggaactggtcaggaatctgagcacctatgttttccccgaagcatgaattcatagagcactcatgatgtgccaagccccatgtaagctcttgggaatggcggatgagtgagtccaggggaggcagatgagaagagacatgggaaatgcttggtgggcatctgtggtgtccttaaggcctctctgagcaggggacacttgaactgagtcttaaaggagtttgcccagaagatgggaaggtagggcctgaggaggggcttccaagcagaggaaacagtatgtgcccttctgtgggcacacatgaacacggccaggagcaccaaaccacatgctcaggcagtggtagaaattcctgaaacactggggccccagaggagtcttcctggtagatccttgcatgttccagggtaggaaatctgtggccatttgggggagaagccaccagttctggtttctggccagctcacagttgcattgttgagttccaattaacattcacggaataattgaaatatgtaattggaaaactcaaaatgcattttaatcccattagcagcaggatcatttctcccatacgattcttcttgggggtgagctggaggtgcagcagtggctcctgtgggtgggagcagaggtcttccgttctgggaatgacagccatcccctcttcgtgccctgggggctgggactgctctggtgtaccctgaacagagacctgagttgcttcaccagtgagtgaagcctgctgactccatctggtcaatgggaactgccctgaaccctcacctgggctcagccccattgaaccaggggtttgtcacccttgccctagttgtctgaggccctgaactaccgctctgaaagggtctgtactgaccttgttaccacaaagagcagaagcccctttcccaggaagacaactttctctaaacaaatactacagtcttgcaatgctcatctgacacttgtctctttccaaagagatagccattaacacttgttaagttctgagaaatgatttgggagcagaggggcatggaatgtctgttagcacaaggttggggccctgggctggaggagatgtaccccaccaaagtaaacatgccattgttttctcaccaggcacaagggaaacctgctgctcacctctgagagctgctcattggtgacagagattttcaagagtggtggtggagaaactgggtgtcctgaaccgtttgcatcctaaaggtgtgctgcgcttcctggggtcctctgggcctttaagcctagcgtgtgtgtgtgtgtgtgtgtgtgtctgtgtgtgtgtgtgtggcagtgttctccaaggctctaacggggccatgccgtgccttgagactccatctggtggggctggcccttgtccaaatggtggacagtgacctgggccctgtcttggaaagatgtgtccattggcaagtgacaaagaaagcaatacaagagacacagctggtgaggagtctattacatggtccagatccagggggacagtctgctttccacttctctctctcaccttcttgttcatcccaaataatgccagacacatggtggcattccttcctatacagacctggggcagcagatccccaggggtaaggaaattctagtgctgcttggggtagaattgagagcaggccctggagatgtttgaccataaggtgcatttgccaggggcagtggctcatagaaaccattatgaggaattggacagtgggctgttggctcacagcactgcatgggtgtagggcaatatattggtctgttctcacactgctataaaaaactacctgagactgggttattgatgaagaacagagatttagttgattcacagttcctcaggctgtacaggaagcatggctgggaggcctcaggaaacttacaatcatggcagaaggcagaggggaagcaagcatgtcttaatatggcagagcaggagagaaagagcaaaggcggaagtgctacacactttgaaaacatcagatcttgtggaaactcactatcatgagagtggcaagggggaaatttgatcccatgatccaatcacctcccatcaggtccctcccccagcattgagaattacaattcaacatgagatttgggtggggacatggaaccaaaccatatcaggcaaagaccaggagacacatgtagaaggcaagatgttatctccacagatgtgggagggggctgcccagcactgtcccttctctcacgctgatccagccccaacctcagagagaccatctgcaaatttggaactccaagcacatcataaggagcaattctcacaagtccatgctcccaggtcagactgctgctaatcaaagtgttgcttcctctaattagagtgagtcaagtcattaaaaacactatccttcaattgttggagtgtgacatttcttcttgatcctaagacagatgcccctcagggcagaagtgggactggagggaggggaaggagtgggcagagggcagcagtagttttgctgctgacgccctgctgatgtgagcagtgcctgcccgggcagtctcctccctctacatccttgccattatcctcttcctcttcccactcaacctgtgcagacacagcccctggcatgtgctgctctggaaccactccttggactctgccttggacactcgctctttttcttaagtccttgggcaaccctcctggagaagattcaggcatccaagatttggatgaacccccacaggccagtcttcttggcattctctactttgaaatgattataaactgtctcaagttggagaggatgctcggtgtcagatgctggaggatatctgacatggtccttgccttccttaacatattagctttttgcttggaggaagtcctggggtagggtaggggagtaaacagacccacgggaagagacaggctgagtagggtgtcagggtgctgtgaaaggactggctagggcacgagacctaacgagcaggcagaggtgctcagacttggtgaggtgggaaatagggagccagcgaaggctctggagtaagtgggcacaagatgataggtgatgctatggaagccccactgggcggccctgagagtggtcaaaacatggcattgagtcaataggcacacccttggtgttgccccttctatgcctggctagttcatgagggaacagggagatttgcacaaagtttatttgtcttctgattataaatgggcagggcactgtttgaaagaagagagagaagtcaagaaatatttgtaaacaatgagaagagaagcgagaagacaaatggaaatcttgatggaggtggcactgctaaaatcttgtaatagtaataatatttcagctttgaccagtgtcctggcagaatgaggggaacacatacagctcaagtgaggttcagtcaggtgccagctggctgggaccctagcctttccctgaaggctgcctctggtaccaaaggttctctctgacttgggcaggaaaggtgccccattcccttggccctaaaatattaccctcagaactgccatggagtaggatctgaattctcacattttcctcttaacagttccaaaggaatgatttccctgtttcctccaaggccaagggcatgtcctgccaccacaaggagcctccctcactcatctcacgtgatcttcctctgtgaggaagtcacacaaagctcccagctgtggagtcagtcagtcacacaaaactccctggcgagtcagtctctgaggatcactcagactatgaggtccaatggctccttcgctgccccagctgcacccagctcagcaccacctggcccggtttggtgattcactttccataaacctcaggatgggcctgcaggctaggccacgcccaggcatagactttgccaagacctgtccactgggctgtcagcactctcagggttgaccacttgcccagagcacgaagtcctaggaagggagctggatcggtggccccacctgccagggcaccaataactaagctctgtgccaagccctgtcctgggtgcctgagcacagcagaatctgacctgccctgtgtccatggcacttgcaacctaggtgtgtgtgtgacatggtcacgacacaaggctgacctctaagcatccctgggtgtgatgttgtgcagtgcttaggagcctgggttctaatcccaactccaccatttactgactatgcaaccttgggcaaatttcttaacctctctggacctcagtttcctcttctttaaaatgggactcagaatctgcctcatagacttttagtgaggactgaatatgtgaaaagtatttagcatgtatcaggcacacggttaacacttgctaggtactaacagagagggacaacggaccttagagctttggaggccctacccagatctccacattcaggcatgtaaaaacacttgcaatgagacctaactttttctgaagagatcttgtttctgtggagcacgtttttgatgtacatccacccgctacaagttaatcgcctcttcaatcttgacaaaaacctttcttctcacccataggctatggttcaaaaggcttaaaaagtcaactcatgacccctgtggctctctggagcccatggatgttgccccagctggaggccacatcatcacattggggaccctccactatgcatctgaagcaaggtaggactgcaggcaggggacttagggagggcttcctggaggaggtggcatctgagctggcccacagtggactgcaaggatcctaacaagcagatcagccttctttgctgctttttggaaacaattttgtttctctctgtttttactttaagtgtctgtgagcgtctggaagttttaagacacactgatcgcctcaatgctgccctcagaccacatctctccatggggcttgaatggagaattttcaatcccataaaaagaaaacctaatttgagaagtactgattgtaaatatcattctgtctctcttacttaaaaacaaacccttgactctaggcagcccctgcattgcctggttgcattcccatctttatgttcacaagtccaaataccagtgcttttcaggcagaaatcctctgctttcagtgtgttaaagctttgtaggttggccggacgcggtggctcacgcctgtaattccagcactttgggaggctgaggcgggtggatcacaaggtcaggagatcgagaccatcctggctaacatggtgaaactccgtctctactaaaaatacaaaaaattagccaggtgtggtggcgggcgcctgtagtcccagctactcgggaggctgaggcaggagaatggcatgaacccaggaggtggggcttgcagtgagctgagatcgcaccactgcactccagcctgggtgacagagcgagactccatctcaaaaaaaaaaaaaaaaatgctttgtaggtgactattctaccgaggaggtgaacactattgctgggagtctgtgaatgacagctgcatgcacatctcttaaatcagcagtggctcaggatgctacctgggtgctggcctatgatggaggccgcagttgggtcatttcatttcctaagatgcaggcataggcatcccaaccagctcagccctggatctgcttctcccctgcccagagctttggatggctgttcttggcctctcattccaggcctctatagtctgactgacctgacactgtggtccccactgcctcctgctgcccgcactctgctctaggatgacagcagtgccgtttcttgaatgtattctgtgtcctccagcctcagtgtctttctttgctcccactgttcttcctgccctttactccaatcacacacatccttctggatgccattcaaatgccaaacaccacctcctccagggagcctgccttccatgactgccacatcacaagcactctgcatctctccctcatgccttatccccaatctcctgcctcaggaaagcagagaaaggctgtttgttttggacttggacttgcctggatttaatcccagctgtgctattgcccaacctcagtcatctcatctgtaaactggggttactaatagtacctgtttgaggactgaactacatataatataaatgatttaacgtagtgcctggcacaaagtaatgcctcagtaaagaacaattattattttaaaaaatgattaatgtattttgagtattccagccccacctcttactaactaggtagccctgggagtgagtgacttaacctttctgagggtggggctttgcggactctgcaggccttagatgagagttttggagacaggctgcaggggccctgtagtagaggcccctctgtcccgggggtcccccatggtgggacagggagccccaggcaccctcagcagcacagccagggagaggctgctgcctgcccctcccaggcctgtctgggtctgcccaggccccactcctggcccgctcactgaattgaactgtttggagcgatgttgctgttcatctggaaacagcttcatattcagtacccacaagaccaaacacagaccctgcccagccacgaggggctcaaaacctgtcacagtcacaatgctcagagcccccagcaagaaactcatcaagatgaagcaccaagcttttaaagagcctctgcctgagccccttggccctggatgctgggacagagcctgcctagggagagcctttgtgtcctggaaagtgaaggtagacccaaggccccaaggtgcctgtgaaaagggctctggcctcgcttgactgacctatccgagtggcagcccctgtcaggacagctggacagcgctggagggggcatctggggactaagcatcactccatttttctgggtcgcatgtccaccttgagaattattcctcggttacaggaaaactgtctgctctctttctacaaagactgaggtgagggtctgtcagaggctgctctccataccctagaggtggtgctgtgccatcctcccgtctctgcagcctgggctcagaggcacagcctggcctggaggaggcccttgggcaagggagctccacagagtgtatgcccctctttcatgcagcatttctcaggagcaaggtcagatcccagctgcccttgggaactgggataacagtgggaaccttgggggctgcgaggtctggagcctcagggcaaagcagggcagagctgaaaatgaggtcacaaccccaactgccccgctattgatctgcccacctttagcaggtacttaatactgaaggaattatattcttgaatccccactcctaatccttcttctgagcctttctcttgccttgaagtagagccctttccttctctatctgtccaaatatatcccaccttcattcttcaagatccagcctaagcccatcttcttccaggaagcccagatggttccacagcacctatcatcccaaccctgtggtttaacacttgatatttacatacctccttcttgcctgggagccccacttccctagatgggtcaggagctcctgagagtggggccttggctgccactttctccccttcctgaatgaatgactgcatgtgtctcccttccccaggatccatgctgaaggaaaaggcctctaagacacagggcagaggggcaggtgtcctgctgtggtaggcacctgtcttccagcttgcccaactctgggactagtcctgcagcctgtcctggcacagatgtagcccaaagcctgacattctgcctccagagctgcccaaagaccagcaccaagcccttaactggtaacacaacctgatggtaccatgtctcagtgatgggtggggggacttatttcatctggctcagccaggcacagagttgtttatttcaactctctttggctgtcagttcacttgacgagaaacagaaatgaagcaatgacttctgaaacaaaaagaatcttgtctcaattgcatttgtattcaaatgggcaaaataaattccagggcctttctgagagtgtgccgggagtgaggcctgcgtgcaaagtgggtgctgatggctctccatccccgagagagtggccaagatcaagaattcagcctcagaacaaaccttcggcagccaatctgttaggcagctgcccaggtgcagcaccagcagggtgtggcccctcgcaaaagcagcctgatgattaattactgtgtcttgccatccaggactgtgaggaggagagtgaataaacaacagggaattttatgtacccatgatgagcaggagacaggtgagactgtttgctgctctaagtgaacagaatgtttggagctgcatcagagggcactcgcaatgcctgcacctctgctgatgccctctgccgccagcactgggcgaatgaggaaaatggagctgggggcagagctcctgtgagggccatcggggagtccttgagcctctgtggcatggagataaggcaaagcttccagcctgggtcttccctcttcatctggcatccctgcttcccagcaggccagcagccttggggaggggtcccacacgggcgactggggccccagggagttgtactttccactgggtctgtggattatgacatggctatctgaagcccctgaattttagctctaggcattatgcctaggctgtgtggtctcctaggatgaggtaaagcaggaaccacagcagagggtggcatgtggcctccaacacagtccccgcccctggagccctcttggatggctctaagcactgccctcagctcagtgacctcagcacacttggggatggacaggccggcagacaggggcccatggctccaggccacctgcctttggcccgcggtccctcgcctgcaatgtgggctgcttcttttcaacatgaccccctgtgggaccccactgaaatgacaatacagctgaatgctggccagcccgtcagggaggagatcgagcccagtgagtccgcagtgctgggcttcccactcttgtgccgcatctcccagcccctcagtctccctagagcctccgtctccgactccccacccatctcctgagcctgcgctcaaggtcacgtgcagctctcaaagactcaaccgcccacttggaagcacttaacaatccgattacaaaagaagtacaatgggaagggggaaagtatgttggtgagacaggagacacaggaggggaggggagtttgggggaagagcgggccgttgagtcacactaagtgtgtggtgcctctaagtaatgacccttggacctcttggtccccttggaccttagggacttctgaagacctggtgctggaaacctcatgtctggaggcgtgggtgggacaagaccctccccagggcagagtaaattgaggggagcagcgcacctgagtgtctcagacaggccctccatctgtttttgtaaatcaggttttactggaacacagacacattcatttgtttacattttatctacagctgcctcacgttgcaatgtcagagttcagtggctgtggtagacactgtatggcttacaaggcctaagatgcctacatcctggctctctaccaagaaagtgtaaggggctggcaggggaaaggagctcactttcaaataagatggagaacaggtggccaaaaaggtggagagcaaatgagcgtctcaaggagggagaggtccggagggcctgatctgcagagaggtcagactggataaagataggagtgttctctgcctaagccaaccgcagggcaagagtgacctgttgcaggcctcagttcctgtacaggtgtaggggaggtggggagggtgtggacggagcacagagggaagccaggggtcaggatgaaggccatggagttgatgagaagagccagcctttctgaagatgcttggctagttcagtgggaggggagagggctgtgggccatagggtacatgttttaatcagcaagccctgcgatttcagacctaagccttgaacacttttctaaaatatcagagactgctttcctaccttggttacaactgtccagcagcttcccagacttggccctgccaggccttgagtctccacccagcccatggagatgggcactggcagatggaggatcgcagagagaggggagtggcagaccaagggcagacccttggggtcgtgctgccctggtacttcccgagcctgggtcaactcgccagttctttctccatctctgaccccttttccacaccagaatgcagaaaacaagtccaccttgccatgcagccttctctgacccgtggctcccaacccttcctcctggggctgcactagcctctgggttctctttgtggcacaagagctcagaccaccaggcctgcctggaaggggccaaggggtgtgaaccatgccctttcctccaggccccagtcctcctgcctctacatgctacctcccaaggctgtgcctccctgcccctacctcgcacagcttgagcacagtggccgctccaggaggggttgagtcagcccactggcctcctggggtgtgccatcatgattcatcacagtggtgccacagctaggcctgaggcccacctgtgaatcaaaaaaaaaaaaagaaagtgtgaagtagcaaactcatcatttgagactctcatgcttcctgagatgagatgattcccattaaaaaaaaccttcattttcagaaaatccatgttcacagcttgctctgtagagcctgcccccacaagttatgatttatattttattataaggtgaaaagagacaaaaaaaaaatcctcacaagggaaaaaaaaaagcccactgactctttacagcaactcccagggcatttgatttaaagggacattgtcatctttaatgttttcattccgaggaattagagagcgccactgtgataatttagaagctcctgatttaaggggcagccttcgtggtctagcttcactgtatttccctttttatgattccagagagtattttctgagagataacaatgttgggtgatatttctccttcgtcaggtggaggcctgagaagaaaattaaaagagatcctttcttctcccctctgtggggccaggctatggactgcggaggaccgtcacagccacctcccgccactccatctccacagggcctgaccctgccttccggcacccccagagctaagaaggagaggcaggcggccatcttggccctgtggcgaactctcggaatggtcttcactgttcagctccttctctcccaaccgccaccccacgcaagggccacaagagcctcccagaatcatctttctttttgtgcccttttctgttcccacttttgcatctgtgttcaggtcttctacagtctctggagtttcctagtcctcactcttccctgtgggtgtctacaggtcggtcctcctcaaactgactttgaccacaccctccatgcttccctggcttccttgacatgcccaaactctgtggcctgcatgtctttggcagagaatgctctgtgttcacctcaacctgcatccattccctcctgtggacacagctggactacatttcccagctcttcctgtagttgaggcatccatatgactgagttctggccagtggaatgtgtcaggagggatgggtgcaagggctttgctgggctccaaaacagctcctgcaagcctctctactctctccatcctactgtataccggccagatgcagcatccagtaaaggaatctgaggccccaggagacggaagaaccacatcctgaaggtgtccgagtccccatgtcactgtgtgcacagaaactgaacaccagccttgagctgttacaggaatggagaacaaatctttgcactaataaatattgcactaagcccctgagatttgggggttgtgtgtgattgcatttagctccctaacacacgcccttgctgttatcgttctaatccctccctcctgcatcatttcttctcttttatttgtccatggcacgggacgagttggccatattagatggtctggagccttcccatctgttcttacgcttaggctgttgcctctgactgggatgccttttcccactcccatacctgcctgtgaaatcccatcgtgccctcctttgtgaagactaatagcattattttgcttagctgtgttacaccctcctctcagtttccatggcgttcttttggcaaccgtcccacagccttttgccttgtttttgcacacgtcttgttttcccatagaagagtggactccctggggccagggaccaaatcttactcatggtcaacctgtctgtgttggaaggtactctgtgtggtgtccagggtgttaattttggaggacatcccctgatttgagtttcatctctaccaccacgtgcaactttttgatgcctccgttcctcttctgtaaaatgggcataaaaagagaccctgcctcagagaacctgctctcagggagaaagggaaacccccgtgcatgctccacgtgccacccaccgcccctctttgctgcagtcacctgctgactctgggttatgccccaccccatttcctgtgttgtagcctatggctaacagcagtctcccttatatgccacctgtgtaagtgccaggtgatttaaacatccaagttgattacctgccaactctccaccttacaggtggccatatcctggagtccagacactgtcattacaaattatagcagcctgaaaactcatatctacaggcatcctactctctgatcacctcccatctcttctggtttattctgtctggtatccagactccaagaattcttcagccccaccgggaatctactgaccaactgtatgcctgtcacctgtggtgatgttgcttcctccttaccatggaattccatggaatttaaatcactggaatgatactgttgcacacactcaattcccttaccctctcttgacaaccctccagccctggtgaaatctgtctgggtgctgtctgcttatacccgggtagctgaacatgctggggaaacggccaccctgctgactagtctcactttggattcaggactagggccctcaagtgggtcccgaaagctgcccaaagatcactccgcctcctctgcatctgtccctctttcactctcctacacaatcgttcccgaccttcttctccctcctcagacttccacatctcttcccttatcctcacgctcagccatgaccttgcttcctgattcactgagaaaacagacgtctgcacacgcacccaccacaccgacccacccatctctgtcggttcacactctcaggcttctttcctgttaactgggtctgccgcccatccatctaagacaatccccaacctgggccctggattccacctcccctcgcctactcaaagaagtcatctggttgtactgcctcttccttccacagcctcagtttcccctttctacttgactctgctcatccacagacatgccggttgctcacgtgtgtttgcaaaagccttcttggccctgctatccttttagctactgccctattctgttctttgctgcaaaactcctcagaagatttatcttcatttagtttctccagttcctttcttcccactccatcttaaacccaatccaatgagacttttgtaccctctcccatcccactgcgtggaaactgcctttcaagccgaagacctccaaatgactaatacaagtctcttttctttgtcctcatcttaactgagctttcagcacttgggacagctgaccgcttcctgactcactcttctcttggctcctaggacattgcacttgcctgggtttcctcccaccactctggcatcttcctctcattctcttttggggctcccactcctcttcctgacctcttcccatcagaggctcttagggctctgtcttggcttctcttctctatccacattcacctactcagtgatctcatccaactcagagctttaaatgctgtcagtatgctaagggtttccaagtttccatcttcagcctagccctctcctcgtctatccaactgcctgttcaacactgccacttgaatgtctgatagcatctcaaactcagtatgcccccaaattaactcctgatcttccctcccaaacctcctccacccatggtctcctctgtctcagttaatggcaactccatccttccagtcctcatgcccaaaaccctggagttatcctggactcctttcttttctaataaccacatgcaactcatcagcaaatctctttggcaccgcccttcagaatatacccatgatccagcctctcctcaccaccatcgtgcccattagctgaattattgcaacagcctcctaacttgtctacatgctcctacttttgccctgtaacagtcttttctcaaaacagcagccaaagtgcttcctttaaaatataaagtcagatcacatcccttctcgacttgaagccctccaataatctagtttcacccattgtgaaaacaaaagtgcttaggttagcttccaggggcccccaggacctttgaccctgcccccagcttcccataccactcctaccatcagacctatttttacctagggggctaggacacatcttcccccagtgactgcgtggcgagtgccctcaccccttcaacacctggctcacatagcccctctggatgaggctttccctgggctatcgtatttaattttgcccacccctgccctgccctgccctaccctgccctctgtgttgctgttctcaaaagtactacccacgttgtaatctacgcatccattgttgtttatctgtgtctcctccctgtaatacaagttccgtgagggcaagagtttttgtctgtgttgaaacctgttgaatttctgcagcctagaacagctcctgccaggaagtatttgtgtgaatgaccgcacactgcctccagggctaagcacttttcacctgcaggcctgccttgggggctggggctggtgggcacactgcagcctcaggtgtaggttctgagggggcacctctaaggtcacatgggcagggagtacctgcctaccttgatggtatcaggaagtcttccagagttcataattgcaccctttgatggaaggcattttgaaaaaaagctctctacaggagaaaaaaggacaatttttcatgtcaaatagtgttaccaaaaaaactgattttgcacaaatggtatcctacgtgcaggatctcaaagcattttgcaaatgcgtattaattggttattacaacatccctgccagacagaggaagaatcaacctcctgaataagaagagaacacttggttttcatgattaaatcaggcacaaagatggaatgtgtgagccccagggttccaggggcagaggagggtgctcccacctgtcctcaagccaaggctcggtgggactcgtgggtggcaggtggcctcatcagatgtgctgatggagtgctggagccatcatgcatgggttggaatttttggtctactgggtaaccgcaggcaatgacttaatctctctgtgtctccggctcttcacctctaaaatgagacacgtggtatcttttcataaggattgaatgtcactaaatgagataatgttaagctgcttaacactcagtcaatgttattagtaataacaaatgtcacagcacagccaccagccacagcctcctgctccctgcctccttcatgagaatcctgtgcacctgactggccccagctctcacagaaatctagagtgggcatatgaagtctcaagaagtgcttgccaaattgggtttaggacccctgaggcctcactgtagtccctcctggactctgctgggtagcacagattctagaagccagggtgtttctgatgggctggcccttgtgggacaggatgccaggtggggtgtgcagcgtcgggaccaacagtcccccatccctcatctggaccagcagtcctctatccctagccactggtacctgccaagtttgaggcacccaaggggtctcccgaaacagacgctggtgaccaagattgtctagaatgacttgagaggcagcatagcttagtaggtaagaacacaggcttggaagctgaactcctgggttcaaaccctgccctgtaactctctagctgagaggtgggcaagttactctagcatggtgcctctgggcctcatctataaaaaggggataacgatagttcctctctcatagattgctgcaaggattaatgaattcacttagaacagcttagcatcaactatgaatgctgtatgattacctgaaattaattatgtggcttcagaggcaagctctgcaacacatggtgagccctgcaatgctctgctccttaggtgtgtgatacctgtacaccaggtgctgggcaagtgtctgcccatccagccaacactccatcgtgggtgggcttccccactgtgggccctggactagtttcttagtaatcaacttgcagacaggatgacagggccaggcttgtcacatcaccattcttttcccagggctcagtccagaacttgcctggggcagatggtaggcatgaatggatacataagagcaaatattcacctgttgtgttgcttcaatttggggcgtttccttaaactcctgcctactcagagctgaagcccaaaagcttcctaacctgttggctttgtgacttcaaagaccatgtctgtcacatctgagagcaggaaactcagccatggtgctgattcatgtggcacctgcgggggtgtctcagttcgctctggaagcttactgccctctgcagagaactgagggacagccacttgccaggccattctccctggaagtgcccatggcatcagaacatcttcatctgaggatcaggaaccggggctggagaccaggaggccagtccctttggtgagactgaggccccggccagagcctttgtggttgtgccattgtaaggaccgcacttctcccctgggatgagggctactccctgcagcctgggcatcttggtagacatttgaggttacagagcttgtaagggcctgagccttctgagacactgttttcaaaaggaacaggttgggtgcagtcagtctagtctaacacagactttttaaagtcacactgctcactctggggcctgggaatatttcatctgctcagctgcctggccagggctgcttacagaggggctggggcctgtggtctcaagggcagggatcataggcttgggctgagtccggcaagatcaattacctctcctgacttcaaagggaggtgcacacatgagtgtgaaggctcaggaagggcctacatggccagatgtccccagtctctctccttatgtccatttaatgctgagttcctccctcctctcaaaaaccactacttcccagagcccttaaccagcagcacatccagttgctttgagtttcccccaccctgtgctgtctctgcttccccttcacatgggctgccttcaaattctaaccaggcggcggctggcaggtgggaggcagggaggctgtggagagtctggcatgaattttccaaagtggacagtcagcctctgaatgatggagagctgactctgggtctgggggccctgctcagcccaggcctttattgttaatttagagaattcgagggaagcatccagaggggaagcccactggcattcctttccaattagaagcagctaccaactgcttctccaaccagcagaagccagagctccctgaaaggctgccccatcaccgctcctccttgtgtctgggaaggtgtgtgcacatctttagttgaaggcaaggggagataggtgctctgtgattggggggctggggagggtgagacccaggaaaaatgagcagaactttgaactgcatggaatacaattagtcggtacactgtctacagggcagacatctgcatttagcctgagacacactgggttgcctccagggctgcctttaaggtgtggccactattgctccttttccaaagccccaccttcctcacagctggcccttctgccacggaacattccatattttctgtgttttcccaaactcagaagcccttagctttaccaggaagctctgtccatcgcttggccaccattcacaggacaggcattctgtaagtgccctaagccctcaagcctcaagggtgttggtggaggcccgggatgcaggatggccggatccagctgtaccttgcacctactctgctccctctgcactaggggacatgaggaaggagacatggtggccacatctcccacagggacacagtctgcttgttaccaagtctgctctttcactcagcacctccaggtgtcaggggtggcagggccctgggctagctttgttctagagctttctagatgctgagttatttaacctgtagtacttttaggccccgttccccacccaaccctgtttgttctgtctgagccaaccaggagtcgactccactgcccttaaatcccctactgtgccctgagcatggagcagtggcctccccagctgtggcctggtacagttggcctggacagtattcagcctggggcttcctgcgagctcctccgaaggctgtcagccttcaccaaggtgtcagcaatttaccgagggatgggtgtttcgaacacccatgaaaggcagggatgtgacttctgtttccaagccatcgtttccctgatgttgaacctgctgccaagcatcagcacatttccaagcaccatggcacagaggtagactattgagggtcaggaccaacaccagggctggaagtggctcagaagaggagtctctggaggtgcatttatttgtgggagctgagaaggagtggatatttgatggggtttgggtttgagagaaagcagccctccacgggacacctgttctgaataacagctctgctgctcgggccccgctttctctgtggagccggaagccctgagctttgtcaggaggttggaggcgtcaactgctatggttctgcaggacagtaatcctgctcctttcacactgtcatctgaaagggacccaggtgaaatgtgtctgaaaacacctgtggcacacggacttcaggactcagaaaggatgccacttcaggggccctgccatctgccgcagcacaggtgaacagctcccagagagggtctgtctcactgagcccaccctctgcccaccccagagtcacacatcatgggggaagacacaaagactccaaagagtcgtggctggagcagaagtgcagccagcatcctgccaaagtgcgcaggtctagaactgccacacctcgctgtgagttgggctctgcagccccaacctctttgggccttggtttccttatttttggaactcggaggtcaggagaggttctgcctgccagatgcctctcatggcatctggcacgtggtgagcacgcagcctgcagtgtttgctgggaagcaacaggctctggagagtcatcagcaactcgctagtggaggctctgtctgaaggggataaggaagatgagtaagcccagagacgccacccagatggagaatgtggggtgggcttggaagtgccgctccatacactgcccatcgcaccacctgtggagggggagagagtcctttggggcccattcccaccccacctggatgcgttttgcagtcccaacaagtatataaacagttgttctgcctgaagcaccgtctgacgaaaaattgcccatgccatctggagaagaacggctctccaagggcatagcttgcaggctgccccaggcggctcgcacagaggcctccttgcaccttccctgagaagatctagatggggagtggggcacgggatgggactgttgctgcagtgttggaattctagtggaagcccaaaatggaaagccattaccaagtacccccaagctaaatagtgacagaaagccacctcgtgttggcgaccaaactgctgagcggtcctcagctcatcaccctcctcagcccacagccaggggaagatttggattcaccgggaagtctgagcagaggagaacaaaactcttctgcttgtacctgtgctgagtccagcctatagttccacaaactagttacgagcgttcgcttgtcccagtcaaaatcaggatcccaagggtccaaagatgctatcagccttcatatgtaaaggcaaaaacctgggacctccagaaccccaccaaatcctgtgtgagctaaatgagaactcggggctctgaacatatggccgttacatgtgcccccttctacatagactcagaacatctgctcctccatccacggggaagatctcccattggtttatttccaggctgcacttgtgatgacctttctcttcctgcttatcaagaacacaaataaatacccagaaagatcaacttccacagcctctgccatcctctgacttcacaggtcttcgaaaaagggaaatcagataagacttgggtacaaacactttactgcagggcacattttaatcccactctacctcttacctcgggcctccttatggtatccagggagcctctgggaggcatttggtaaggacagatgctctgttataaagggtgctagggtggcttggcactgtcccgtggaaggccagctttgggggaaacaggagtcccaccaggacagcagtgagtaaacgggagcatggtgccaaaccgaggggtgactgcaggttccatgtcccctctctgcccctcagccatcagctcacagaccactgtgtggaaccatggtgagctgctcacccggcgcatgccacacgtgggcaacaggatgattccaccatcaaggggaaccctcaggtctgttcttcattctctctgggaactgccacaacagctctgaacattttctctttactacaacttttaaaaagtccaccatggtctttaatcctggtgacaaatgtttgtcaagcacctactctgtgccaggctgaatgcccaccacatggaaagtgctaggctcctcttccctgctctgctggtcttgtcctcccgctggaacaagagccttgggccataaccaccctgccagctcttcgaggtcacccctactttccctttgtccttttgtgcctcctgcgtttgttactgtatagccctgctgccgtctttgcatacactcattagtcctgtggcctctgactatatttcaaccacctggcgactctcctgctctcagcctgccttggtcctcaacccagagtgagggtgtggggaatggctggcctctgggctagaagaggtgctccttagcctttggggctaaagagctgctcaggaagggccacgataagtagggatcagtattgctgatgctgagaaaatctcagatggggcactggcttatcttctgggggtttccagctcactcctcatctgctgcttcaggcaggcagtagtagctcaggtgtccaatgcctctctctgcctagccagggactgtctgtccccagggtctggctctccagccagctcctatcaggggccactttggtgccaaggcttctgagtgccctggccctgagtgtggcccacagctcttcacccagtcagtcactatgtcccgtgtgagtggagttcctcttacatccccaccactccctaaccccaggacacagcttgttcccgtgcagcccacaagctgggccttgtagtagtggtggtggggttctgcagggcactgtcatggagcctgagaacaggtgaccagagaggaaggaaagagcaacaagctagagaactggtgattgtgccctaagcatccttcctaggctggtacaacctcaggcaaggtttacctttcagaagcatgccaaggtgggtcttctctacacctcagtacacctggttatcactaggtacctcagagctcacaccacccacactcacgctgagacaagggcagtgctggcaggccaaggaggcagtgggcttgggggcactccctgttaccctcagtttggtttctgggctcctgcctggagcctgggaggtagcctcggccatgcaaagatttcccttgagatgtgagctctggaaggctcaggcattcacatcctaagcccgtcaacacctccaatccaagggagcaagctgagaaatcgggaatgtgaccttcagtgcttaattgcacattgaagtcctcacaaaagctttgcaaaaacatggagatttatgaggacaatatggtgctatcctggtaaaaagctgacatttaaattgttctcattttatatctttgtaatgaaattctttgtttcctctgcagccatttttgagtatttactaacattcagagagctctctcctgcatgcaaaatttcgagctttatgatgtcaggctgggctgtgtgacacatgaacatgaggctgttctgcagctcctgggggagttcttaccccaggaataatgaaggacaaggtttccagccaccccgttcctgcctctccctccaagaggagggtttaaaaaaatcaccaaagcttcatattttaatgagttttctttgcaatttgtatataatagattttcaataacaacctgtaattagttcattttctgctattcaattgctctgcacggaggccattgacaacttccagctgggatctttaaaaatggaaagtgctggaagactcagctccagacaatgactagaaagtgcccggtcccaccatgcagctgttagaagtaaacgattgagatgggaaaggggcagtctgggtttgaaacttccaagtgtgggagaagaaggaactggtgcagggtgcactggccagcaatcatcagttctggttcagaattgagccctctgtggtgtaatgggggacagagattgttccacccagaaccccagtgcacagatgggggccccattcctgccacccctgttcctcatgcagatgagtcactcatcagacacttgccaaggggctcctgacaacttttcctgcacagcaggggcaggtggaggcagatgcatgcactcagctgtgtttctgtctttatatagcaagggagagccaaaaaggacagagtccagaccccagaacatcaggaggtcttagataacagctttaggtcctaggaggtcttaaataacagctctggttgcatgtctgtcccaacagtcatcaccggaggccttcaaaggccaagtccagctctccagctgatactcagtcccctctccagcggcttgcaggctggcatacctgcagtgatggggactcaccactcactgggcaactctggagaggctggggagggtccccctcacagccgagctaagctggccttctccaagccctggcctctgagtctgagttctgcctccggggccctaactgtggtggcggcctttctaccctgggtattgcctcctccctcagtcaagccccttgtcccttgggatcacatgctcccctcacctgcctgggacacctttttcctcaccctctgcctagttatctctagctcggcgttcaggtatccactccgatgtcccttcctgacctcttgggacagttggtcctcctgcacccaggacgctctctctcagctcctactttgtttattgggtcatctttctgcctctctacccgctgcctctctacccaggtggcaagctccccatgggcagggcctgctgtggtcttgctcacagctgagtctctgcccagtgcttccccaagagtgagctctgtgtgcgtttgctgacctaacaccacctcatctttcatggttctcctcctcttatgcttcccaacctcaattcctcaccctttccctgtgctgctctccctgccctggtcaggttcctctgaaaggctcaggttggtggcctgcctcttccatgccactccacgccaagtgtacagatgggagatgagaccgggcctgtccctccctgcccaggagctcaccctgctttcagagagcctcagcctacggtagcttcagggcggacctgctggccttcccacggtggtcttccttccgcatttgtcctcacctgcagtggggagcttgggtatttgtggctgacggttttgctccagaggcctgccttgccagcctgccagggcccagcatggaaatacaaacccatattctatgcctataaattatttagaaggtatgcagatttgcacagccagcaaagctgacctccaggtgaggtggcaggagttgggccgggtggggctgctggtcttgggctgctgaagccaggttctgctgcatcacgagggatgtggctgtaggccagcaggcacgcagggctgaggagcgggctaagcgagagccctcctctgcatacgtggctgccggaggtaaaggtaattacgcagcctgccagccgaccagagcacttactctgaggagggttgaatggccagttagcggccctctggtcaggatgagagctttctagtgtgagttactttcatcttcaataaggcatcattagcccatgtgagaagcaggggcttccctcacacccagttgctcatccagtgattagggatgtccaggctggggatgtccagctggcctgctccagccaggctgatgcttctctaccaagggctccagctgtggggccccaacaaggcacttcctctgcccctgttttctcaaggccccctggaggcatgcagagaccctctgggatcgctggccacagctgcatgtctggactcctctccttgcccgatgtatttctccatgtccttcatgccctcaatgagcaactctgaccaaggccttcctgggtgccataccccatgctgagcaggagtgcaggatgggtgaagcagcctctatcctcagggagcctgtggtccctgagggggaaggacaacaatggcatggcacagggtgatggggcacacacagaaatcttcatcattaccctcaccgccgccatcattgacctggttaatgtttgcctaatatttactataggcaaagtctcatgctactaatcactttacattaagtagctcctttagtcctgaataactctgtgcacggttgttattcccattttacagatgggaaaattaaagcccagtttaacctctggtagggaactgtccaaagtcacacagttagtcagtcgcagaataaagattcaaaaccaggtctagcttggactctggagtccacactcttaataatcaggccacagccttgttaacccagggctgtgggcacacagaggaaggtgtgtggggcttggtggaggaaagagaaattgagaaagacctcctggaggagaagaccattgagttggggcttgaagtttagggaaatcactgtgaggacagtgagattctcttcaacggagaatgcagatgtgttgcaaagtttgtttaaatgcatgagaaagttctagaatcagacacgcccactaaatcctgactctgctacctgctgactatgtgatcttgggttagctacttctctgagtttcagtttcttcatctgtgaaactggacatagtgtacagtgctgacacatgttaaatgctgggtatcactttatacaactggagtactaagagcctattactaactacggcgatattgacaagcaaagtcattcaaatggaacactgactgtgaaccctgtcctccagcgctggcctcaggagactcacgtggaagtgggcttcttgaagccctctctatgtacttgaagtcaggacagcacccccaactctgtctctgggaggaggtggtgagactcacaccttctgtctcccaattttctttttttttttttttgagatggagtctcgctctgttgcccaggctggagtgcagtggtgcgatctccactcactgcaaactctgcctcctgggttcacgccattctcctgcctcagcctcccaagtagctgagactacaggcgcccaccaccaagcccggctaagtttttgtatttttagtagagacggggtttcaccatgttagccaggatggtctggatctcctgacctcatgatctgcctgcctcggcctcccaaagtgctgggattacaggcgtgagccaccgtgcccggccttgtctgccaattttcaattcctcccttggccactccagctttaactgttttgtgcccttgagaaaatgagggaccaagggcagtgaatcagttcttcggccactttatttgcaaatcctgtgtgggaaaaccagtgtcttcctttggggtagggggagtcactggcacccatggtcttggcttcagccaaaactgaaaccagcccataggcattgcttgctctccaaattcaagagccaagtaaattcagataaaatttttgatgaaccccatgctatttaaaatcttgttacttactatccaaaactcaggaatgaaatggagtagaacaaagcagtatccttgccatctaagctccttgtctgaactcaccctacctagataaagagccagatagatctgggtagtgaggatgcttgcggttgcttattttaccatcctgctcaacacaaggtgggtgtgaggattggctgagatagcatgtgtggaagtctggtatggggccaggcactattagttccaaaggatagtggtgtggtaaacgaaactgcaccatcccttcactttgcaacagagatggtgaaaaaacagatgtaaattcaccaggtgaccatatcatctgtttcatagagttgccctggctgtagtggtagtgctgtagatgaaaacactgttttcctttctgcttgcctggagcttacacatgtcagaggtgaggaagggtgtctggctcccctacattcagcaccccaggtcctcctgacaccctgcctgtgtggtcaccggaccttcacacgtgaagccctttatctgctagctgctcaaaaccttcccatgcatccaacacattcgtgggctttgatctcataggagtaattaaaaggacaactattttctaaaaagcagaagaaacttgcaatgaatttgaagtgagaaaaatccttgttttagcaacgtgttttcccctgatcccaacctgagcactcagaacagtgcaaaaaccatgcatcatcaagaagctttttagatgagcaactttgaggttaatttactgtgatgaacagacagggccagcacacaccttgcttatggtgaccctggagcctgggtctctgccatggcagggacaggtggcactactccttgttggggtggtggggggtggcgtggggaaggagaggcagagggcactgctggagaaggacactgagcctttagttcctagatcagcctgtggtttgggaagccaaaacaatgcaaagagaacgtttagttgacaaaaggaggaagtgggggcaccctcatatttcattcctgtccctgtacagagagaggcaattgggagccttggctccatctgacaatcagaaagagacttaactgactcccatgactaggcactgcctgccaccctggaggagagtcacctgttcctcagagccaggaagggggtacagccccatcacgaaccagctcagcacagacatccaccagctgtgggactcctagcatcaccctccaccagctgcagactgtggcaagcatggcccagccagggccaggccagctgcatgggaagacatgattcaggagaccacccccacaaacctcaaaaactgataaatacaacttccttctctgggtacaacagccccaaacccatcatcctttagtaaagcgattgactccgcatcggtaggctactgagctggagtcaccccacagacctcaccctgccttatacccaaggacgccagcaaaatagagactagaaaataaaatgctaatgcctcaacctctgccagcccatcagctctagtttttaaaattaaatccagaatgttgttgctgaaatgtttgagatattactttctgggttttagtgagatttctttaatgcccatcgattgctgggtaataacttgtacctatatgtctcatttcaattacctatttaaaattcgctgaaccataaatctattaccagagctatgggaatttagtttagagttcctgtgactttgaaaaaccattgatccccatatgctccaagtggctgcatgtcaagcctttatagtgggggttaactcattttgcggcttccttaatggctgtgagtttacgttttattgcatatctattatttgggctgggctgtgatgaatggtttggctgtctggttcaaaacaagtccaaggcgacagcagaatctaatttgctttaaaaatgatgattataaagctttccaaataataatccaggaacgaagggagctgacaccacattgctctgtatgagacatgtggctggaggtcaggtaatgacgtccttccctttccagggtagctcatgtttacaatgaccttactagggaagctggagaggccttctctttcatcataggcaatagggatgcttccatttccttgagagcaaagccaagagcatgctgtttggccccagacccactcatgggaactgtgctcataaagcagaggctgctatggtaccaggcaccaagatggtgcccaagcagtgctataatctgcttgatgacggcatctgggacattaagtaatgatgcctggtatgccccacaaatccctgaagtccagtcttggcctctggctctaaaaatgcactgagcttttccttcataactcctttggcagaggggtctaggctcagagagtgtttttgggaatgtcttggaactatccccagagaacatgttgctgctttcctgactcagagagctgctgttcctgtaacctgccctagctgctcgagcctactgttgttcatgttccatggaatcatcaaggagtctcagtgaggggaggtgggtggggaagatattgccagaagtggactccgagggcaggagagagggtcttgtccagtgacatgcaggtcaatgtataacaaccggctccctagagaagaaaaaatgtccccccttcccctttttggtagcatatgtgtggtgtgaatttctatgatgtaaatattctcaacgtggccaatttaaagcgaccaagtgtctaactgtttgcttgtaaaattcctgaaaatttaacaatgagctctcatgaaccaggtgtggggagttgtggatacttccacacattccaaatgcatttctggaaataatctctttggcccacaagacaaacacctccgcagcaggataagcctaccagtcactctcaccttattatgaaccaacataggcaggtatgagtttgactagtgggcggggaggaggatgacggggaccctgcacagtcacagtaaatcaagcaaagctctggaacctggggtggactttggtactaaggatgatatgaactggaaaggcccctgcaaccacgtcaagctcatggacactgcccatagggaagaatcatgcttgcttctctcctcttatgtcatccaagtacctctctatttgccacaagagcccttcttgccaacaaatcacaaggatccctcttcaggccttgtgaaggtgtggaatagcaacagcccaaagagatgtcactctgaagcaggaatactttgctggaaaacgggagtccaggtaaaggctggggttgagggaggataccaggctctgtggctcagggtactcagtgcccctgggggtggggtgggcttgcacccacctcttgaatgccagggcttgcacttaggaactgtgagctggcaggtcacacccaagggtatatgcattgcccactttaagcagagcttgaacatcttctaatgtaaggggcttcatctcttttgggccaaggatgtcccctctagtctccagcgtgggcccagcactgccctttcctctcctctctgctgacccctgcctggagctacgaatggctcttgtatcttgcatttcttgtaagtcctgtcccagcaccacctctggttaatgtaatctcttggaagatcacctcaagtaaaagatacaggtcctgaaggcatcccatccacttgcatatgcatgaggcactctttggaggggcactcagagtacctcctctgttttcaaacagcacccactttcccttcttctccagggatcccctgcctctcttcacattggaccctcactctccattgtccttgggtagtcactgctccctgccgctgcatggccaagcctccaggccctcctgcagggtgtttttctccaggtagggctccccacatggccaggccctagcctgaggatagccctaaaatctgcttccttctccttcagtcatagaacccccaaagggtgttcacagtgccctcacagctatgcttcaattacagtcctgggcccctcaaagagcgagaaaaatctttattaaaaaggaacagggcaagccctctctggccccatccactctccgtttagtcttttcttaaagctcaggcttgttgcagaacaaattcaccagctttcctctgtataagaaaccaacctgggagacaactgaggacagactccaggcacccaacagcattttggtgcagaagcacctgcagaaataagcccttttcccactgggacccaacttacggaaggccatgtagaactcgcggagggtcagggagctgtcactgttgtaatcgtcaaatcggaggaggtcacctggtgagcaaccaagtaagtcttcatccaggtcctgcttcttcagcacatgctgtggggtgaggaggagaacaaggccagaatcagatgagtttagagtcataggcattgatgaaaatgactcaggccaagagggaatccagggacagctcagtgggccttgaggggtacctgaagctctttgattttgtcttgtctgactccttcattttatggatgagaaaactggggttcagagaggggaagtggcttccccaggttcacacagtgcttggggcagactctagactagagctcaggtgtgtcttttccttgtctaggcagacagacccagacagtctaagatgggaatccttgaggccacctgctctactgctgtgtgctatagatggggagacaggagagaaaagaccccatcggataaacccagcaaacagtggctgaactcagtgtggggacagaggtctgccagcttccagctgcatagagctggaggtcactgctgcatcatgcacccacccatcagcccttacccatggcaggcagtgctgcctggacacagcacactcccagacccctccgttctatccacctagacctgagcttcccccctgcctgccttgtcctgcccaggacacagatgtccacccttgtgactctggcacggaggctacagacataggctctcgtaaactcctctctggttgtggtctgagccataggacacagaggctgcccagcatgatcagccacacgtcccaaggtaactaagggtagaaattctaggcaccctcactcagctggagctacagccagaagccagtgtgctcggaactgaaggtcttgcagggaaaatgctcagaaggaaatctcagaagaaagaaaatgattttattttattttggtgtggggggaggggggcagaggcattttctctttatttaacattctcagcttggtctgctgtattaaaggcaatttaatgtgataatgttaaaaaaatgacccttcaccaagcaagtaagagtgttcgataaaagggagatcaaccataatgcctgagatcaatcttccaaagatggaaatttccctttgtctatttctgcattggaaattgattaactttttataggactgacaagttcttccccagcacctttgattcagtgtcaaggaaaggcccactttagccgggctctgcttggcagatttatgaaatggactttaactatattaaattttaaagaggaaatcattgtccaattaccacgcttgttaatggcttcaggtgcctcaggccacatatctgccaggttagaatgaagtgcctggtaaggctctgtttacctggagccatgtgggcctggataccaagagctcatagcagcttctgttcaagacaagctgatgccacctgcccttggtgctccctgctcggtagtttgaggaattgccaggtggttcttcctgcaagtagctgtaactatcaggacctgggattttcccagagcagcctgagtcacctgcaggtccctggccctgcccctcagggtcttagccagagctggggcctagtgctgatggaggtggtgacatgctggcagggcggttgccccgggggccatgggcagcaagcctcctgggatgcaggccttgaatgggcttgcgcgagccactcaggtatgagtgaacagagcagagtcatctgagattcccaacgtgcttcctgaaagcaggctcaggactggctgggacggagggcctatgttccaaagcttctggtggctactccttactagggttctggaggtacttgttgtccctacagaccttgaaggaaccatgtggtgcctcttggtgggagccattctctccagggagattccaagtgccctgaggagagcaggtgcatgcaagtcagcctgccagggtttcatctcagttccatcatgtcccaggcagtgaacaactcaggcaagttgtctgatttcttagagcctcagtatcctcatctgaaaatatctgtgaagtggaataatagtcgtcccctccttacagcagaggatggtcgaaagatttaaggaggaaataataataataaaaatgatgatgatggcaacaatactgatgacctctctattgaaacacaccatgtggccaggcacagtggctcacacctgtaatcccagcactttgagaggccaaggtgggcggatcacctgaggtcaggagtttgagaccagcctggcaaaatggtgaaaccatatctctactaaaaatgcaaaaattagctgggtgtggtggtgtaagcctgcaattccagctacttgggaggctgaggcagaagaatggcttcagcctgggaggcagaggctgcaacgagccaagattgcgctactgcactccagtctgggtgacagagcgagaccatgtctaaaaaagaaacataccacatgccaggtaccactctaagccattcactatcttagctcatttaaccctcatgatgaccctgtgaggttcacagctgaacacagaggcacagcgaaacgacattgtctcccaaggtccactagctcatacatgctggacgcagcacttgaccttaggcagtttgactctaaagtctgcattctttgccactatcctacataacaacgaactcttctgtgtttattaatcataggtcaagggcctagctcaatgtcaagcacatggctcaatgaatgttagggcactccccaccccacttcttcccaatgaccgggccacagccttgagaaggtccctgtgccatgtttaagatatctttaaattggcatcaaaggtgggaacctgtctttattatccatccactgggtggacagtctgtggtcacaagaaaaaggctgcccaccgccccccaccacccaactcagggaggctgatctcactctccttgcagatcttgtacctgcctggtgcagctctagggctacagacccttagaaacaaaccagtaagcagaagtaggaatgcaggcccctccagcccaccccagcttttctaccatcaggaccctacaggctcctccctgcaactggcagtggctgtggccccagtgagtgaggtcactctttccttgctttctatgttgcagacactaactacccctgctccaccttgtagctcgacaaaggacatgtgtgctgtgttgaacactgcagtctcaggggagggaggcaaacctcagggtgtaatgcaagtgttttcccaaatgagagcagggcttggtgggggttgacgggtagacacagggctttctgcaaacaagcagtccgaggtttgggttcttgatctttggatactaaggagcagtgatgtcctaaggtagaagacttggggacttccaggttatagctccaatggtgttcaatggaaaccaagcactgcttccttgtaacttttctgctgagtaactaatcctactcaaggaagaaaagattgatttcctagtcaaaacatcagagaccaggccctctgaagtgagttttttgccagatagctgagagggcctgaaagcttgtttgtaaatagaggctaaaggtggctggtgggaagaacctgacctcattttgtttgtgagatgttctcagaggtattgaacacatgctcttagacaccagggggccggggtgggaaatggaaaactggattcctccatcatgtgactttcactgaacacgatgcccacctgagccagttcggagctgctgaggtggccattgccatctgcatctaagtccctgaacagagattccaccaggaggcgcttctgggaggcagggtcttgtctgctgtctccttcttggagtggctgcagacgggtctggagtgccagaaggacattcttcaagcgggcgtagccggccatggtgcacgtgtcacctgaaagagaaggtgaggttattattttgagacttatcccgtggtcttgagagaacattcttgccgctggtccattcatctcactcacaaatagccaccaggcgttcactatgtgcagtgcacggtgcaactgtcgtcgatgggacttgtttgtgttctgctcaccaatccatcccataaatattgatggaacatggaatgcatgctacacatgatgcaaatgctggagggaatctgtccatctgacaaatatttgttgagcaccactacaagccagactagagtgactgccagatggaatgggaaattcttccagcggaatatatagcggcagccccacagaggctttaggaaagctacccccaattccattttgtaatcactggtttttgccttaatcctaccttaaaggctgcttttgaatacttggcctcctagattagggagttttagttaacaggactaataagccctgcttatgttaattaggcaccctcccagagctggattacttcaaaacaaacatatacacaagtctatgaccaagaaacaaaaagaagctttacaacgttaaaaccgaagcacacagctcgttttatcccaggcgcgcttgctgaacagcatcagaaccatgcagtgtttggggaagtaaagcctgggatgcattgcagcatggcacagtttatcttgctggtgacgggcttctaggatggacatcacgcagggcaacgcccatacactgggattgcaggagtgtcagcggagagggcagcccctccagccccacttcccgactccctgggggatgagtacttccagcgcctggctttgctgaatcctggagaatacgcatgggctcctcactgaccattccaggttgaaggccaatgggttgctggagcctggggctcttctccttaattccaaggccagtttagggcctgagataatatcccagagttggagagtcaatagaaagaagtgttagagagcatgagctctgaggtcccctgggtttgagctctagctctgctgccatcaggcatgtagccttgggcagggtgcctcagtgatctcatctgtgaagcagagataccagtgcctcccacaaggggttgttacgaggattaagtaagatgtgcacatacaggcctttgcaccagcatggcacccagtaagggctcataacatgatagctactctctcccttgacattatgggaaccacatttactgaagagcaatcatcagggaagctactggggggaaagggatgatggggaagtctgtctgtctgtttctctcttcctcccttcctcttttcctccctcataccctcccttgataagcctggacagcccaaccactttttcttgtgcttgtttgtatttccagattttcttccaatttggggtcaattgatttctgtcagaaacagatgcccattgccatttcctcctgcatgtttatttagaaaaaaatcaattgttgtgttcaatataatcagatctatttgctctctgggagtcttcatgctctgacaagaacgcctctctcccacaccctcaccttgcttgcatccctcttttgcctggtaggatattgattcctgggggttcttggggcctccagttggcaaacccaattctcaagtctgtagagctacagggcattgaaaatagtggctttgtgcccctacaaaacttgatgggtttttcctttttctgggcctggataaggataagttttggggaagaggaggaatagttttgcctgagtctagctcctcactccctgaaagaggctgaaattttgtcctggcaaatagaccagaagtgggggtacagaatgaaagtggaggtggggccagctgctggggtaaatggagatggatgtgtgcctgtgtggagggtctgcaggagccagcatttctgcagcccccaggacttcctggagtggggggcatttatacccagatactgaaaaattgatgtacacagcaggtggatatggtgtcaggaagaggctgtactcagaaacaccggtggacaatcaggctccgaagaacatgctgcagcagggccacctgaaggtgaggacaggctgggtcaaaagggcaggatgccccatccttgcagatccccccaaccttcctcctggaccttggtggggcgtaaaccacttctgagctgcctgctgccctgggcaagattcctttctgggagcctcttatttcgtctcaggaccccagtggccaggctggcctaagcatggagagcgccctgggagttcttggggtcaccagctggcaaacccatttctcaagtctgtagagctacacggactggcgtccccctgtgagcaggggtctgcagctggacaacacctccaacactggcaggtgggggaaaccatccaggtgggtcttgctgggatggaagtggggtgctgcagcatcctccccaggctcggccccacctcacatcctcacagctgcctgtgagcgcagacttctggctgcttcaccctggcaactgcccaacagacaccttctggtcaggaaggtatgtgcaggtctagaagtcaatcatctgggggaaaggggtgggccctccaggtctccagcatcagctccctgagcccacggtcccaccccctgctagggcccacactgtccaggccactcccatccttttaccagtatttatttacatactgtgtgcccgatgctgggcagcctccagtcctgggcactgtgggtgcctgtggtgggaggccaagggagggatgttcaggatgagacctgtaggaggaggagttgtgggaggaagcagagggaagagcaggccaggagcaggactgcgcgtgcaggagccatggtggggcacgtctggagactggtgaaagctggtgtggctgggctagaggggctgagtcaggtggagagtgaaacaagacaggcaggagagggcagtgggacaacccaggcagagcctccaaggccttggggaagtgtgtggcaccgtacatcatgctgttcaaaacttccttcgtcatttcttccctttactgagggcactccatgcctgggccaagcttgccactggggtcctgagatgaaccaagggattccaggaacagaatcttaaatccttctttaccccaggagcaactgtgctttaatgagttgcaagagagaactttgcccaaacttaaatcatgaagtcatttgtccgaaattactgagctcctctggtgcccgacagcactggggaagggccatggaccctggaggaaaggcagcctgatgctcagagctctgcttctgtgcagatgatcactcgagatcccaaagtccaaactcgctttttgggaaggcttttgagccttcatctccaagggctgccctcttggtggctccctgccttcactccctgcctttgtcatccgaattccacagggcttgaggtggagtgggggagggaaaacttccttccttgccttcttccagcccccagaggcagatgccccaaagctgcagcctccagctcagtctccctggatagatttcctccttcacagctggccttggcttccaggatagatattttcctagcaaggtgtgtcaaagtcataggttaccaaattccagttttatttttacattcctgccccctgctggtttcactgtggggtcagataggagtgacttagctgtgtgaagcactgggcattttggacaccaccggacatgtcttcagctaaaggctccctcccctcttccagcttcaaacatttgtctaattctagaagaaatacatgcccatcagagaaccacttggaaagtgcaaataaaaataaagaaaaagaaaataaatcatcccgaaatccacctcccagatgcaggtgctgtcaacacactgctggccagatgtgaagctgggccctctccatgagtgacactgagcccattattgaaatgagctctttcacgtagtccagccctcgtctgctgtgcgggctccgagacctgttttctgatcttcctcctattcttctcaaattccaatcattggctgggcgtggtggctcacgcctgtaatcccagcactttgggaggccgaggcgggcggatcacgaggtcaggagattgagaccatcctggctaacacggtgaaaccccgtctctaccaaaaatacaaaaaattagccaggcatggtggcgggcgcctgtggtcccagctactcgggaggctgaggcaggagaatggtatgaacccgggaggcacagcttgcagtgagccgagatcacgccactgcactccagcctgggtgacagagcgagactccgtctcaaaaaaaaaaaaaaaaaaaaattccaatcattttgggcaagaaagtgtcaacacccaaggttcatgtctttcttatcttcaccccagtcagccctgcccacctgcccagcaattccacacaggtgactacaagagaggtggggggtatggggggaccaaggggacttcagcagcactgatcactgggcatgctcctgcccaggggcctggcattgactatccccctggctggagtgctattcacccaaatctccacctggtgtattcatcttggcctctgcttaaacatcacctgatgtaagctggcaccccttaccttcatcactctccgtgccctgacactgtgtgtgttgggcctggctcccaggtagggagggaatcagatctctccggacaggggcagggtccagtcttagccttagccttgatccacaggatactttactccttcggagggaaggtccctggggtgtgtggcagaggcttggggaccaccccactcctccctggtgcccctgtgggtgatggtcaagatgatgttgagaatgatagtggcaggccgggcgcggtggctcacgcctataatcctagcactttgggaggccgaggcaggtggattacctgaggtcaggagttcgagagaatggttcgagagaatgccataaggagccctgagctggggcccggatcccattgccagggcctctctaactcagcctgggatggggagactcagaatacagttgaacttcagcattgattaatccggaggcatgactcttccagagaaaaggtgggatgcttgcatataaccttgacgtccatgccttgaatgaggctcagcaggggctgccaggttgggacccgcaggggacctgcttcatgagtgggcaggaccgccgtgatttggactgcacaagtttctgcccacatgtttggaaagtcatttcagtgttttctctgagtcttgctggtttccaggtaaagagaactttgtgttgttctaaataaggggattttgtctttgcctttgtggtaaccttggctaagtcaagccttacagtgaggtttggagaatttcagggaagccccctccatagctggaaattccctatgctctgaacacagctgcgctttctcatgctgccccacccccttcctgtcttcaggcccaatccacctcgtctgtaggaagcttgtccacttacacacacacacccacacacacacacacccccacacccacccacacccacccacacccacacacccacacacacacacacccccacacacacccacacccacacacccacacacacccacacgggactgccttctccctcagctttcctttctgcctgctatgaaatcctttctgagtgaggcttgccccagccttagtttgggctcccccaaagcagtccctgagatgaggatctaggggcaagcagcatatttgaagatgatcccaagaagtgctggaaggaacaggaagtagactgggaagggagaaaagccaacaaagggttcactcatgagtgggttgccgccgtgggcaatgggggttcaatcccatggggtcctcagagggactgtgtagaacacaccgcagaattgcttcactgaggtgggagggagccaggatatttttctactgacttccatccctattagctgaggttgctcttggaggaattcaccacctccagctagcagttctggacctcccaaatgaggactgagtccacgcctgagaccggaaaatgtcctcaggctgaagctgcaggtgcctgggattggatgctcttggcaagtgttatggggaatcgtccatccaagctgcacatcacctctggggttgactgagggaagctggatgggcggctttcagcatctgctatgtccccttaatgggattacatgttctgagcaggcaggagttgaagtggacagctccccatgcagcattacagtatgaaatgcttgttgaatgagaggaccagagtcctgtggctccagggcattttcatgaagctggagccagggtgatgggctcaccctataacaaccttgtctaaggtcttcagggggacacagacttcatcttaggctgccgtgtctacctgatattaacactgctaatgacagtcaccacaaggtcagacagaacactgggtggaggatcaggagaccacctgacttcagctgtgagaccttaggaaaggcattcactcccctgcccttcctactcctattccctatcttcacatggggataataatagcttcttactgccttccagggtcatagcatacaaggaaatgtgaggacttagcaagtggttggcgaggcctggggtcttctcttggtgagatgggctcaaagccccaagggaggggtatggctcatttgtctttgtcccctttactgtggggcctgggacaggttggcaactaaatcagtgctcatggctaaacagaagacagaagatgtcctgatcctctccctccctcctgaccgccagtgcacatgccccatctggggcttcttggggagagaggctgcatgtcctggtaagcctgacactgacagcgtcattggcaggctctgtgaagggctcagccaccttcctgccagcctgggtgccctccatgccacagggctggcctggccagcccctggccctggcctcaggctccttgccagcacatgcgtggggctcctcctgctcccagaccaggcctgctttggcagataaaatattgatcagcttgccgaggagcccagagtgtgatcctattttcatgtcagaacttggtaatgaactacatttatcaagcccgttctccatgagaaaggtcagtcgcagatccggctaagttgttatgacacctcattaatctagttccctcaataattgtccctctttgaagattctaatgttctctcattcccactgcactcccttcacacagaggaagatgattatagcaggagaacaggcacatccacatttaatttttgagcaaagggagataggtagcaggtagcagtctctggaattaaatgtccatcaaagaaacactttctattgcaaaacaaagggaagcaagggagacattgtaaatattccatcagccacttgtgcccctgccagactgtgctcaaagggaccatcttcattctgtggcaggtgaagctcctgtaaaaggcgtgggtggggctgggagactccgaagagtcaaggggagggaggcgttgtgtaatgtgggcaatgtggaaagtgctacacaggctgtcgggagctcagattctgagagggagacaggccatgtggtcaaggcccaagccttggatcccaggggtgaggcacctgcatggtggtggggcgggaaagtgggctctctcttgctgccccgtcctactctctcactgcaaggtgtttcttcaccaactccttcagcctccctcgcctaacacaccaatcctgcctaacgggcaccctcgtgtgctgccctgttctctcttgccagccttctccagccttcaatttctgtgactttttcatccactgtggatcatcaggctccctgttagactgtgagctcctccagtgcagtggggccttgcttacaggtgtacccccagcacctggcccagcatccacacatagaaggggctcattcagtgtctgttaccggtatgactgtggaagacaggtggcaggtgggcttggagagtggctacggccctgccctgaagaggagacaatcccagccaccctgcaccatggtgacgggtctggatctctgaagggggctagtgcctgtgtcacccatcatgtcagttccttggggggcatgctgaccatgtggtacatgtggccatgctcactgaagcccagacctccatacctcacccagtggggacaacccaaaacctgcaatgctgttcccatggagtgaactccagcatggccaggctaggggtggtggcaaggtggtctctggacactaggttgcatagaagtgtggtgggcacaaggcagctgcctgggaattgcttctggagaggaggaggaaagcttctgccctcttgtcttggcattgctggtcaggagagccgtggatcaccctgtgaagaggccagctgagcgccctgtgcttgaaacagccacccaggtaaggaggcctgtggatgaatttggctatggcatagcttcaggaaagaccctgttttttgccccggctctgatcagtaaatgaacagagccgaccctgtggaccatctgtgttcttggggacagctttatacacaggcagaatgtggggtcaaggtgggtggggggaatccccaggccactataagaccacagccccatgagtctccggggtgctggaatctcccttcttggggtcactctactctcaggagtccccctttgaagaatatccaaaatgtactggagaggggaacgcaggacatggctcaacatcatgaaagagctcagctgccactgctggaagcaatccctttggggaagggggcgtggacctaggggcaaaggcatggggaagaaagacttgcctgggtgggggatggtgggtctgctctgaatgccaacaaatggggtgaggatctctcttcccaaaccagacacaggccatccctgcagaaaccacatagtaaccagccactctctggagctgcagtcactgggctccagcccctcttcaacctggcagggtggctagagctcagatccccaaacctcacctgagaacccccccagagaggcccaggggagagacaggacatgcccccatcctcttggctgcctgtcccccagacattagcaacactggttcccacactttccccattagcctggtaagtcatgtcatgtgctgccccagcaaagcttcgatcttcaccaccaaagcaaaaacctggcttaattgtctggcacccatgttatatagctcagtgcggctgcgttacaggggcctcagttgtgatgtgtcattctgaggtctattttgaaactgctaagctgcgcaaagaacaagcaggattttactcccagctctaatttaggagctgccgtaactttgctggagtttagcttaagaggaacagatgtttaacttgatgtaaattcatgaacattaacaatctttctgctgccatttctgggaaaattcaattaacaataaatgccaaaaccaatgggcttatctttaagatatattttagctaacatgatgtcgtttcactgacagtgttgactgagccacaaaactctgaaaattccaagagactgttacacacatatgatacagtcttctcacaatccccaaacaaacatggacaggtgtactggaagtcgtgccacttggtaacccactgccgctgtcccctggggtctgtgacttctaagtgagtgggtcactatccccttctctcagcaccctgtggcggtgtttatgcctgtcattggcctaaaaccactggctactctagccttgaaggccctcccagtggtcccagtctggctccactgacttcccactccctgccagaaagcccgcccgcagagcttgctcccaggtgccccactcctggcagaccctctcttcaaatctgacttttctgccaaggcccagttccacagagctgtttccatccattccaaaccacacactctggaccttggctctgtgagcctggaggggtttgtccttgtcctatctcctagactgagcttcttaaagcaaagactgctcccagcatctttgtatctcttgggtgaataacttcacgttcttagagaacactgctaacagggacctacggtgggcataccttcaccaggtgctgcagcctgcccatggcctggaggaactcagcctgcctcctgtcccttccatcacttggagctttccctggaacactcctcactccttagtcccaacaccagaaccagcaatgagccaaatgcagtcattagacagatgggaaaactgaggcccagggtggggaagggacgtggctggaccacggggcagactagtagcagatccaagatcagaacccagatctcctgaccctggtctttcaaccacataacaccagggcctcaggaaactcaacgaagaacctgtttactctggctttccctagaggaagcccaggacaggcctagctgaggaaacgcaacggtatgggagagctgctatagattctcacctctagaaggtctgcaggtctgttagaaacaaattttcagcttctagaagggtagcaagtatggggtgaggcccggaaagctgcattttaagagtctgctgattctagcacagatagtccactgagcacgctttgggaaacacagttttagcaaacatgcttaccttccccctacctgacagggctcacttggccaccttgcttgagagctgactggctctcaggaggggcctggaagggaaaactaccagggattaaatcagaaagagaaactgggtaatagctggagggtgcccgcctctcagccaagacccagagacagagccgagcagttccttccaacatcctggctcttgcttcccggtaaggcatggatgtgctggttcctctaattgggaaacagaggccagtataagggcttcagggggaggagggcatggctacagcactgggtctgtctcttgttgagctgagctgacagccatcacaggcagctgagtttgcggctgaaagggttggttctctcaaaggtcacctgctggcatttggccatgccaaggtcctgggatcctacataaggattttggcgtgtgggtactctagcatccagggactggctgagggaaatcaagtggttacagcctcttagatttagcccctcatcctcccaggattcaaagagggccttgcatcaaggctgccaaactattctcagtcagtttccatctggtcttttccctggagtgtccatatttgtcatctcagctaattttgaattttctaggttgaaggtacaaggctcactttggaaccacaaacagaatctgcatgtctaaggcttgacatggccttttacccagggttaaacacacacgaggccatgcagaccttgcgcctggttccccggctgtgctgcactggagcagatccagccgactccaaggctggtggcaatatccacctccacttgcacctgaatacgcagacaatgcctcatctcaatttgcaccccagcatcaggtcatttaaattaacaaaaccacccagacctttgttagataaatggtacatttgcttatgaatgcctggttcaattgatgttgctatacaatctgctgtctgacatttacaatcctctcttttattcctattagagaaagcaaaattggttggatccctgggagagggatccacatatactttttatggttgactggcagatctgtcaggtggccccagagtgaaagagcactgtatgaaaacatgaataaatgctaaagctctcctggtattaagaactttattttttactattgtgttagtggaaaacctccaccagctagattccctaacaggtcagcattccttgtggaaggtgggcaacagcttcttatgaactccggctccccctttgccctgtccagcagctcagccctcctcccactctccctgtcaccagccccaagagcagaagcagtagtgctggactagaggtcagtcaccaggcagggaagtcggaggggatatgggagtgtgggtgccttctccacctcctgtttaattttattaattttgtttccaagacttccttgggaggctgcatcctcccaaacatctaactaaggggaaaaggccggctgtggagctggcagtaactttgctcagcgtcagcgaggcaatggcgtcagtgatgtccagaaatgtagctgctttgagcttgagctactgtggcctttgagtggccactagactgagtggtgggcacatccatagagacacggccgggtctgaggctgtcgcttcctccgcgagtgatcaagatgagggttactggctccagactgaggctgatgggtcaggcaaagggagcacttagctcccacatggactcatcgcacatgcaaggagtctctataaacggtctcaacaagggcagtgctgtccccaagaggcgttttggaattttgtggggatgtttttggttgtcacaatgattggagggccttggtagcacttaatgggtggggccaggggtcctagcgatcctgaccttcacggtaccatcctgcacaaaaacttctgctggcctggtgtattagtcggggttctcttagagggccagaactcaaaagagagagagagatatatatatatttatttattaagtattaacttacacacctgtaacaggttctgtttgcagctctcacaaggtcccacaatagactgtctgcaagctgaggagcaaggagagccagtccgagtcccagaactgaagaacttggagtctgatgctcgagggcaggaagcaaccagcctgggaaaaagatgtaggctgggaggccaggcccgtctctccttttcacattttctgccttctttatattcgctggaagctgactagattgtgcccaccagatcaagggtggatctgccttccccagccccctgactcaaatgttaatctcctttggcaacaccctcacagacacagccaggcttaatactttgtatccctcaatccaatcaagttgacgttcagtattaaccatcacacctggcatctcatctgaatttttaaatgtctcactcacggcagcaaaacatctggttactattacttgagcctagaatctaatgtgttacacgacattcaccccctttgccccgggtttggcaaaggcattccaaggatgcacctctgctgtcaattgtagattctgtttactattttatcaagaatcattcaccattttggagaatcccatctctaaagcgacaacacttgaatattcaagttgtcaacataacagacgtgtaacaggttctgtttgcagctgttgtattcttagggttccacgtgtaggtgctgacatctggcctccatgagtgcagctggtgcccagatatttacatactgaaaggtttattttatgctcatcacttttcctgcatttctcctttttatcacattgtattaggctgttcttgcattgctataaagaaatacctgagtctgggtaatttataagaaaagaattggctcacagttctgcaggctgtacaggatgtatagcgctggcaacagcttctggtgaggcctcaggaagcttttactcatgaaagaaggtgaaaggggagcaggtatctcacagggcaagagcaggggcaagagagtgggcagagagatgccacacccttttaaacaaccagatctcgcaaggactcactaccgtgaggacagccgtgaggggatggtgccaagccattcatgagaatcccacccccatgatccaatcacctcctaccaggccccacctccaacactggggattgcatttcaacatgagatttcagggtacaaatatccaaagaataatacaccacacatatatgggatagaacttagatatatccctcatatcaaatatatgtcatatttgatgacatgtatccatttcaagataataaaggggggctttacaaaagatttgctataaaaaggtggctttaggtctgacagggggtaaagacaagtgatttacaagagcaacccaaatctgtggccttacttcttttcacactcccaggtactgtgatttttaaagaacagcgggaacagtgtgggagtatgcctgtgtgtgcatatgtgctgaagtgtgagtgtgtccctgtggttatgctgtggacacacgtgcacctgtgtgcaagctctgccagcatggtcaaaaacaggggggcaggggattcagggtcatgcctgggggccatggaggctcctggcctctaggaaggcagcccacagcagccccagaggaagaggcatcacctctgtgcactggggtagagacagcaagccccgctgagagggaaagcagccccgcataggtcccggcagggccttctccagaactgggctctctcctgtctctgttctcccaagacacccccaggcagggcaggtgtgccctgaaataacaggtggggagactggggcagtagcagtttctgagcgggcgtctcacaggcctggcagctcatggtgtttttctctcctctgtgttgatcttcagcttctgagccaagccaaagagtcactgggttttcaagacaacaagcagagattctggtcctctgatgtgaggggtgcctggactgcaaatcaatgccattgaactgcagtctccaggaaggaactccccaaatgttaacacattccacattcacctgcggaaggggctcctggggtcatttactttagaagaaaaggtgttacagggaaactgcctcagaatgctctcagaaaacgggtctgctataagccggcgatacgtgctcttacatgagcttggcaggaaatggcatttcagagaagaatgacccaaacagagggttttagacctgagacggctcagagaaatttcctgaggtttgaagatttatcttaacctctcggacttgaacgattgacagtaaatccctggtcaaaataaaacaaaactccacaactctgaaagcgaacaccagccatttcgggagatctttggagtatttccagggcttgagcctctgggaggagagtgagaaggctctccttccccgtcacctgcactgctgttctgaggattatctacacgggaaacttatcaaaatgtgggcagcccgtggagggagctgcagaaaccctcatttctgtgaaagtcggtgccaggcggaacgtgtgggtttttcaacctgaagcttctgagctgatgcgcaggctgtggtctcagctcacatccagaatgcagggcctggcagtgtgagaagccggggctgccgagggagggttggcagtggggataaacagcaaaccaggtgtgggtcctccgagcgctcagaaagccctcctcttccagcgatggagtttgattccagacacatctcagccataatgcatctgcactgctcactccctgaacaccgggaaaggagcgaaagcagcagcctgatgggatttggcagatgtgctggctctcactagactcacacactgcgcaatgactccagcctgctctctgcctccatatttatcagttcccagagcctgagaatggcctcctggctgccttgtctgtcatggtaatggattcagatgctttgagaggttcaggatccacagttgatgggagtgacagggaccctcttggattctccaaagaaaagtgtacacagctcagagaacacctggggccggagaggcggagccagtggcctgcagcctgagggtcttcccatctgagatcccagcaggagccctatgcacctgtgtccctgtggatatggtgcagatcacgtgtcacagaattagcatgttttgcttcagaatgtgttaacctgtcttctgacttatgctttgaaaatgtggttaaaatattcataaagaactttccaggcagaagggcaaatactgagaaatcatctggtaagtgaggctcaagaaatgccacttgatgatgtcatggctcctaataaaaacaggagccatcagctaaataagccaatcacactctcacctccatttttgtttttaccacgaatggtgctctgtgtttggtgaggataacactctggtaagagtttcacaaggctggggtgagaaactctttcatttcttttggaggctcatggcacccagtataggctcaggtgcagagaggacactggagaataggtccttgcacgtgcaggtgtcctctctctctctgtctctctctctctgtctgtctctctctcatgcacacacatacacacacactcactcacactctcacacacagctgtggatctgggtgtgcatcccagtgacactgcacatgtggcggcagctcagccccagccccatcctgcaccctgtttgcctcttggaggctcctatgcagctggcccatcacaaatcccaggtcatagtgcccaggagcagggataaaggttttggaatgatgtagtccaggctcctcatttattgattaggaaactgaggccaaggaacagtgagaggcctggggccccgggcaatggcgatgcagccaggccgttgcctgcctgtccttttgtgccccacattcttgttttgtttttctgcccatctccacctcctttctctcctgcttccagccttccagctctaactgtgatgggagaggacaggaatctctatagcacaaggaccacgttgaaaccctgcccaggcataggggccccttactgggcaaatcttattgtcactaacacactggcacatcctgccttttactgcccacagctgtggctcagaaatccagacgtctgggctggtcatctatctcatccagggctgagaaatgtagggaacacaaagatgggatttccaggtcttttaactgacaggaatgacctgtagccgattcccagagcaaggtaccctttggagcaagcagagtcacacccagcgagggcatctccacgtcaggcagaggctgacctgcactgcgcagggcctcctgcatcaggcagagggtagtgtctgagactgaagggaaaggaaatctggaaagatctatgttgcaggatgttcttcagggccctcagacacagagccatgagtacagctgctcttgggaagggcagagtgagctggaccccagcctgagccaagagggcccttcaatgccccatgtctgacctctgaggcattggaagggccaggccccacccaggtcccgaggtctcacctagagcaggaggaagcctgagtgccaacaggagatctttgttttctgctccacaggtaatttgtatcgcttccactcaaaagtctgtcttcctttgggcgtagagtctagaaatggttcgagttccaaactgatattgcagccgagttccaaactgataaagcatctgaatccattaccatgacgacaagttcctaggtgattgcttcaagttctacatgcagcttccagtcacagttggcgagggtcctgccacgctcactgggtcgttctcttccacactcacatgaagcttttctttacctcatggcctctgctctcttccctgtttcccctctacctgggcacccctctaagtggcagtgctggtgttagccacccttctgctttgtcacagtcatgccctctcctctttcaaaaggccacctgagtagtgggtatgcttgggtgggtcacactggaatagagcatggtgtggggtgcgtctgggcactggtaagattctgtcttttgatctgggtgctggttacgcagatatgttctctgtggaagttcactgagctatacacttatgacttattcattttctctctgtgttatgcttcaatgatatgtttatttaaaaaaggtaacctgatgtttctcaatatgtctgaaagacagcagttgctttgagtagacagtatttgtcctcagccaagcccaggcctaggtacatgggggaggggtgggaaggtgcggggctcacaggagagggtcactgatatggaagtggcggcagctcatctggtccctgagactctgccatcctgggctgggcatcccttcaacccagggctgccaggaggcctggggtctctggggaggaggctgggtgggggtgtgggttttgccaagcagccttaggagaagaatacaaggcctaagagtcaggggatccccactgccccagggcgtcctggcctcacccaatactcagctcccagaggtatctaaaggaggcttagtccaggagctaggacaccttggggtgtcctacacaaacactgtgagcaaggctcccgaaacacctggcggtctgtgctgacacggcaccacctcctcatgttgaaggcgtggctggccgtggctcctggctcagaggtatcggtatggaggcaggtgctcagttagtctgttcttggtgagggtttgtcatgggccctgacataaaactgggcctccttggagacctctgagcacacagggccaatgtgtaaggcctgaggagcctctcacaggccatgccctggcctcgtctgccctgctctcccctcctaggcttctcaagggtttgaggactgaagtatggactcaggcacggctgggactcgaccttcacggccctggctgttcagctcacgtgacacaaaaagagacgtcaagggtctcctgcccaggaggaatcaagatggacttttctgccccttcccctcatggtccagtcatgcctgactggccagcaagccacccccggacaggcccagcctccctccctccaggccttgcatggttggcctcctctacctgaaatgtccccctatcaacccctaaactgtcccctggggacagcttcaatttctttttttttctagaaagccttccctgaacagctctcccctcccctttcttggggggggtggcaatcagagtccaaattctgcacttgactttcaacattaactgccctataaagctgattcttcctccagcatgcagtgtgatgcccaccaagaagatgggccctgatgcaccaacactgggatccttgggacaggaagagttttgccttctgaattattatacccaccacacccatgaggggtgcttcttaattatttggaatgaactaatggatcccaagctatgtggtttgcattgagggagcagagggacctctacttgacagtgggagatatttataaccattccaaatatctggcttggcagagataggcaacccatagcttaccctgctctgtgaattcatgagcatgtgaattactaccgggacttactgtaactctagatcccagattgaacatagaccaaataggcacaaggtgaagagctccaaaccataaccacgggacagcagccctcatcattttgaggccctggaactgtccctgacccttgccgcatcctccccagcaaagctgggctgtccagctcggggaggaggcaagggtggggtggggaatgagcacagccagccctgaacagtcctcatcactcaacaaacaagcactgaccccaccctgccttccactacgctgaggtgtgaagtgggtggagaagggggcgaggctcgagccctgctctccagaagcccatgccccaggacatgagaagatgtgggcacagctggctgagcgacttcccttctggctgtctctctcccatcctgctcccctctcctgaccacagccgcctctgcagtcagcgttgagtgctgagagctgtgtgaatgctcttctgttaaggagggtgagaaaaggatggtacggattttattccctgcccccattgacccagggcaggggtgagaggctgactgatgaagtcactgcctagacttgtcatcagggcccccacatcttcttcaacacatcctcctgcccactccatctaaacaaccctacagccagttctgtcccatggttccctgcaggcctgaccctgtgtgcctgtctttctattgagccagccaggtccttcatcctccctggggccttttctgattccccagcctgtgcttgtctcccttgagcccttctaggcatgtagcatctaatgcttgaggagagtgagcaccatttccatgaccacactgtgtaccccggggcaggggctgtgtccaccccttcccaggcctctccagatccatggggatggagggctcgcagtatgtgctcaagacctgtgaccactaatggaatgatgaatgatttgccctatcacagcaacacacccctgtctcgggaacgggacacctctggcaactgggcacaggcctgtgttcggggatggcgggctgcaggcccacagtgctcgatttgggatatcgtcctctccggtaaggcccagagcccccaacctgcccttgcaccagcatggggctgtggtgggcaagcttacttccagacagcgtgcaccaggatgatgaggcaaaccattgagggacatcatgattgcattctaggtgggggcttcttgcacctgtgacccaaatgcaaggccaaaggtacattttccaactaggaagcgggctgttaagcgtcctctgcaacggactcttgcccacactttccctagtttttaaatgcagatgaggtagaactcacgggggcagctggctctgcttgtttaattggggtgcattagcgctgaattggagcccgaggcttcttcgaggagtggatctgggtccatttatctggattgcatccacctgagcaaagcgccgtgattatagcttttaaatgacttcctagagctaatggatcacagaaaatagtgtgggactaaaagtaaatataaaatgagggagttggctggcttgaaagctgggctgccaaatgggaataccagcaataattacatttgaaatgccacccatgtcttaggacattttcccagcttatgcctccaagtttcaggctggatgttacagagtcgatgctgcacaccactcagagctttcaacatgctccaagtagctaaggctagttgtcccctccatcagaaagcaaacataagagctggagaagcatcttttaaaaagtgagccaactcagtggagttgatttgacttttaaggcgctaggtagtgagcattttggaggataggatactgtttgaagaaatggagatcaaatgtgaagacagtcatggttcttgcctacagatcacttaaaattgtgtggccttagatgagggggtttgggtggtgagtatgcgtgcggagggcttctggcaggagagctccaggggtgtctttccatcacaggatgtatccgagtgtgagcttaactctctgggtccctggtgtgcacataggtctcccaggtcacccatggggagatgtctgattggcaggtgtaaatgtcgattgagtcatgtttctagatgactcgggtcactcactggccctggccctgatgaccccccgggtgtgtgcccctattcctgtctgctccatgcttagaggccctggtggggtgtgctgacccatttatgccagtgcacactctggactggctcctgcgggagaacacaagagtggccatggaactggcctccaccatgctccatcttcccaccctggtgttctcaggcccttttaaaggtggtcgttgctgagagtatttggctgcttctcctgccccatgcttttctaggttcccagaagctgtggttctttgggacgtggagtggcataagctatacagaaacttccctctgctcccccatggatactcggttccctcaatcgaggctggtgcaggggaagcttggagcggtgtctactcactatccagcccagtatccactatcctctcttgagctcctgatgtcccaccccactgttggcctgacatttccccacattgtcccacaggcccctcaactcaacatggcccaaatggaactcaccatcaagactgctccttctttcacatcccagcctcagccgacaacccctccacccaagccccctgcttcccaaatcgcacacctggcactacctcaccatcttgcccatccccagccaatcagtcctggctcaggtcatttctaccactgtgtctcttagggtgccagtttcccaccactcctaccacctctgctgtagttcaggaagccattaacacccccggatgaccactatgcctccgatcatgtccccaccaatcctcccccactcagtagctggaggaatcttatgggggctcccactgccttcgggctggagccaggcagcgccctccctgacttgccctgttatgtctccagcctcatccttccccactcacacacccgttctggcgaccctgcgccacctcagttccttaaacatgcctaccatcaccttggggctacaacaccacagctagaatcttgcccccgcccctttccaagcctcttcagatcggtggggctgtgcagagggctggcttgcagcatctgctcaagacacgtggtcactgatggaatgatgactgctttgccctatcatggtagtgcaaccctgaatagggagcaggaataggacacctctggcaactgggcacaggcctgctctcagggagggaggggtggagggctttgggtcttagctggcacgtggctttcctgcatgtcactatcctgaccactcctggctgggttcagtctcctgtgtattctgagagccctggacaccccctcagaacatcgatcatctctgcttcctctacttgtccacatgtccctcccaccatcgacatgagccaatgggggtcctggcatacaactagcactcaacaaacatgtgccagataaacaaaggaacgaacacatggctttgtccagagttgcttctactgagacatgcatggcctctaagtttcctttgaccctgagtccaggctgccataggacagccccttggtaaactgaacaagaatactccatgctcacaggctttcccttttgcttcctctggaactttcctccagtgaaatccaacccctttgcctaggtgagagcagaagagaaaccatgacaaataaatccaagtgcgaggtgctctagctgagagctctgcccctggctaggaccaggcttgatgacctggggtctgttctcctcttcagagatggggaagggagctccactcagtgtgaaaaagtatggggattggagtcactgtggtttgagaatcctcccagttctctcttttgctcttatttccctgcatgagtgctcacaggataggccggagggcgtggggtgctgtttccccccacactcgtgttccaggcatggggagtctcagagcagagcagcacccacttgcttgcttgctggaagcccagggcttctctccctgggcctcatttcctcatctgtcaaatggggctgataacctctgtcctgtaattgctataggagtcaaggcccagaatggcaccttgcctggcctggctccaggggaggagcaccccggatggcagagaaatactctttgaattttagtggtcagattttcatccctctgaggcatggggtgagtgtggggtgtgtggaaggttctgggggtcaatctctctccagaggaaacctccaggggtttgatcccagggagtccacaggatccagggtagatgtcccctcctggcagaactgtgtgtgtggggtgctcataaggtgactgtaatggaaacataaattgtcctgcttcaaggcagccacttcaaaatgttgtaataaccattataaacccattctctgcacacccactaataaataccttagtcccacgtcacatttcctggtatctctaaagccaccaggagaaggcaggaaggccataaaagaaacacaaaaacacagttgcagatgagcctaaaacccatttctttgaagcttaattgatgggaaaacttctggccctagagaacttaaaggcctatcgtacagatatttgattaagtgtcctcatatcacagaccaagctaaactggaaatcattatgcaataattggaaatacactaataaaatgaggatgtgggtttgctcaggacataaaaaggaataaaataattcactcagataactcaacaaaaatgagcaggctgcccccgagacagctagaagagagcctcctgagacagtgcctggccctctattgtcaaaagcttttagggtaagtggatgcatagctaggcttcaaaaccaccccaaggcccaggtgcggggtgcctgagggcgctccaaagtcactgcccacagcaggggccgccagcccactctcattcgcatcacacagcagggagagaccaggctctaaagacagtgttccttagacgacttgtgcagacatgacctcccttcgaaactaagagctcaggagagagttcacattaactttactagttaacgtgaatatgtttgagttcctgctcacatttttttttttttttttttacttaggggaaagtaaaaaaaaaaaacgtgtgcaggaattcaaacataaaaaatatgtgcaggaattcaaacacatgcacattaactagttaaggtctcagacaaggtcaaggtgactccctaaccatgaggtggcttcccacaggacgtgagttgggctcagcggctggctctcataccccagaacacggcttctcctggcatttcccttgcacgtggtcctaggaattcccaccaagcccctgtgtgagtgcatgtgaaggaagcagcagaggatgagggacaggccggtggagacctctcagacaggaacccttccccctctctgtctggtgctcttttgccaagggagcacagccacctaccaacacctctgttctaactccagggcctgtcacctctctgtgccattctctccagcccccgctctctgcttctccatatcccatatgtcctgccaggcccaccttgaagaattcttcctttaggaaaccctaggtgtcaaccttgaatgtgccacttataagctatgtgacctctggtaagtcacttaccctctctgaaccttaattctgtcatccatgatgcaagaacactaacagtatcttattgatgtagctgtggccctccaatgtatgacagtcaacccccacctctccagcctataagagagctagtagctttgccaccaggcctagtacctgctccagcactgtctcccaggcactcagggcttcctgtgtgatttctctgaggctagagccatctcctcactggctctggcaactcgcacagaccccacacagggtggggtccacagaggccccaggaatggacagggaatcaggcagacgagtggcaggaaagggagctggaaggagagccttcctgttgacaggagggggcactgaaggtctgtggtgaggtcgcttgaagttcagggaatggcagcattggcaggagggaaacaggcgctggacccccatgtggctgcagagagaggcggcagaggtaggaggagaagctgtggggtcaggctggtcaacaccatggaggggcttagagggcaccaggggcaggttgcagagaaggggcaggggaaattttagcttggagtcaaagaaaacaaaactgtgcctctgccaaagcaaggaagtggaaaaatcctgtgtcaattatctctgaacaagcagcaccattcatcttctacttacagcactgcagtgaggaggcaagctgtcaacctgctcatccacagcgcttttaccccaacacctgatgaaggaggaacatttggagtcggcctctgcctgtctgctctggccagggctgtgtgtcccatgagtctttctggagggcctactatggacgtccagcctgaatcagatgctgcaggtgagctgagcagagacaccccagacacagggcaaatgtcagttaaaagcaaattaacattgtaaccctaaacattcccctttcatggggactatgagaaaacttgggaaaaagaaaaaaagaatgaccagtgattctcagacccctaacaaggccacatcgatttgtgcatacccccttggtcgtttgccttcacgctgtgtgtgtttgcacatggcagccatagaacccatggtacccagagtatgcctttccaataatctcccagaataccctggtttctgattgctcacggatccttataccataaggggagctgcttctcaccatctctagaaaacccacctgcctgtgattgtcctaatgactgtgggagttgaggcctttccttcttcctagaagcaggccagggaccacccctgccggcccatcgagatgaaggatgctcttgtcgcacgggtgattattgtgcatcatcacaagggctcaggccacttgtcctggaaaacttttttatttcagttagcaagaggtaaagcagggtgcggattcccttagcaactctggaagaagagagaaagttctgagtcctctgtgaggaggacagagggagggttgacgctagctctgatgtgaaatgtctccttagggccactagcggtgccaacagaaagcagacataccttggctgggctggacactcagcacgggtgtggagacagcctgcagccagcatctgggctccctgggaggctggcccacggccacctctctgttcctgggaacacctgagcaacttggcagcttcatacagaacgtggaatacagaggacttttcaaaacactgcggcatccttctgaaccctggggcttgagaatcttaggtcttccaaaaccacacatatcagaaatacacgttttggtcaaactgcttagcgcagttgaaagaagactctgaccttataattgaaaaaaagttttttatagccgggggctgtggtttggtgatgtttggttgtattcaaggcagtaagagacattttatcaagggtgcagttcccatctactgggtttctgtttactctgcaagtcctaattctgtattgtcattctgtgagcaacaccacttgaattcaattgctagattttgaatttccttaagcaagttctatttagttgaggccagaatctcagtgggtggtaataaatatcaaagcacaggatggtcgagggaaacaaagtaaaaatcccaaatcaaatacgattattgatcaacgctgaactgctttaatcatttctatgctaattccagatatatacacacatattggcattttcattacataaatacattgatattttcaactgagaaaatatattgagcaatttaaaattgcaatctttgaagaatggcaaataaataaaaatatagtaaaaggcacagaacagaaaaggcagtgaattcttataggcctgagacagcctgtgaaacaccttcagatatttaatatggcaccactttcttgaaaatttttaaaagcaaaatatgcataccataaaaaacaaaaactgcaaataatacaattggacaaattaaacacctttcttgccccttcactatggaaaaaatcaattccctgatccttccctgttacttatacagtctaaaacattaatttttacctcattacattctgtaactataagtaataagtgtaagtttctattcattgactctaaaagtgaaaatgaataaagaacattatcaacattctgatgatgtaaccctcatccatggcagaaagatacagtgaacctcacggcaggggagatgtcagcccaggtgactcacctgtgctgtttgaaggagattattttaagcttcatagttaaattgttctctttcttcatcttcctttaattgctcaaaatcgtgacatattttagtttgcttaatattttatgatgtctttctggtttagcaatttgccttctccagaatttttaactgccttaaaaaatttattgagggatagcacatacgtattcttcatcatatctctgaggtcttccagtttcttcatcttatttttgttcaatggaattaactttcttcttgaagacttgcttttcagaaccttctgactttctgttctaacttgaatggattctctcccaggtttcttacacagttgtcccacaagtcctgccggggttttgtttcactggatacctggcttagctcttctgtttcttggaccagctcttcttctttctaggttccttttctgtcttgctggattacactcctcaccctccatgcccccacttttttttttttttttttgagacggagtctcgctctgtctcccaggctggagtgcagtggaacgatctccactcactgcaagctccgcctcccgggttcacgccattctcctgcctcagcctcccaagtagctggtactacagggcccccactttttaaatcagaaagatatacaagaaatctcatttcttgtatactgaaaatgtttttatttggtatagaagtctaggtacaaaattgtttgcccttagaaatgtgaaggcaagtgtctgttcatatcctttgcccacctttagatggggttgtttttctattataaatttgtttaagttccttgtagattctggatattagccctttgtcagatgggtagattgcaaaaattttctcctattccgtaggttgcctgttcactctgatgatagtttcttttgctgtgcagaagctctttagtttaattagatcccatttgtctattttggcttttgttgtaattgcttttggtgttttagtcatgaagtctttgcccatgcctacatcgtgaatggtattgcctaggttttcttctagggtttttacggttttaggttttacatttaagtctttagtccatcttgaattaatttttgtacaaggtgtaaggaaggagtccggccaacaaacatatgaaaaaaagctcatcatcactggccatcacagaaatgcaaatcaaaaccacaatgagataccatcttacaccagttagaatggcgatcattaaaaagtcaggaaacagatgctggaaaggatgtgaagaaataggaacgtttttacactgttggtgggagtataaattagttcagccattgtgaaagacagtgtggcgattcctcaaggatctggaaccagaaataccatttgacccagcaatcccattactgggtatatacccaaaggactataaatcctattctactataaagacacatgcacatgtatgtttattgcgccactattcacgataacaaagacttggaaccaatccaaatgcccatcaacggtagactggataaaggaaatgtggcacatacacaacatgaaatactatgcagccattaaaaagaatgagttcatgtcctttgcagggacatgaatgaagccggaaaccatcattctcagcaaactaacacaggagcagaaaaccaaacaccacatgttcttactcataagtgggagttgaacaatgggaacacatggatagagggaggggaatatcacacactgcggcctgtcagggggttgggggcaaggggagggagagcattagaacaaatacctaatgcacgccgggcttaaaacctagatgatgggttgatgggtgcagcaaaccaccatggcacatgtacacgtatgtaacaaacctgcacgttctgcacacgtatcccagaacttaaagtataataaataaataaaaaataaaaataaaagaactgtgaaggcaattacctcactgccttccagtgttgctaatgccaatctgccaacaatgattcctgatcctttgttgataacttgtcttttacctctggaagctttgagaatcttctctttatcctaaatgttctgaaatatcaagaggatacgcaactatacaactgtgggtcttttttcattcccccctgcttctgtctcagtgggtcattctttttgaaggtctatatcttagctcagctctggggagttttcttctgttattcctttggtaatttcctgctcttaagtttctttgttctctctttctgggttgatattagttagatattggtattgctagtcatctgtgtttctcagtttctctctcgccttttccatttctttgacttttaatctaagttgtgggatacttccttgacttattcttcggctccttctatggaaggtttaatgttggtgactgcatttttaatttccaagaaatacttcttgggctattttcctttctcataacaacctgttcttattttatggaaatgttttatcaagtccctctaaaggtttttttttattagatttaaaaatttaaaaatttttcctttgttccctatcccccacagccagttgctcttttccttcctgttggttcttcccttttgtgctcttggctttctcaaaatgtctcacgatccccgtttgtctgctgcattgtgcatgatgggttgatcagtgcaggcagtagacaccggtgtgcattgcctgtggctgtgtaggtctctgtctcttcccctgggagggctgcgtgtgaactccctctgtcgggaggtgtgtcacacagcaggctcagtttagtatgctccctgggcagcgtacaggtgaccccacccaatcctcttgacttctaatcttttttatttttacttttttgatacagagtctctgttgcccaggctggagtgcagtggtgtgatctcagctcactgcaacctctgcctcctgggttcaagtgattctcctgcctcagcctcctgagtagctgggacaacaggcgtgtgccaccatgcctggttaatttttgtatttttagtatagatagggttatagatggggtttcaccatgttggccaggctggtctcgaatttctgacctcaagtgatccacccaccttggatttccaaagtgctgcgattataggcatgagccactgagctcagccttgactttcaatcccttgaggtcagatgaacaccacgtattttccttttcttagtcctcaagaggaccttgaataagacaatgattaataaaaacaaaaacaaacaaaacctcccttactattcattaatggcccactctgagccaggtatgttatagctgcattatttctatttatttaattccataaatagacctagtttccactttagagatgaggaaacagacccaaaaagtgtaagacacctgcatcatagccaggaagaacctgagagactagcatatccagcccctcactcaaaagacaaggaaactgaggcccagttttgtccaaagccatagtttggtgaggatagtatttcagaatgatggccagtggtttttcattttcagtgaattgtttttttctcctaagttcttccaccattaaaataagacatgaggctgaatgttatggtctcagagaaaagtatggtgcacagagcataaaggtatcaaactcttggctcttgaaaatcataccagagaccattttctgaaaatgaaggcttttgatttgcagaaaacaggcttttgaaaggtaatttatgtctgaagctgcaaaatcttagcttttcatagcaaagaataaagctatggagtccataaagtttagagtctaagcagaggcactggggagaatgtgtaggaatttcagagctagttttccctcccaatgagagatcaagtcacttgtctgggagggagaggggaaaggaatttggagatgagaacagtagagacagccactagaaggggagtctacatcccattctcctgggaggagcagatcataaccccataggagttggtgggggtcccaggatgccatgggaaaggggctgcaagcctgtgagagcccccaagtctggccaggtgcaggagctgaggggcagaaagggcaggagtgctcacggaggtgactgggcgggagtgggccactctcagctgtgtgtcctccacttcgcaacctgtgcctctctagtccagctgctcagaactcatagccggctacctctgcttccttgtggagggactgttggctacttacctgtgcctcagtttcctcatctgaaaaatggggatactaatagaacttgccacactgggtagctgtgaggattaagtgagatggtgtacggaaagtccccagcatggagcctggaacagagaaactgcctggaaaatgcagctcttataagaccaggtttaaaatctacccgcctgaaccagcagaactagggtactcctgcatggaggccaattaaaacagctaagtcatcaccatcttttcaataactgccacttagagtcctgacaccagggcttgtgtggtttctaatcgtattcagtgagatctcagaatagttctctcaagtacacagaccccgtgtcctcgtgaaaataaataaaacacatcttgtgacaacttcagtcctctttgcagagggaaggctgggatatggacccctgcctatgtgtgagacccacaaacccagagatgagcagtgggtagtcctgggggaagaacaccaaacactcttttaattgctaaaagatggagtgcaagggtgctcccctgttgaaagcctctctctctgtgtgtgtgtgtgtgtgtgtgtgtgtgtgtgtgtgtgtgtttctccatgtgtcctcttccctgtagccccatctctctgaggagcttccagcggtgcagaagtcattgacccacaaggcacaacctcactgcaccaaagaagctaagagtgcagccagcacagcagaatacttccaaatgtcatgctgccatgtgactgtaaaggatccataggatggactttatgtttgtcatgctgccatgcgactgtaaaggacccataggatggactttgtttgtcatgctgccatgcgactgtaaaggacccataggatggactttgtttgtcatgctgccatgtgactgtaaaggacccataggatggactttatgtttgtcatgctgccatgcgactgtaaaggacccataggatggactttatgtttgtcatgctgccatgcgactgtaaaggacccaaaggatggactttgtcatgctgccatgtgactgtaaaggacccataggatggactttatgtttgtcatgctgccatgcgactgtaaaggacccataggatggactttgtttgtcaggctgccatgtgactgtaaaggtcccataggatggactttatgtttgtcatgctgccatgcgactgtaaaggacccataggatggactttgtttgtcaggctgccatgcgactgtaaaggacccataggatggactttatgtttgtcatgctgccatgcgactgtaaaggacccataggatggactttgtttgtcatgctgccatgcgactgtaaaggacccataggatggactttatgtttgtcatgctgccatgcgactgtaaaggacccataggatggactttatgtttgtcaggctgccatgtgactgtaaaggacccataggatggactttgtttgtcatgctgctatgtgactgtaaaagacccatgggatggactatatgttctttctgttcttggagatagtgtcatacacttaccaagagtgatggttattagaggcactgagacaaaccccttctggggaccagcactgctgtgcccgctggggccccagtctgcccctctgtgtccagccccatgagaacccgctgttgcacgaagggcccacacagcatgggcagatcttccctccagcctcaggctctcagggttgactacctcccctggttcttcactccctctcttccttcttaaggtttctctcaaggtttaggttcctgttttctttcctacaatcaaaagctctttggtatgagtgaagattaaattttctgtaacaggtacgatccacataatggattaaacaaatgataagttttgctgtctttatgtaaaagaatacagaggcgggtgatccagagctggcatagtgtcctccattaacttgtcagagacccagggtcatctcagttcatcattctgccatcccctgggtgtggccctgggctccatggtccaggatgaagctagccaaaatattctccttccaggcagtgacagggaggaaaggaagaaggaggacatcccctctcttccttaaggtggctttctggaaatttcacataacacttctgctccatctgattgaaaagaacatggtaggaaggctaacttagctataagaaaggctgggaaaggtagtttcttatctgaatggcaatgtgtccaggtaacttcaagattttgttactaaaggaggaggtgggaagatgtttagtggaaggcaactagtaatatctgcatatgtaaatttttttattttggccagcagagggaaagcggcacagatgtctccactgcccctttgctgcatttccagtccctatacctgagcccttctcgtagcttctaatattattccattgtgttctggcatctgttgtgttttttttctgtctatataattgtccctttgtaggtaatgtcttttatctctggttgcttttaagtttttctcattatgtttgacattctacaattttaccattaagtcttgaatcacttttataattttgcctggaacttattatactttctcaatctgaagatgaaagtatttttcaattctggaaaattcccagccattatctcttcaaacattactttttcattcttgctattttcaccttctataactcctattagatgtatatgggttcttgtcattgtcacccatatcttagctgctgttttatgttttccttttctttttctctctatgctatattctaggctatttcttcagctgtcttccaaatttttaattctctcttcagctgcctaatctatatttttaatttttatttttttttgagacggagtcttgctgtgtctcccaggctggagtgcagtggcataatctcagctcactgcaaccttcacctcctgggttcaagcaattctcctgcctcagcctccctagtagctgggcctacaggcatgcactaccttgcccagctagtttttttatttttagtagagatgggtttttgccatgttggtcaggctggtctcaaactcctgatctcaggtgatccacccaccttggactcccaaagtgctgagattacaggtgtaagccactgcacctggccttatattttgaatttttaattaaatagcaattaaatttttcctataagtctagtatggctcttttttttatttttgaagagtatttagatctgtcacaatttcttattgctttaaatattttattttgcttttttttgttgttctcaactttttagaattggggggtacatatgcagggatgttacaaaggtatactgtgtgatgctggggtttaaaatatgaccaaatccgtcaccttggaagtgagcatagtacccaacaggtagtttttcacccttgctcagtgccacccctccccattagtccccacgtcttttgttctcacacacatatatatatacacacatatatatatacacacatatatatatacacacatatatatacacacacatatatatatacacacatatatatacacacatatatatatacacatatatatacacacacatatatatacacatatatatatatacacacacatatatatacacatatatatatatggttttctttgagacaagttctcgctttgtcacccagactagagtgtagtggtgtgatcttggctcacagcaacctcaacctcctgggctcaagtgatcttcccacctcagccccccaagtagctggtactacagggacatgccaccatgcatagctaatttttacaatttttgtagagaccagattttaccatgttgcccaggccggtctcaaatactgttcccatctttatgtccacatgtacccaatgtttagctcctacttataagtgagaatatgtgatatttggttttctatttctgcgttagttcacttaggataatgacctccagctgcatccatgttgttgcaaatgacaggaactccttcttttttatggctgcgtagtattccatggtgtgtatgtaccacatttttaaaaaatccaattcactgttaatgggcacctgggttgattccatgtttttgctattgcgaatagcttattgctttaaatattttaaacactctttaaaaattatattttaatcaaagatacataagcccataatttacagtccaataattatttaaggtttttaaatggaaaacagcagatctgtcctcttcttcccatttctctccccttccagcccatttagttggttcttttggaatttaccttaaaatatcctacttgtgcatttggcatctattaacttcccagtataaagatgagaatttagctctcttttacacacttcccctaccccctttacaaataaacaccctcctgctcctccaccccttcaataaagacagatagcattttggttagctccgtgtttatgtaattgggccttacaaatgccattcacagccaagccaggaaatgcactgtgaaaagttcttttcttgaatggcttcttttctctcctacctaatttttggtgatgaacaaataacccctctgcagaggaggaagcaaaggtctgcatgtgggctggagccagactgctccccggtctgaaggggcgtgcgaggggtcccttccacacccccaaaagaggccccaggcgttcctcctgccctcccctggagtttggcaggagagtgtgtggggcaccatttctcagatggaaataactaggagtgaaaatgagggaatgttgtagaaaatgagggacagagctaggtgaggtgggggtgggacaaccagagtcatacaatttggatcaacattttctagaagtttttcttaaaaagttgccacctgacagtgttatagcagaggccataaggccaaagacaaaaataactgtacacaagcgcacacacacagttgccatctgaaataacaaccccagaagcaggaaggaggcatgctgcctgcggggctttgttcaccacgggcctctgggttgcagtggcacttcccagaggccagttctttgagcagcggcaggagccctgagcgtgctggacagcgttctggacatgcgggggcagtgctcatcctgcttggctcttccctgctgaggacaggcaggccagagttactgagactggggcagaggtcaaggggtgggcttttgaaaacaggcccctgcagctattctgcactggccgcagggtcaggagctgcatccggtcttaattctgctcctgctatgtggcctcagagaggtcacttatcctcccagaaccttagtttgtgcatctgtaaactgacccctattatacaggactattataaggatggagagatagccgccaaaaagaaaaaaaaagcacagggagttgatgatgctacggaccaggtgggaagcccttaaggccttaccagggtggaaagagacaaggggctagaatgacacacgcatgagccagcgccatttggccctgcgacagaggagcgcacaatccctattgctgaaatgggaatgtgatcagctggttctaaaaggggttccatgaatgttttcaaagatggatggagatgactgggtaggcctggaagctcctccagctcagccctcgtggttgagtgtgcattgaagttttgacatgcagaggacatcctggagagccttggtggcccaggcccaggtctcactgaggaagtaaagtgaatccacacccagcagtaactggcagttccttttacttcctcaatgagaccacgtaagctccttgtgaacagagtttgaactcatccctcctgtggcctcagagagtgggcaaagggcggggcactgggcagggaatccatgagaccaatccatagatactggtataactaagggcacagcaccagtcctctagctgatggccttgagacaatcttataattcaaaggccacagctgtgcccatgcagatctcacgtcacctacatcacacctgcagccccgggagcaccatctttccaccagagagtgagactgatggcacccaagtgatgacagtaatgtacatgcatgtgtgggatgaggaatgtcactgccgtgctggcctgggcctaggcctgctctgtgcctgctggctcctgtcatgctgatggtgggctctgtctactgctaattgagtctaggaagccctgctgtcagcagcggtctctggctgtggttgatgctgaactcctaagggcagattttatcagccctaagcagttgttggtatgtagtttgcatgttaaaagaggcgtagcatcctgacaggtgctactggaattgcagaatacatattcacaggtgccagccacctgtgctagacgtctgtgcagcctggctgaggaaggcagtgctctagacacttgagtgctctcctcagctattcccagacagcttcccaagttttgaaaacaaataacacttagcatgaagctaaattgaatatgactgaatgtttctttgggttcagaagacacactaagctctagcagaaacttaggactagcattaacaatgtctagttttgggctgggcatggtggctcacggcggtaatcccagcactttgggaggccaaggcgggtggatcatgaggtcaagagaccgagaccatcctggccaacatggtgaaaccccatctctactaaaaatacaaaaattagctgggtgtggtggcgcatgcctatagtcccagctactcaggaggctgaggcaggagaattgcttgaacctgggaggcggaggttgtggtgagtcgagatcgtgccactgcactccagcctgggcgacagagtgaaactctgtctcaaaaacaaacaaacaaacaaaaacaaaaagaacaaacaacaacacaacaatgcctagttttgttttaaaagaaagtaggaaacaaatcttctagttatttaggttttaatggccaagaaggggtttctaatcctttatttcagactcagaattctgtttttgtgctggtccgtgctccccttcacactcctgagaaactccttgaaaccaacacccatggctgtgccctggtcccatgggaagatggatcgagaactgtctgactcttagtgaggaccgatgtccaggcatctcaggaaatcctcgcatggctagtgttttatcttttaagaggaagaggctcaaggcctcttacagaggcttgggggcctgggtcccagggggccttctgggtcctggaggccagttataactgctgcccaaacctcccccacagccaagggctaagggggctgtgctgtaagaagtcctgatcatgaaaacatagtcttttcatgcagacagctatgtacactacgaaataattcttatttgccatagattcaatcacaaacacatactgtgtgcccactgtgtgctaagccctggggacaccactgtcatcaccaatcagccccttcattcatgggctcatggcttgtgggcgccaagacaaatttgggcatgcccaggtagtccactgatctctacctggatatgccactgaacctggatttagagatgaagtctgggagggactctaggaggaggtactgggagggggaatttgagaggaagaagtatgtcatggagagttttgatggccagggccaagttttagacccaaggtccagccacctcccctggggagaggccaggctgagaaggacaggtagacgcccctgcagcatgtttcaggaaacctctcagctttcttcagatgggactggttaccagagaggccccaggagcccgttgatgagtaagtatatggtagtgacaagtgagcagaaaccactttgtaagtgtcaactgcagggttgccacaagactagaaacttaaagggaaaaaaagcatgaaagacccacctgtgtggtgtgaagcatggctgcctcctggcctgcctcgcagggatccctcaggcccacgcagtctttttggcaggggacccctcacagcttcctgcaggacttttatggggacaatgctgggcatgcaaacgaggccctaggccacatcacacagccccttccctgcccatcaggaagagcctgtgctggaggctgagctggtaaagggccatgccacccacttttccatttcaggttggttttacagtccagggccagagtggggcccagcacccaactaaaggttgcagtaactctggagtctgagaagtccattgggcacaagtgtggagctggggcggactgcaaagccctggacagaccccgggcagggaccaatatagcctgctggtcagtgtggctagatcagatccctggcaagtgggacaggaaggacagcatgtttgagatttggtgtgattcacctcagctggccttggaagagcaactctgatcctttggcagagtctcagtccccctcctgtttgtgctgtccccgtgccctgccctgcccctaggagaactccccgttggcctctctgtctcctcctccagactggaagcacttccttcactttcttccctctcttctgcccccaaggcagaagctcctctctctagctgcatcttcagcctggctcacaggagatgctgatagatattcatacaaacaacaaactggcagtaaggaaaaaagggacagggattgggagccagggagccaatttctagttgtgtttggcctatcaatgtctgtttacagtttagaaggggctgatttcagctaaggcttaaagctgacatcatcccttgtaaagcaaaatggaattcttcccaagtaacttaaccgtgagaacggccatttgcttccaaacctacagggccctttcattgcttcattggcttctgcaggctctgcagacccaggtttcttgcctacctcatttcttaagatttactccttctggcctctctccctagcaccccccacaccccctaaaatgaggccaaagtagttgacttgggctcggagacacccatgctgaggtccccaaaggagaagtgtgctagggccacaaaacacctggggccttccagaggcctctgccgcccccagcttctcagcccactcctgttctagctgagtctgggcagaggcagcacagtcagtgctggtgcccactcaggaggaccagtcggcttgggctgggcatagaactccagccatgctagccagtctgtggtcagctcagcctggcaaagtgtgcagtggacccagggccacctgctatctgctcagcttgtccttgtctgctgtaggatgccacctggcctgactcatttcagcgcagcatcctcaaatttcctctgactgacccccattcacatagcaggaaccttatgattacatggagccctctcggataatccaggataaactcccctgggtctagagccttaacttcacctgcaaagtccctgtgccatgtaaggggacatactcatagtttcaggaaattggctataactatctttggggaggaggaagcagcatcctgacgaacacactggccaattcagcccgtcagctcccagcatcaacctgggaaggctgattagaggaatgacggccttacgtgttgttctcccagtgaatcaagcagcaggggcaggactctgagagcaaaggcagcccccagcagggagggcgagggggcctgggctggctatgccaagtgctgtcctccccaggccctgaagcccgtgctgctgataccttgtgttcgcttgcacgatggggcccatcccagccagggttctatttcttttttttttttttttttttttgaggcggagtctcactctgtcgcccaggctggatggagtgcagtggcgcgatctcagttcactgcaacctctgcctcccggattcaagcgattctcatgcctcagcctcctgagtagctgggattacaggcgcccgccaccacacccagctaatttctgtatttttattagagatggggtttcaccaggttggccaggctggtctcaaacaagtgaatcacccgcctcagcctcccacttcttttaagtaaaatgctatttcccgattgcaaaacagcacatactccctgaagacaaactggaatataaaggaaagaactaaaaaggaaataagtctccgatgatcccaacatgcagagtgagcattcaggtctggttacccatgtggaaattctcacacggtggggtctttctgtataccctaacttttgtgctcttaacctgttggcatttcttttgccattggccgctcttctagctagagcgtgatgtgtaacaatgcataggatttggtccttcccttctcctataaatgacttaatctttggtggccattctgtgtgcctttctcactaatattggtaatgctgccacctacatctttttgtatcattgtgatagtttccttgggacagattcctggcagtagagaagctgcgtcaaaaggcgcatagtaaactccaagaaggcagggactgtatctatcattttcctggtttattcgcagtgtgaattcctgtggatatgtgaagactgactgactatgggagactgatgaataaaggtgatgaatttcaaaaatattcagccaaggaaatgaggccagacacaaaagagtacttacaagaagttttagaataggcaaacgaacttatcatattagaaatcagatcagcaatggcccttggcagggcagtgatggggggactgactaggaaagcaccgggaggaaagttctggggatgacagcaatggtctgtatcttgattggcatagtagttacatgggtgtgatgcctttgtcaaaattcactgaatttagccacttattgttggcagtaatattagtgtcttgcttcttaaagatttagagtacacttgaattaatgaaaggccccacatctgccccaccctcattcagcttttaaaagcatttcctttactcttctttggcttaattgaaactcttctctgagccccttttcctacccgttctgctgctggtgatggcctcagttgtccctcacgggagctttcccggggagccaaggaggccagggcaggtgtggaaaggcctctacctgactccccgtgctgctgagactgccctggcagaccagggagccagtattctgagctccagcctgcctcaaggctctctgctttgtaaaccccataagtgggttccaagagaacagatttcctgaagtgctgcccaggaatcaaacagccctaacagtggaccctcagcgtggcctcccttccctgcagggctggggccttcatgggaacacaccctgtccctctcctcttcgtccccaatcgggtacctataaagtacactccaagtacaatcttctcaacgtttactcaaaataggaaagagaaattctggcgattttcctcccaccagcacctcgctgttccttgaccttttaaagcccatttgatgatgagaaagaaagaacccactgttgaattcaaagctggctctaagatctgaccttaacacatgaaaatgtgttctggtccaatgatcattttgcagaatctaagtctgaaaatattcctgcttcaaatcttaagttaaaaaacataaacatcactatagtgtctcttagagtttgttttcaggcaataattttttttttttttttttttttgcaacaagtcagctttcattatttgtgaacaatctttaaatttaccaagtttgataggctggaaaaggaacctagacaaagcaataaaatctcaacagcaaagttcctattgatgtgattacagttttaaagaaacaagagatgacacatttaaaaagtaaactttttatattgtccaattatgctcagtaaaaataaaaataagctcatagaagggctatgttttcaacgtccactttaatttcagacagttaagagcggcaatgcattacccttcaaaaataataaataaagttccagagtaattgaaaagcctcttcgtctcttctgagatggcgcgtcccattctctgtcatgtttcccaattatcaccgtgagtgatactccctaacgcagggagcttaattgccatcttaccgtgtgttgcatttaccgtgtattcctaaagcaaaatttgggaaattaaatctttgagaataaaactgttcaatcacaataacacaattgtgtaggacctttttttctcttcttggagtttacaaacctcgaaattctgctctgagcaagaaacccattttagaaatgagttaaatgacccagagtcaggagaacatcagattaactttttctgagcccttgaagccgagagcaagtctgaaacatgattcccgacctcttctcgctctaataaacttttcaaggaggggtcgcattccgaccctgcagtgctggcttctttccagagctttctaatgacttggtattgtctctggatgaaaaccatcctgggagtgggagacccttacctctgcccctttgtatgttatcttgagatttcgcggttgactgcgataatcctttatagttatttactatctaattgagaagcaccctttctgtcatctgcagtttcttctacaacagcagcaggccctctcttgctctgcctgagctccaatctttcctcttttcatccttatctgcccaaggatctcagggctccctggagcatcagaccagcacatcttggccaaaacgcataggtatctctttcagagtcttctgctcttgcttccaaatgtccctttttaccccaaaaatttccctaaaaattttgagactgggaatgtatagccatgaggaaacccaaaggaggtgtcaaatgccttctagtcctgacaagtttctccctctaagacagtggttctaagtggggcagaactgccttgtagtggtttttttggcaatcactggggcattttcagcagtctcaatgattgaggtggggatggggttgctgttagtattgagtgagcaaggaccagggataccagacattttgcattgtataagacagtccttcacaacaatacattgtcacatgcccccattttttggatatcccattggatattcacgtagttgaaaacatatttataattatttgagcctagaacctaactctagttatccatgaatacaaagtattttgtgcatggcttaatatacttggaatttctctgggatacaactactataaaaaccaaggaatgagtacacattattttgttcagaactttatcaacagttgttcatcattatctcgttgccaatggcaacacagtgttgtggcatatgagttgccaattccataaacctgtatcagttgtatttgtagaggctgccttcatgccagcatctggctacatcattatgaattccactgtggtcttgcatattgaaatatgtaatattttactacaaattacttcctttgtatttctcatttatattttaattaggacatcatattgtgaaattaagtgtggaagtggattacattgtctataattttcgtttcagggcaatacatggggtgttattaaatatttgttctaaaaagtcggcactggatctgaaagagttgagaaccagtgtttgaagatttggcagtggaacccagtcactcctcccaaaagagggcaggaggagcctttgttcacttgcgttttttgataagttttcactcacccagcacgtagcctgagcgctttctcagtgcgtctgtggggctccctgtctatgcgttcaggatttctctgataggtctgggggctgaggcctctgggcctgctgtgtgcctgtgcacatgggaaggcagcccttgcccatggagactggaaaatgctccctgtccagagcaggcaaaagaacacaagggcgaggctgagcacaggaggtgcttccaggcctggcccctgctctccgggaactccttcccatagtctcagcagccatttctagatcctagttaatttctattttaaaagcatcatctcatacttttattttaactcatcaattactatgcctttaacctatctcctttttaaatcactcattttaaaattcatttttttctttctttcttttctatttcatcttaagtttaatatctgagatttaaattccaggctaattcctcctctcctgtctcctatagctgtcagccctttagagctcttattttaaacctcttctgttttattgatttctctctctcctaacttcttccctttttacctccatttggggttttatgactgcgctgtcattcttaaagaaaaataattacccttctttattttctctttttgaataatctgcatacttcacagagaaaaaaaacatacaaacaaaaccaggtgtacaaattacctcatggttaagcatgtggtggggggcagcagcgacaggtaccaagtgcccacagaagctgcccacatttccatgagtgggggtgttccaggaggccctcagctctagtactgcttttcctttgggggatatcaggttatgggggagtcatttacggtagccccctcaatccttgttttcccccagcaactctggaaattcccacccttaatgacttttcttcttctacttgtcacaatcacgccttcccccaagcttggtcactaacaggaaggtcttccctgaccaccgcagcctgaagtactccgtccagccctgaatttgaatggccagccgcaatgtaggtctaactatattaagtgccttttcatttcactttccttgctcttgccttaaaaataacatttagcatccacgtgggaggccaacaaggctgctcctgaacctccagccagtgtacttggcaatacagccaggatgaaacctgggctgagggcatctcagagctggcaggccgtggaccacagggaccaaactcctgcttactaccttggtcgagctgcaatttcacatcccaagggttgtctaaaatgagggctgcccacaccctgcccacccctgtctttccatcagccttaacagctttgtgcaggccctctcaccgctgagctggcctcacactgagctaactctagtgttctaatggctgggttaattcatagacggcggctcagagggcactgaattaacacttgccactttgcaataactcaccagccttcccgtagatgctttagcccacctctgggccctgaatgtgctgctggggacagatctttaaataattcccttctcactgaacagggcagcctggctaaggcaggacacgcctgacattccagcatcagcaggcgattgacaactcagaaatatggaaccaagagtgcccatggggtcaacagtttccaacactgctcagcaagggacatgttcaaagtgcatcttgagctaggctctgtttctgaaagtccaggtctccagactgcttgtaacaactaaagcccggttctgttgggggtgtgggggtgggtggtggtggtcacaagtaaagcctgctgtctcaaggcctgaaacttcagaggggactctgagtgtactcccagtgggcacctaacctcctgatcgaggtggcagcaggccaccgcaaaggaggaattggcaggggctgccccatgccaggggcctcttacacctgctgagccctgattcaaggtcctatgatgaagactccctgctcctcctgcaggaatcatccctcctgacacattagcaagcaacgtttgggaaattgtgcagttatgaggcaggcacctaaatgaatcctgaaggagatggtacattttttaagccacttaattgaatctgtgccagtaaatcttttagtcttctcttagcatgtagaatttcaattttgtccatggatttttgtgctcagcccccagtgaaaatgaacatttgtgctgaaaagctttttatcaaccgttctcaaaatgtcagtcccccttatctccaaagcccaccgaaatctttgtgcccgtggttttaaaaatatattctgtgtatgctgtttctccctttcagattctagcattctttatcttggcttaatcagagtcatttttgatgttcatccccctcttaatctccttagatttctttttaaggtgagctttccacttcaatccagcttcactgatctattaagattctctgaggccgctgcctcacagatgaagacacgcttctgtggaaagccctcagaaagccctctattttagcgcacagaaggttaattgcccagtttttaattaaatcagtcatttttctttaatgttgtttgtggaactctgtagtaaattaagccataaacctgtcctccttttacgaggagtttgagttttgactgttgttgcttgcagtcaaaactcaaaaaggctggtcatggcaaaagttaatttctaaaataataataataataataataataaaccttaatggaaaaagaacacaagatatcctgaaagagatcaacttttagggattttaatggcaaatgttttatttggggaaagctgctttttaatagttttctggtaaaatggtaacaatctccagccaagttgctgagccagggggaccacccaggcaggtccagatgggacctcccctctggggtctttcaaatgcggctgtcatttgagcggccaccaggggacagcatgcccccacctgctgatttgctaatcagcacccctgctgccctgaacccctgcacgaggcaggatgttctatcgatttctccctggccctctggtttcccatgagcctaatcagcggtgcagtcttcagtccttgctccttgatttgtcaggagaatgagttatccgagctgacgctccctgtgatttgtaggttggagaactcagccgtactgctgtgaccttttcaatattctgttattagatgggctggccatttcaacttcctcctgaacaaagtatcttcaacatgtgctgaagagggagaatggccagttaatcagaacaccgaatgctgaaaaggtcggaccagggccacgggtattaacattcaccatctgcgtcagcctcctgcagcctgcaagcctcacgactggcaggggctggtggtacccgacaaagggatgagggctagccctcagcccttcttccaccccttgcagacagggactgcttctcccagtattaccctcctctaatgggcaacccagactcttgtcatccacaaggccccacctgcctgggcttctggatccttctccaacatcatctcctaccaccctctcacttttgatgctgcaaccacagtggcctttgtgtgccaccttgaacgtgtcaagctcctttcaggttcagggcctttgcacttgctgagccttggtgtgggtctctctttcccctgatttttggatggctgactccatctcaaaatgcagctctcatctcaaatgtcattgcacagaggccttccgaggataccccagccattgaaactccgcattgaaacatctccctcaatgcttttctttatggtctttaccacctgtcatccttgtctgttcatgtgtttattctctgtctctattcaaatgtgagcagcttgagggcaaggataccgtctgacatggtcactgttgtatcgccggtgcttgacacagcacaagtccacaacaggtcctcaatccatgtttactgacagagtgacagtgacatgcaatttatttttttaaaaatccgtaactctgactcctctctggtcactgaaaactttcttctgcctgcttccccatgtccctttcctcactttcttcttggaggaaaccctctggtgactcaagcacaccctctggtgactcaagaagtcaggtgaaacccagcactcagaatctgaactcactgcagctcttcagtccaaggaacatcaacggaccaatccaagatggaagcgtctcacacaagcacaaggcggcatcctaatttatagtaatgggaccattttcaagactccagttttgaactgaggtctacttaaaatactaatagcttgaaaaggccaaaaaaattcctacaattccctttgcttaattttttggtgcagagcattctaatgctgttaaatgatatatttaaatgttgaagtattttaaatgaatatttaaatgtattgaaatgttgagccaaacaacagcaggatgagaaggcatccccagccattcagggtcctccccttgaaggtctctcctgaaatagtgactctgttagctgcttgggggcagactttggtggaagacagctgttcttctttcctggaagagctcagctggggactaggaaaggatgagacagagccaactgatctgcttaggcagcaatgagaagaatggacaccaagatgtccataggccctacagggaataaagactcaagtcagccagtaatccctgttccaaaggcctgagattcatgtctatatccccacaaagtggaacaagactggtttttagcaccacaaaaatgtgtgaggttggatgtgttgtctctgaaacaatgtggaagatttcagtccagaatgtctctctttagccccaaggtaaacaagaaaacagccatatggcaatgctttattctcagaagttttctaggaatccaaccaaagcatcccagaaaggcctgcgtttttaattcctttccaattagaccctgggattttaggacagcaacatggggaggcttcactgccacaacatgtgacaaatttctgctttcgctccagatcttggtcggcagcaggcagaaccatttgaacagctgcagcttggccacgctctctctccttggctctcccgcacctcaaggatgaaagatgttaagaagtgcaaggaagcgggtttccctgctactgtggggtttctgcagtaggccacatcaggagttggaaacaaagatcaggagagtagaaaaggaaatgtaagctaatggttttaaagagcctgccagctatgatccttgggagagaacaaatcaaacacagttccacaggtgacacaggatgtacctgaatagaaacctaacacagtttcacatttcatttggctggaactttgttctccatgttctgctgtgaataaacccagatccaacaggcaggatcaagatcccagagtctaagactttggtggaaccaggagaccatctcatctagcctctgcataagaaagatacccttgtccaaggggagttctggcctttgccccctgcccctgggaggggattgctaagcccttggactgtgctgcctgataagagcatctttgtttagctgggggctttgggccatgacacagtctatgctaacaatgtgatttatggtgggaggccacggaccatgtggtgtcagctcaacctctggaaggccagacactacggtcagccatgcagccagccagccagccatatccatgtgactgagtcccagtaacatccttggatgccaaggctcaggcaagcttccctggttggcagtgctctgagtgtattgtcacacaccagtgctgtctgcacaactccactgggaggggacactggggagttatgtgcttggaactcttctgggccccatgcccctcttccctctgttgatcttaatgtctccttgtgctgtaataaaccataaccatgagcataaaggtttttgtgagctctgtgaatccttttggtgaattattgagcagctgatgtcagaagtgagggtaccttaggggactgccaacctctgtagaaactaaggtccaaagagcaacaggaagagcctgggagaactcaggtctcttgatgcccagttgagttccctagcacgggaggtgcatcacacacagattcctgagccaggaaacaaacgtgcaccagaacagaaccggtgggtagtcattcctgtagtctagccccatgggcagctgtgcccttggccttgctgtcagatgtacttggaccctccaagccaaagtctacttggtcccctctttgtcccccaactgtggacatgttggtttgtcatctagcccattctaataattctatttcactgaataaagatcagctggcaggccaggacttttcctagtgccaactggctttttctgcataaaggggattttccagcagacggtgcttcagggattcagtttgtcttatgctgggaaaagtcagtcttgagccaaatgtaggtacccatcccaatagacgaagaagcctcagggatggacttccaaggctggcttggtctccatgcagggttctggcaggcacacccacacatggcctgctgaataccaccagcctccaaagctacccaagtctgtccttttcttgttaatgttaatctctgtatcttccaaagtttaatgcccatctggcatttgaggcttggctaaagagaatcatgcctcttaataaaacaaaaagccaattacacaagttgttacatttggcagctggtatcttgctaatttgcagcatgggcggtccctctgttaatcccctccctgggctcattgctcctgtgtctcctcagcaggacctgggtggagagccacaccgagacatctcatgccactcacagcagagtctcagaatatcatgatgagaaggggactgagaaaacagtaaggccaatcccctctattgcacagagggagaaactgaagccacctggcagggggttgggtgggaggaccaggcttgttccgtcacaacctggtgaggttagaacaccaagtcctggcacccagcctgacacagcccctcccactgcccaggcacctactttcttattctccacaaaatgctcagcttaggtgggccccattctgacaggtgggcgcctcctacacagtgtgattttagagactctagcaggctcatttggcctcaaacgacaccattaagggcaacacacttgtgccatttgatttactgggtgggttctgtcacctggcatcagcagggcttagttaacccattaggcaccccactccagatagtctcagagctgaggaatccctggtggcagaggacacagggcagctagctatgacacaggtagaagagcacctccctccctccctccccaggtgccagtgaggcgctgctgatttgatccctttgttggggttggtcctatctagcagggctgccctccacccacccaagccaagagcatcctactggattccaatccccctcctccaggaagcttcctggccacccagctcttactgttctagctcctttgaactgtcaccgtgcatgtggtcatagccccacaaccttcatcttcaatcatgccctaatattttctgtctgccctgatgagacccagagttctccagggcagaagaggaacatgatttctgcccagagttctctgcttgtcgctgaggaaatgacaaggtcgcttggaatatggcagctgtggttggcaggctgggctgtgggcagggagacaggctgagactgagatggcccctcacttggtatctgcctgcaggccagcctctctaaaagtgaagcatctggatcctatttaaggagcctctccctgtgggagagtcctaattttttttttaaacattagccatggctgggcaggaagcctgctggaggatacccaaagtaagacaggggtcccaggcctgaagggaaacaggacagtagttctcccaggcaagccagcgtgctcagggtcctgtgtggtctggcttcctaggcagagttgtgtgaggacaggctcggggaagggcagcatgggtcctgaagcatggtctttgggcagtcttggggtttggactcctgtcccgccagctggagagaaggaatgagggatgaggcggtgctgtgggaagtggggagaaggggtaggcaggtgtgaggcagcagtgagtcagaggctcaggcagcctcgccctcagagcagagggggtggtttcaggaatgagaagaaggaaagaaagccagagttcaaagactcattagggtctaaggcaactggccccatggagcaacagggaaaggcaggttggggtcatcgagtgggtgctggggtgctgagtcaacccagggtaagagatggctctcccctgccatgactggctgcaaactgggttcccagcacagacgtgagcttggacatcaggcctgtgatgacagaggccctggctgcctccctggccagtaccagcctggttctctgaatgcctgggtagttctgggcaatgctggcaagcagggcccatgcagggatggggcatggagggacagcgcacagagggccaacggtcccgaggactcagagggtcaccaaccccaggccatcaagaccggccagctctgggacttaatggaatgagccacacaacctacaaagggtgtccactccgagactctgaccacgtaagctctgcccatgttttggggctgcccagaagccagcactgctttcccaaggccctcaccgcaagaggcattcctgacatttaacatatctactcttgagggtttatcccatgtaggtctcgtgaaatttaaaatcatggctagtgtccctaaaactcccaggatgggaaaaagcaagcatgagggaagagggtctacggaaagtgtgggcctgactcctggtggcaggacggacctgtctagggtgtgagagccgctgagtgtccctacagggcctccacttgtctggcacaacacaagagctcccaggggaaaagcctccatttgaagtgcctgtaaagtaatgcggaatgtgtcagatgattcatgtgcgtaaatatcagttggcagacaaggaaatgtcattttcacctttgttctcagattcttttgaagtgtgaaaaaagatggtttcagcgatcactgggcattgtttgttacaggagcatcattaaagaaactgatttggggcttgaaaaacactgaggtatgaacactgtctgttagagctggaaggactcctcatcgtcagacctcgctcccggggcagaaattcctccgcctcttccccaacagcctcggctgctgcttgtccactcccagggacgggaagcccacttcatcaccgggaggcccattgcaaaggcagccccagctgttggaaggctcaccattttatggtggaaactgcttccaggagagaggaattgaaatccatgacactgacaagcagggcatttgaaattggcctccctgtcacccacccacaggccgaacatgtgcctgctggggctgccaaacacacctcatcaaacttccaggtaaagggccatcagctttggagacagttttcatgtttctcccgccagggagataatgcttcatgctgagatttgaggactggcaggggaattatctatctatgtatctatgtatctatgtatctatgtatgtatgtatgtatgtatgtatctatctatctatctattttttaaaatttattgtcctgtggaataaagtttttagactgtgtgtgatcctagtctttgccccctggaggtcacctgtgtgtcagaatccccctaagcacgtgacaccaaggagagaacacataactgagctcagtgtttaccttggtattaggactgggtcatggcccaaggctcctagtcgccaaccttccaggcctttccacaacgagccctggagtcagcaggaagccagccaacaggcttctgcaaaggatcttttaaaggtagtaaaaagccaatgaggacaaccacaattccaagcaacagttggagtgggagccataaaaccagcccgatgaaagagagctgttgtgttttagtgttaacatcacttatgggggaatggatccagacacattctgaacagcctttgtttccccttgggtagccagctcctctctggagagttcagggaatctgcatatcaaatgtggcattttatggtgcgaactgagcctccagcggggaggaactgaaatttctggcatatacaggccgggcactctgctttaattgtgcccagagggagggtgactccttgtaacaggcttcttcatgttctttgtcacagctgctttctcagcagctcccacctgtgagaacatcatggctggctgctatggaccgaatgtgtctccccagaattcatacattaaagcctaaatccccaacgtgaaggtattaggaggtggggggagcctcatgaatgggattagtgcctttctcagaagagacatgagagaggatctctctctgccatgtgagcatgcaacaaaaaggtggctaagaagccaccccaaaaaggtggaataaaattttcatagttgtctaaatcacctatttggtgctattctgttaaggaagcccaaatggactattctaatccctgccaggaaggcctgcggctattacgaagagcccccagggctctgcagccaacaagagctgacatgacaccaccagcccactgccttttggggtgatgcaggaggtgggcggtcagcaccttgaatcttggactgtgggaattatagggattggaagagttttttccgagggtaacttccttgaaacacatcctgagagtaagaatgtgaaatccatgagtaacaccaccatgtgggagggttgcacaatgagctatatgtagaagcagagatccactggatgcacatacaagaaggaaccagtgtgaacaggcggcagcaccaatgtgaaaatgagtgagctggaatatactgcttcatggccaagctgatccataacttaacaccaggttgggtgtgtgggatgctggccccacactgaacaactgtttggggcagaccccaccaaacctaccctcccttcttgggaagccttgatcataacctagtccatgtagactgggttggggccacagtgcaccctccatctccctgggtggggcactaagatgggtgaacagcacaagcacctgagcagcaatggtccccaaaatctcaggatgaagcatcacttgcctctaccttcagcagcatgatgcccttctctatgttggcttaaatagaactggtcacagagcttcagagttatccccacccctcaggaagcatgggaagtttcttcccttagactccagctctctcctgcagtaaccacactcagcagcacagatgtgagggctaagctgcttgcctctgcctgacctgaaatgaagtcccttgggcagggaaaccctgagccccacattaatctagctagccatgtcctgagtggtaacttagaagggtgatttcacaggatctgggaaggtcctcctgccccctcccctggcttccctatcctcctccaactgcccacactcagacttactgacctgggcacaaaggattttatttgataattacaggtggttagatgtgcaactttctcctattcggtcattatggaggcaaatttattcacgagaagtccctttctggacaagggtccattgtactggtggagctgaagggaggaaaggggtccacacaggggttctgggcccagggcacacaatgattttaccagagacaagcctgagttcaccatctcttctctgtggaattgagctgtgcagatgaaatggtcttttaatattatctcttctagaaagaaattgtgacagtactaccatcttggttaaatatgaactttccaatcatattcttggtgggcagttaaacaagcaaaccaaaaacccctaactatgcactgaatgtttgtgtctccccaaattcatatgctgaagcataaatctccaatgtgatgatacttggaggtgaggtgtctgttaggtaattagttcacaaggatggagtcctcatgaatgggattaatacccttttaaaaaaaagacaggaagagatgatctctctctctctctctctaccatgtgaggtcacagcaagaagatggtcatctgcaaaccaggaagaggaccctcaccagacacagttctgctaccaccttgatcttggacttcccagcccccagaactgtgagaaataaatttctttaagccacttagactatgataatccgttatagcaccagactgactaagcacccctcatttcaacaactcaggcctatgacagtgttaggtgacatgggaccacagatcagacagaaatcttggagtcccaaaactttagagttggatggaaccttgagaggcaatcaaattcacgtcagccatctagaaatcagtaggtggtattcgaggagtgagctggtgcataacctggttggcagtctcaacttaaacacctctgtctctcctgaagggattctctgcactttccctgcagcactcttgagcacccattacctgctgttttccaaagaaaacaatggtttgacttactgttgtataaagagatccatttataaagagctattttgaaaaaaaacccaaaacatagggtgtgcatggcatatatatatatatatatataaaagactctaaagttacataccaaaatattatccctggttctctctgatggtaaatcacttttatttttctcttttgtgcttttctgtatgtcctaaattctctggaaataatacataatacctttgtaatcagaaaaacaacaataaaaggaaagcaacagcagttacttttaaagacccctaatcaatattttcctgccttgattgaaatagccaagcctcatgctagttccccattgtcagaaaacagctggagtgttggtgaaagcatgaaaggaaataaactggttagtaaaaagcagtggaggagctttaaagtaggtgctactttgtgataaaaatgtaccttattctactctcactcccgttgggtatagttgatccattagaggcaactaccaaaaatatctacttgtctagaaatctggctttctgtcacattgggatcagtaatagcctctaaagttaatttgttcttcccacattgacatgatttaaagtgatatgaacccttgtgagatgagtggagagagtagaaaatattacaagtttctggaagatccatggccttagagagcacacatactgcttgcatcagttgatatttatacttaagtaatggagagatatactatgtttacggatggaaagccacagtcttgtaaagatgttgattcttcctgaatttacccatagactcaatgcgatacaaatcaaatttccaacaggttgtgtgtatacacacgtgtgcacttgacaagctgaatctacaatttataaacatatacaaagtcctgaagacagcttcagtgctctcaaagaagaaggacaagggcttgtcctatgagatatcagaacttactatataaagcttttataattaagacattgtggtattggtgcaggaatagatcaactgaacagaagaaagaactctgcaatatgctcctgcagaaacagacatttgctacaagacagaggcagtattgtagatctctgggggaacagatagacttttcaataaatggagttagggcaaattggaattggaattcatgtgaaaaataataaaactaggcctttgcattataccattcacaacacattaaatccaggtagactaaaaaaataaacattgggtcccgcttttagaattatggcataacgaactctgtagacatgctcttcagagaaataaatataaatggtgaaatgatgattttgattttaaaaaaaacacacacactccaaacccaaccggttaaagtatctggaaattttcctaagtacctatagcacatgaagaaacatttattcaagaaaatctacttttgggaggccaaggtgggtggatcacctgaggtcaggagtttgagaccaacctgaccaacatggtgaaactccgtctctactaaaaatacaaaaattagccaggtgtggtggtgggcacctataatcccagctacttgggaggctgagacatgagaatagcttgaaactaggaggcggaggttgcagtgagccgagattgtgccattgcactccagcctgagagacagagcaagagtctgtctcaaaaaaaaaaaaaaaaagaaaatctactaaattcagtaaaaacagcaagagtcttacttgagccatgatctgcttgctccctctctctttgccagctaaatgtgaaggaagcttcattctggatggaagtgccaaggagacagggttccctcttccccagcttccagtcaaggtatataatatttccctgggaggtcaggatgccagcacaactaatccctgccagctccaggctgtggagactaaattccaggcaaatgcaactgagcagtctggggctctcatcttccactcagctctgactcataagatggagactctactgctggtgtgacagggcagtaacactgggacccgaagttccctcaccccagtttactcataggacagagatttcatgctgggagaagtgaactgagagaccagagtctaccatgacaaccaggctagaattacaactaagggtgtcattctaagagaactgggccattatgcccacaccaaactctggagcagtggcttggagattttggccatggggcgagacaggccattaaaatggagagctctgactgagaggaatttggaacagagtatgaggaagtttgagcctaaaagtactcttaaaacaatgaacattttggtggtaagtaattaagaggaggctggtagctccatgagagcaacaagctagactgtaggacagctagtttactagggaagaaaatgaaccaaaaaaaaaaaatgaacaaagcctcagagaaatgtgtgacaccattaagcacaccaccatatgtgcagtagaagcaccagaaaaagaaaagagaaaggaacagaaaattatttgaaggattaatggctaaaaacttcctaaatttgattaaaaaattaatcagtacatccaagaaattcaacaatcttcaaggaagatatacacagagatccaggtgcactctactaaaaatatagaaaacaaagacaaagagaaaaatttgaaagcagcaacaatttttttttttactcgtgtacaaaggaacttcaatatgattaacagctgactttttgtcagaagctaaagaagccagcagacagtggaatgacatattcaatgtgctaaaaaacaaaactgtaaacaaagaatcgtatatccaacaaaaccacttttcaaaaacgaaggcaaaataaggacattctcagataaacaaaaacagataattcattgctacatacccactctacaaaaggtgaaagaagctttttaggctgaaagcaagtgaccccagatggtaatcacatctacaccaaaaaaaaagagcactggcaaagataactatgtaattatagcagacagtataaatatacatttattctcctttcttgttagctgattttaaaagcaattgtataaaataatatgtttataactgtacaattgtgcctataacatacagaaatataacatacttgaaaataatagcacaaaggatgtaggtgggtgcaaaactgtattggagtaaggaaatgatatcaaatgataacttgaatctacaaaaacactgaagaaaaccagcaatggtaaataagaaggttaacatacaaattatataactatatacttgctctcatttattccctcagcttcaaatgacaaaattatttaaatcagtaaatttaaaacatgtattattgggtttgtaacatatatagttttattttgtgtaacagtaatagcagaaaaatgtaaagtgtaaaatacatataggaataacatttctatatctcacagaaattaaaagttttagtatgaatttgaagtaaattctgataagttatgatgtatatggtaaaccccagaaaaatcactaaaaacaccctccaaaaatgtaggaaaagtatcattaaatgacttaaaatgctacaacagaaaatgttcagttaatacaaaacaaagcactgagggagaaacagaggaataaatgaaatgagacatataagaagcaaagtaaaatttcaaatataaatccaactatatcaataaacatattaaatgctaatgaattaagcaatccaatcaaaaggcagagattttcagactggataaaaaagtaatattcaaatatatgctggctgtagaacacatactttagaattaaagatataaatagattgcaagtaaaagcatggaaaaagaaactataagaaagctgaaagagttatactaatatcagacaaaattaactttaatataaaacaatgctactggagataaccaggtgttatataaacagataataataaaagggctaatcaatttgaaagatttaatagttttagacatatacacatctaacaagaaaccccaaaatacacgaagcaaaagcgacagaactaaagaaagaaatagatgacaataatagatggaggctttaatatctcacttttaataatgaatagaacaactaggaagatcaacaagaaaataaaagactgacaaaactatgatacaactaaacctactagatcccgctggaacaccctatttaacaaaagcagaatgcacatttttctcaagtgtacatagaacattttccaggacagaccatatactagaccagaatagaaagttcaataaatttaaaagaactgaagtcacacaaaatatgttcatctaccacaagactgaaattaaaaccagtatccaaatgaaatctgggaaattcacagatacgtggaaattaaacaacacacacctacataaccaatgggtcaaataagaaattacaagagaaaatacactttgatatgaatgaaaataaggacacaacgtaacaaaacttacgagatgtagtaaaggagtgcttagagagaaacttgtagctattaatgcttacattaaaaaagaaacaggccaggcacagtggctcatgcctgtaatctcagcattttgggaggctgaggcaggcggatcacaaggtcaagagatcgagaccatcctggccaacatggtgaaacctcatctctactaaatatacaaaaattagctgggtgtggtggcttgcgcctgtagtctcagctactcgggaggctgaggcaggagaatggcgtgaacctgagagacagaggttgcagtgagccactgcactccagcctggtgacagagtgagactctatctcaaaaaaaaaaataaaataaaataaaacaaatttcaaatcaataacctaatctttcaccataacacatagtaaaaagaagagcaaactaaacccaaaacaagcagggcaagcaagtagtaaagattaaactggaaattaatgaaaagagaatagaaaagcaatagagtaactcaacaaacccaaaaattggttctttcaaaaaaaaaaatcaacaaaattgacaaaacctttagctagactaacaaaaaaattttttagaagtctcgaattactaaaaatagtaaggaggatgatattactactgactttacaaaataaaaaggattataagggaagagtatgaacaagtatatgccaataaattagacaactttgatgaattggacaaatttgtagaaagacacagactattgaaagtaactcaagaagaaataagaaaactatataagtaaagagatttagttatttaaaaatttcacacaaagaaaagcaagggaccaaattaattcactggtaaattctatcaaacatttaaataagaattaataacaattcttcataaactcttccacaaaataaaagagaagggaagatgttccaacacattctgtgacttcaatatcaaccttatatcaaaaccaggcaagacaacacaagaaaactactgaccaatatccgttatgattatagatataaaaaaatcctcaacaaaatactagcaaaccatatccagcaatatataaaatatatatcatatatatatataacttataaaataaatttatacctaatatcaaatccagggtataaaaaggattatacatcattaccaagtgggatttatcccaggaatgtaagattggtttaacatatgaaaatcaattaccgtaataaacaataggaaaaagggcaaaaccctcagtagttgcagaaaaagcattttgtcaaaaaggggttttatagtcacaagtgttagtaagaatatgaattatgggaactcacacactgttgtttccaaggaaagctggtcaacaattttgggaaagagtatggtgatatctagaaaggagagtgaagtacagtgcctagagtacacgctagaggaacactttcacaggtgcacaggaagacatatccaagaatgattccagttgcacagcttggaatatctccaaatgggaattaacccaaatgctggctgtcaacagcagaatggatacatcgtggcatagttatacaaggggatatccaggaatgaaaagaacaaggtatgactataccccatatgaactagtcttacaaatcagatactgagtgtaagaaataaatctgaaaagaacacccgcagcatggttccatttatatggagttcaaaaacaagagaaagtaaaccatgttgagacacatttatgaatataaatttagataactataaagaaagctggaagatgattatcacagaacggacagtggtcacctccaggcagggaggaggacgttgagtagggaggggcacgagagagggagcatttctaaagcacagcctaattcctaaaacacggctcttgtcttcacgatcattctttcaactgcatgtacacattttcatcccactgtctgtatgccatacgtcataatagaaaatgaagaaaaacatttccttttcaccaagtggtttcccttccaattctatgaatatgccagtaggtcagccttgcacgtggacacagctatgtgcagggttgtgtgttcaagcgttcctatgagcactcagccctcactctagttaaacacgctggccgggatgccgtggactgaggaggaacatgaggaagcagggcctctgtcctccaaggagaaagttagccaagttagctgtggctgtgtgacttacttttccaaggaaatgggggtttaagtgaatgtgtgtcaattccaggctctaccttggggttttactccctcttcacatccccttccccatcctgcacttcctcccggtcatctcagagcccagaccatggtgggctcagcagggtctgcccagataccccctgaagaggtggggagagacaccctctcacggaggaggtttgctcagcctctcctgccaaaccctcctgccaaaatcctcctggttctcagatgcctggccttccctacatcactgactgcagaaggccatgtgggcctgggtctgtgagctgagcccctgcggacccatgctggatgtactgcgtgagtgagaaacttttactggggtgccgaggttttgcagttgtttgttactgtggcataacctaacactcctctgaaacctccatttctttacgtgggtaataatttccacctacttgtgatgattgttagttctcatcattccctcctcctcctcctcctctcactttaaactggatgcaagaatactgagcaataactcatttgttgaattagtcatttacttataatccagactgtgattgtttggaaaattggagagagggatttctccaataaaagacaaacttgctggctcatgtggggttgacagcattcacaggaccatgaacggtcagatggcatggttcatcccctgatgctggggagcatgggtgatcatctatttcagactgtctcaactctgctagggaaactgcttaattccctcaacatagaactagtagcttgcaccatgtaatacatactcccagttaactgagaaacacattatttcagtcacttgttttagatatgtgtaggcacactcaagtcagacctcacagggagggcacggaaagggaaaatgaaataggaggtgagaagatgaggaggagtacagggaaagaaagagggcacagagagagacagggagagagagagaaggggggtgggagaaggaggaacagagcgtgcaactgcctggtggatattcaggtggctggagcaggctctgcgtgcccacatggactttactgacatgttactccttggcccattttgaaatgacctctccattggcatgaccagctactccccagctggccaagcccggcccaccctgattttgtcctaccctgagtttcaaatgtctcccagtcacagctcttcctgtggcccacatcctgcacttcctcctggccattccagagcccagaccctggtgggctcagcaggtgcttcccaggtaccatctgaaggggtggggagagccactctctcaggaaggaggttcgccttctcctgccaaaattctcttggttctcagatgcgcagctgtgctttttggctttgagattcctggggctagaaactcccaaccagagagtctcagtggtggtgctagggtcgggggagaggagagcctttctgaaggacgtgtcctttcctgggtcaggcaaaggtacttgtcaaaaccagatctccatcccattgaatgacaaaccagtgcccacttccctggaaggagtttttctccaattaacttaagtcatgtacctgcctgtctgactgacaggccccagggccctgggagaagacaagacatcccatcactcggcggggacacctcaaacatttgctctgttaattggctgctgccttattaagaggcgggtctcctgccgcagccttcattaccgatttccaggagtaactaggctcccccatgctccagtcaccaaggcggttgattaaatacccagattcccatgtctttgaactcagcagcttgctggtcgaggcgtgcatttctcagacaaaagtatccttagaaaggaggcacacttggatctaatcagcagcctctgtgctctgccactcctctccctccaattgtggactgttcttttgttctgagaaatccgacacctaaattcccctttggtctttctccccttaagtttgcatcttacattgtttaagtgtttaaatataatttcaaatggatattgtttaaattattaagcttttggaagaaaagaagactgctgggaaaaatgtgattggcagaaagcacctctgaggctggtggatgaggagaggtaaagacttctggaatcaagctgcttccccaccctcctgcggaacccctgcgtactggaggtggaggttgcaactcaggaaaggaaggtgcaatgaccctagagtgcaacactccatccatctatagtccaggacagggactgagccacagggtaggagaatcacactctgacttcggcatccaagccacatttcctttctgagtcagtggcccgctttccagacggggtggtgacagggtgcgccctgacgaagggctgacactttcccaggactgttcagggcccagcccaaatgggaaacttggctcttgtcagttgaaggatttcactcaggcctcgctgagatgacttgtacttctgcttagacgaggactggctaaggatggaggaaggcagttagaaccatcctggggtgggcaggtgtgatggttaattttcacaatcagtgcctggtcctgctgactgtatttttcctaagtgattctccggtctgcccactcccccgattcaggcttctgtgtggctttgttgaatgtcctcgatgcctcctgctgggcccctgcctccagggtcactctgtcccaagggcaacacaggtgatctttctgaacaccaggcctatggtttaaaaccctagaatgctgcctccccttgcatccaggagaaagtccacactccttaacctgatggtccaggtctggccccagcttggccaaagctcctttccaggcttgcccttgctgctttctctctgccctaaactctatatttggagaaacaccaattggcttgtggctccccatgctggcttcatatcctaacccttggcctagaagactcccctcctctttctctaacccatttctcatcatttagtactcagtccagatggcacccccttttggaggcctccctgttccttccataacagactggacgtgctccgttgtcgcgctccccaccctggtttacaataggcagggggtgtgtgtcccctctcagctccccatgggcagggccctctcacactcctcttggacccccgccaccgggccctcgactaggcctggtacacagcaggcactcagcactgtttgttgaagcaatgaaatgcggaattgcagaatcctgccaaggtatgaatggcccagatgcaagaatcacagatctttctatgaaatcgtgaaacacaagaatgaaacttgatcggtgcagtgttgaaaacagggaccactactttactatcctcaggagtgtgaacaaacaggcaggatgaggtttagagcacatgccggtaccactcatgggttcctgtgtgatgtacactagagaagctctatccctgatcacacccaccctgaattccttttccaagactgccatctcgggctgccccacaggctcctggtccccctagaacccaacatgggctgcacagaggctgagtccactggcagcaaatctagttagcagctcggtcctgagcccaccctgtccactggctcctctgaggtgagccatacatagtccccggctttttgctaattttgaaaaagggagagactgcgcaggtgctcactgcaaggcctccttccttttttaattacaggaatcattatatacatagacagtgtggcatagtagaaggaacaaaaacaacaaagaaacaaagattttcaaaaaccatcacaatttctttgtcgagtcaagagtggctaacaacacgggcacatgtcagctacacgtgcagaaagttgccttcagaacacaagtgagagtgcaggcacaatctgcccagttgctgaatgataatcactatgtgtgtgtgttttttttttaaattatacatgtaagagatgtggcagagcagacagagcaaagacaacatttaacatttcaaatcagtctttattgcagctctcctcctcaccggttgagtggtgttgggcaagtcattaaacctctgtgagcctcagtttcctcacctgccaagttaggggtaataacagtccttaccctgaagggctgtcacagaattaaagaacagaaagtgcacagaatgctcagccttggacctggcatgtcacatgggctctttgagttagttgttaccctgccctccattctcatccaatctctggttttttaaaaagggtaggatgtgtaaaatcacaatcatttgctgcaaagcttgatgattataatcacagccagcagagtctccgtggggctatagccacaggaatcctggtggtgccttcactcaagttctttccttcccagccttctagacaggcacgctcaactgtgcatcttgttttgtgccaactgtttctctaaattagtatatgggcttctgtcagcatgttttacagagagaaaccacatttctcagcagtggactttgccttccttttgtatagattccccatttcttcaggtcttcctgatacccacagttgtttaccctgagaaccacaaaagtttttaatatggaaagtttgttcctttaaaattgctaggagaatgtttattgagacaagcctggcacataaacgagatcttcatgtcactgaaatttggcagggggcagaggtggggacactggcgagaaggaacccaggcagaagtggagagacagaaaggtgtgaccgagaaatatggacgtttttcttcctgtgcaacgaagccctcaccctgtgtttcacgtggcattggcggggactttcttcctttgtaatgtgctcactggggttgtcacgtcacatagccacgtggagacagccactgaagttcaaagacaagatgggtgtaaatgtgattcatttcattaaaacaactggatatacaatatttgatgtctgcggtaactctaacttctcctcatttccctttaggggagtgagagtttttaggtacctgctgtctgatcagttgcaagtgccaagtctggtggaggaggaaggaatgcagccataacatcagcaaagctgcatgaagtctttccctctgctgctgcccctgccctgtacctggttgttcatgtcccacccacccactcttccaggttcaggtcaagccccactccctgacaaatatctctcctaatcatgggagtggccactgacacacactgaaaggggatgggcaggtgccagtactggtgccgtcatttacaagtccagtaactgggaaagttatctggcttctctttgcctctcagtaaacaccaactaggaaaaggagtgcatgagatgacgtccatacagcccctggcggtgggctggcagcctggcacattctccgtgaatgagaatgtgtatttcccatgatcctatccaccccaccctgatggccattccttcttttctgcaaggctgtgtcccatggtggccctttattgccttgggggttgaacttctacctctatctcttaacagggcagctcttctaccttctttgccttttcttggcaacagaatttggctcttatgcatttctctctaattggttaatcacattgtattgactgcaacattagaaccaatagttcaggccttcccaattgtcctgaccatgtcactggcatactgacacacgcccatgaacaaaggcttcatcacacaaggaagacacactatgacccgctgcggttttcttccacttcagttgtagccctgcatgctttctggggagcacactctagccaccgagatgaaggcacggggaggcccgaccgtaggtcgaacacgtcagtcagtggctgatccttcccatggtctctggatacaccagtgaaggcaggaggtgaagtctcccagatcacctgggaacagccatggacacttgtctggggctgcatgaggtttgttctgggctctgatggaatattgccctcatgtatgctttttaacataccgagtcaaggattatgcaggatctgttgaaattccaataagtcagtcaagaaaattaagcgcacttaacctcatcatttaccctttgcaatttttggtaactatatttgaaaaagttatttagacaccttctcatttcaagagcctctgtgctcacctaagccttgagttcctctttgtcagattctctgatttctctgtagaatgtgaagggttcatctttcactttttttcccagccaagagtacacggatggtgtattatttgaacccttgcccagcagaaaatactttttattctttccatacatggatcaccatttgataagtgtagaattcttgcatcatggtcttaccaccccaaaattctaccaatgttcttcattgccttcttgcttcttaatatcgcagaaaagtccaagaacagaatgttttttttccttcctaccagacagtgtctgagactcacctttgacacaaatgtaactgaaggggagaagctgcccctgggcaagccggtcagctgaaaccactcaagagcccccagtgcaacaccaggtaggactttttttttttttgtctgctttgtttttctctctctggatatttcagatcactttaattttttttttcaaaacctaaaatgtcagcaattatattttgacttatttgatagatctttcagtatagggcacttatttttttggatctctctttgcttattgtgtccatttgaattgctctgaggtctttaagataaccaatcactattattttaaatcttttatctctgtcttacataactatcatcctctcccacagtattttttaaatcttcttctcattctcggtgtatttggggagcggttttcaagtttgttccctgtattggaacaactatgatttctgtatggttaatctttcctttgactgcttgaagtggagaaggaacttctgcaattgtatttcaggttctttatattctttccttacctcccccagcttccattttatttttgactgtggctcagccaatttacaatcccattttttatctcatttcagagttcatgttttcttgcattgggagtagaacacagttgctgtctaaaatgagcttctgtttcttgtaataatttttccccaaagcatgctcttttgctgcatcttaagtgtgtgctctcctcctcctctgttgcagaagccagcttccctttcattcgtgttcagacaggtctgttcaggcttcacctctgtttactctcactgcagcccagtgagattgaccagactggaattacagctaaatccatggtcactgccacgacatattgcatctggagaggggtcttaacttccctgtaaccagcattcatggctaaacagttgagagacgcccttgaaaatctggagttctgcaggtgggtgggaaggagaacaagcaagctcactctctgcggaattaggatgatgtgtcactgaccctttctgacacccctgcccctaccctggtgtccccttctgaaacctcctcctttgtctagggtatttcttcttttgtagctttataagagacatcttcctcgcccctgctttcctgtccatcacccacctatccagaaaggttctgcccttcatatcctctgatgtctctaatctcgggttccccaaatcattggacaagcttgcacggggaaaagactaaagtctcagctatgaggactcatgcagacctgggtctgtacaagctccacctgactggatataagtaaagatctctgaaaatccctataaaaataccttgggtttattatattttgatggaaatatggatcactggatgagcatctgagaaacagagacaaagatggggtggaggaaggcagaaagagacagagatgtacaggtgtattggaggaaaagtcagagagctagccaggccgaatgagtgagggaggcaaaggctcaaagaggcatttgctggaccactgtagaccaggcctttgggcataccttagccaactgaagggggcatggagtgcactgaacacaagcagtggaagagaaagcacaagttccctaaggaagacaagaaaagagacatggctgctaagtccctggatgagcccttttttccagctacaaagagaagtgcacaactgagatcaccctgcttataataagtggacggagttcactgcatctggctattttaattacctgcaagcaaagtgattttgctactttcctttagaggagctttttgaaagtagttttcactctgattactttcattaacaagtgatcaaaatgcatcaaagcagaaatgagcacaacaagaagaaaagcagagggaagaactctctaggagatgtccaaactcagtagtcactgttaagctctgtcttccctcattagcctggagaatacatgtgttctggatctggccctcatgaggcacccaggtgcaggactgggcacaagctcacctacaatcaggaagcatgggtggttcccggagacccaggatgctgtacagggctgggccccagctttctgtagttctgtccctcagttctcctggctgaggactcaactccacagaccttacattcagttgtttggtgtggtcttgttcctccttcatccaatgagcctgctctgctgggaagtgtttactcctgaagacactctctgctgatggagatgagcagtcatttactctcccctgggtcactgcctcctgatccccctcatttatttcagttaacttgacacagtggcaagtgctcctccctctctttggagaagatggcccaaactgggtcactgcttccctgtccagaaaagcaggcagagaggctgagtgatcatgcgaggcacaagggctggggcgagggagggaacagccgagcccccaggcctctgctcaattcttgtacccactgtcctcccagccactggccccttcaatgccttatatcactaggcagcagaggaacctgaaagggatcccatatctagaaaagagcatgaaagtcctgtccttgagcttgctagtgggcataaaacactttgaggcaggcgtacagagaccacgtatttgagttgtggctggtctgacagctgctgagtctatcacacagataattagacaaactgcttgagcacagagattcaatacatggtgtcatttagcggctgctacacgggggccttgatcttaattgaaggcacgataggggagaaccttaaaggagtcccaaatcaacttcttcttgctccagtaattaaacatctggctcctggtgatcatctgaaacctctcgagtgttgggcatagggtccactcacatggatctgagcacctgagccaccggcacccctcctgtccacacagggccttcctcaaacagcctcctgcggagaagcctggggaggaggctccatgtcactccctcccctcatcaaggccacttttgggtgggcctcacggagtaatgagaagggcaatatagccaagtggcaaagaacttgggcttccaatggccgacagagccctatggggagatcaaccccatcagccctccgacttgctcagtttctctctgcttacttaccctggtccagcaactctggcccccttgtgagcccccaaacacgctaggcaagctcctaccttaggatctttgcaaactttgtattgccactgcctgggatactcttcccccagatattcaaatgcctcactccctaaccccccggcctgctgcagacctttgcccaaatgtcacttctcatatcagaggctctggctaactgccctcctggctttattctgctccatggcacttgtcaccatcacatagacttcatctcttgtttactgtttgtttctcccacaagactgtacctgccatggggactgggctctgttttgttccctgctgtgtccccacatctccaaatagtatctgatgcatagtacatgaatattgctgaacaactggacagaagggttcgagcaggacagcaccatggtcaaagttccatcttggaaagcttactctaaatgccatatggaaagtggatttgaagaagcatctgacccggggctcagagaatagctaggaggccatagaggtcatccagccaggagatgatggtgggatggaccatcccaggtggaatgagaggtagactgaaacgtgaggagaggtcagggatgaagatatggttgggtctttgctcgtgggacagtctgggtctttgaggcatggctggaactgtgagaagagagccccaggggaaatacctggaagcagctgcaagagaaggagggatctacggagagtcagagggatgggggctggtccctagaagacagtggaacagggttgcagagaggatgacagagctcactgcaggaaggatgcatgcagcaagaccaggcctggaaagtgccttcttggcatttagaagggtaaggtgatcttagcaaagtcagtggcaggggtaacaggacaggagctaggtgcagaccctagagggcagaattcagggaagttgcagaagtggagacagccagtgcagaaaatgctctgcggcctgacagggaagagatgaaaggctacctaggaggatgctgggacaacagcttgctcctctgggctttaggatgagagagactaggccgccagcaaccaacgggactgaggagtgcacagcaaaggaggggttggagaaagaaggacaggatgccagaaaacagcaggaaacaatgtgggggactcggaggctgtagcttgtttccataagtgaaatcaatgcaccacgagacttactcagctcagtaacttcttagcaatttttaattactggaatgtaattaattcattcaaagtacagcagttctgtggagcacaccacacatgccgaactgataatattcttgcacatttgcggggtgctcacaccaagacagttccttgcataaaacctggaggaaatatccaaagaacacacatatttgttttaggtcacttttcttgatcctggaagcagatactgtaaatgggacaactgagctcccagggatgctggactacggggctatgagtgaactgtcagttcagtgaagtcctagttgttttcacagatgctgacagaatccgcggaggagtgaggagagggtatccaacatgagagacagtccgtaaagattcccgtttgtccttgaggtcttggaggcatctctggctaaagcagctcccaaaggataacccagagggtggagatgtgtggcgtttcttttggctataaattccttgaggtcaggcccggtgttctgatcatactggtatcctcaggtcctggcacagccttagcaccaagtgggcattcaacagatgtctgtgaaggtgagtggcttggcagaaaacagccaaaccctcttctgtggagcttaaagtgaaggccaggaagagggctggggacagagagatccctttgcaaagactgaaagaacaacagcggctactggacagaaatgtgggtaggcccaaaagtggaagggcaactggagggacaggaaagggagtctggagagaaagtggaggccagcttccaaggccagaccaggctgaaggtaggcttgtccccagaggctctgcctgcttttgaccccaggttcccctggtaaccttctgggtatccctcagtttcctactctttccttagaaaggagacaagggtctagtttcctgatgtccagaagctctgtgagtttgggatgattgagccagctttccctggagaaggtgcagctggcttcttaatgacctgcggagcagggaagccccgcccagcagtggcacacgaggccctttccactgcccatggctcctgagccttccttctgcaccaggaggtctcctggggaagaagcataaagcaattgcatctgttagggacatgccttgctgagccctaactaaaaacagccacaaagctatgggtgcctttgaagggcctgccacagcagcaaaggctgggccctggcttggctctgcctgtgtgacttgggacaggtactagccctctctgggcttcacggtccctctttgggaaatgagaatgttgcagtagcttatctgacactgagaggtgacagcatgctggtagcccttgctcactcttggcgcctcctcagccttggcgcccactctggccatgcttgaggagcccttcagcccgccgctgcactgtgggaacccctctctgggctggccgaggctggagccagctccctctgcttgcggggaggtgtggagggagaggcaccggcgggaactggggctgcgtgtgacgctcgtgggccagcctgagttccaggtgggcatgggcttggtgggccctgcactcacagcggccagctggcaccactggccccggacagcgaggggcttagcacccgggccagcagctgcggagggtgcgccaggtcccccagcagtgccggcccaccgggctgttctcgaattctcgccgggcctcagctgcctccccgcagggcagggcttaggacctgcagcccgccatgcctgagcctccccaccactgtgggctcctgcgtggcccgagcctccccaacgagcgccgccacctgctccgtggcaccaggtcccattgaccgcccaagggctgaggagtgcgggtgcactgcgcgggactggcaggcagctccacctgcagcccggtgagggatccactaggtgaagccagctgggctcctgagtctagtagggacttggagaacttttatgtctagctaagggattgtagatacaccaatcagcactctgtatctagctcaaggtttgtaaatacaccaatcagcaccctgtgtctagctcaaagtttgtaaatgcaccaatcagtgctctgtgtctagctaatctagtggggacttggagaacttttctgtctagctcagggattgtaaacacaccaatcagcaccctgtcaaaatggaccaatcagcgctctgtaaaacagaccaatcagctctctgtaaaatggaccaatcagcaggacgtgggtggggccagataaaggaataaaagcaggctgccccagccagcagtggcaacctgggtccccttccaccccgtggaagctttgttctttcgctctttgcaataaatattgctgctgctcactctttgggtccgcactgccttaggtctgcagcttcacttctgaggcctgcgagacaacgaacccagcgggaggaatgaacaactccagacgcgccgccttaagagctgtaacactcaccgcgaaggtccgcagcttcactcctgaagccagcgagaccacgaacccaccagaaggaagaaactctgaacacgtccaaacatcagaaggaacaaactccggacacaccatctttaagaacttgtaacactcaccgcgcgggtccgcggcttcattctcgaagtcagagagaccaagaacccaccaattctggacacaacactggtcagcttgagttcagacttccctgcttggcacacaaggcctttccccagcttgctgtgatccacttgtctgcctttatccccaactatgctctcccctacacccaggatcccataatcacttgctcttcccggagactggaggtacttcatgcctgtactcctagaaagccttccccacactctcaacctagcaaaccttcccttgctcttcaaaatccaccttgaaggtcccctctcctccagcaccttctctaaacgttctcatcttcaggcagatgaattcttaccccaggctccactggcatttcctgagagcccggaggtacattctaggagctttgtccagactggggatcagagatacctgattctccccttgcttttctactaacctgctagatgaacttgggtggctccttacatctcttagcaagacagagaaggtgatcattaactttgatcaactggaggtcaaattctagtcattcattaaataaatatggagggccaatgttcttctctcccctcattcacaggaggacccaccacccctgacctcttagctcattacagagttgtcacataaatgggcaagggtcttacagcttgttgcatctgctccttgaataagccgtgatgttacaacggcaccagcatcatccctagtgctgttgacactgcgtagagaagaatgctcactgcatgccaggtgctgctcctgtcatactcacaacactctatgaggtaagtgctggtattatccccattttacagatgaagtaaatgaggcacagaaagctcacgtgccaaagcagtgcccttgagcacgtgccacattgtcccatcagcctgggcctccctgatgcttccacaggccccagcacctcttgctatagggactgctccagcagagttacactaaatcccctatcaatgcctgacagcatcacagccctgcagctggatctcacacatcccaggaagtgagtctcccgctgagagctggactgggctgacaaagctggggatgtaagaagctttccctggcaggacagagaatacttgtggaagtatagaaatgcccctggaggtgtggggcccaatttaaattcctaaagtaacaagactcagagtaacaacaacagcaacaaaataacaagaagaagaagaaaaaaatggctctttggcaggaagctctatttgctctgctaacttgcaacaaaatactgagtttttatgtctgcttagtaacaagtaagaaaaaaagatttcttagtgagcctgtagtatgtttaatttgtttccaaaaatggaaatgatttcctgtctttcattaggttgggaactcccctctgaagcacccaaatccacctgcaaccgcccgcaggctgaggaagctgaaggggccccttaaaacagaacctctaacagtcccctttcttccataatttcatggtttgtttggaaaactgcccaactatgacattgtatcatctggtataatacaacgctggcttggtgagtgattgctgaaagggaagctcatcttcgtgaacagcgtaggagataaagcgtgaattcaaaaccaagaaaaatgagtttaaaagtgccaactaatacacaaataggaatgcgatgtcacaagataactttgaaaacacaaactctataagaagttaaacagtgaaatccacccaatatcttggcattctcttggtaggatttggtgctgaggaaaaatgtgactctaattttgctacaagaagagatacatctttcccacacctccttttgtcccagactttcagtgagaccctgcttgtgactcaggagatctgggatcaaagctgtaaactctagctgcagcaatccttttgagtctggttgatttcccgtacatgctaatgatccctaaatgatatatttcattttatattcacaaggaatcccattgccatagcaactggaatgtgataccagaagttttcttgtaaatgggtttagaatgctgcctcttctcccttgcagggtggtgaaggctatgtgtccccccaccagtcctcaggagaaccccctccctgacaggaaatcagggcctctggccacagacgggagctctgaactgtagcagcttagcccagcacaacccatcacttctctcctcttgctccacacactccagctgcacaaggacttgtcctaatattgatttctggggacagataaagtcccagagaatgaagtcacaacttcttcttgtaaagtctgatagaaatagagaatgaaagatggatgattttagaatttttgcttgcatgaaaaacaaggtatttttttgtttcctgtattaataactccctggaaaattgggacaaatgacaaactgtcattcgtggacctcaagctgttattaaatattctgctgccattgtggggtggggactgtaggaacttgttctttatatcctcctttgttccaggaccctctgtccccacagaggttcccgacagagcctctgtcatctatttcgttctactcccccctggagccatggttctggtgaaggtgacgtgctcaccccaaggcattcacctcagggctggcctgccttccatccgtcaggctcctgtgaatcagtgcccaggtctttcctgtttgctgggcactccctatgggaatgatcgaggagaggcagcccagctcttctgccctcccaccaggactacagctgaccctgagggtgaggcactgaaggctttccactggagtccagacccaagaggccatctgcagaaagagaagccctggctctaggtggacattgctgggagaggccccagcaatgagtgtctgcctgacactcatgtcttccttacccactctccagctaccattaaataatctgggcccagaaatctctccccaaacctcccagacagaacccttgctcctgcctctgcgttcttcacagtttgtgcatctctctactctcggcctgtggccacgctggattagaataaataatgatggcaggtctcatgaacaccaaatccatgccatgcaccaggcagcgtgctaagtggtgcttgtgcagcccctccttcacttctctccatggctgcagcaggtgggtactgccattagtcccattttacagtcgaggaaaaggcccagagaagcagagtgatgcaaccaacaccacacagctgggaagtaccagaactgagatgccacccttggtctttctgggagctcacaggcaccactctccaccaaaaaggggtccttaagagaggagcactgctataccaagtgggcggcaactcacaatgtgtgaaaacctcaatgagtcagaaggattcggtggataaattcaatcagcatgaagcagaactgagccctgatctgctcaaggctgcctgccccccgctccacgccagcttgtccccatcactcctcacctcggtgggttttgtggtggctggtttttccctcccattaaatgagaaatgttgtttgaataaccaatggtgagggagggtgtgcacactctgatgcagaaatagaaacctttaggaagatgcaatttgaaggatattggaaaccagagaatggaacatcagtctataaaattcaacacggccaataaagctggagcaactggtcaagtgttttagtgtgcacggttgcagaggaactggcggcacgtggctgggcagtgcttccagaatggggacgtttttcctaggctcattttggcctcatttccataatgtgtctcatgatctctgaagcaccttggcattagcatcataagcacagctgtgaaagtgtccaagactattgtcatcacccggtaaaggcacatttcccaagccctgccctgcctagcactctatgctgccacgactgctgagtggagtggcccattaggtgggtgcaggtgacacagatagatgtaacagaggccaacacacctttgctccaccacctcagccatgaatccgcctccgctcaggtgtgtcagcatcataccatcctcagtggggttctgtgagggtgaggcaggagctctgccccttcccacttggtgcccaggcctttacagcctggactgctctcacgcctttgtcttctagtgttgcaggcacttggcaggtgtctagtccaagcctcctcctctcctccctgtgcaacctaaagcacattcctgacctcacataactccaagtgggctctcgtagctcaggctatgtgggcctgttcccatctgcctgcaagctgcttctgtcttctacacacttcctaattcatgtatacccattttgtacacaaatatttgtatacaataaatacttccacaggccatggcatgtactatttaccagggccacatcaatcaacccaggatgtgcattctgacccttgtatcttcaagcatctgggagccattgagcattttcttggtgcagggcacagtgctaggtgctaatacataagcgcataagacagccatagccgctgccctaatggttcttaccgtctagtgggagctggtacttcccttcttttctgactcaatctcagcctaaagcatgaatccttggccccagctccacagacatgttctgatgtccatgcaggggcttccttgtcttgctcagaggtgttctggacaggcaagacatgggatgccttcccatcaacaactgccccaggccagagtttgtgtccttgtcacgctggaagacattgcgctggtgtctgcctgaccacattctatgcacagcacagcctcctgattcatgggactctgtgcagaagggtaaacatggtccttgtcacaaccttgcaaaggcccgtcctatgtggagacctgggtagtgccctgttgcctggtccctagtgaacctgtaccagccaggttttaatttgacctgcctggattctactccccaaggagcttcctctaagggcaggggtctctggaggtgggacacagagtatgcatcaccaaaatgccactgctgctattttgttacacaccagtctttgtctttatttcctaaacatatgtaacttgtagactcagcacccaggtcacttgtcaaaaaggcattggaagacccatcacaaaacccaaaaccacagggcaagggccctgttcctacctttgaggaaacagtccttgctgtggatgacggtgatcctctttcccaggaggcaagcagcacggtggagcttacagtggttttcataaaacctcccatcagagccgcacacaggcacgtagctgggcctgcatgcctccaggcactggcattcgggctcccctgtcttcctgctgagcacgcaccggctccctcggctgcagaacttcttcccgcaggaggccagcagctcgttgtggctggaaagccctgccagacacacaaacacagagggtcagctgtaaacactcagagggtctggggtcgagggcttcctttgtagctcacaagcacagactccatttgcctgtgcagccaagctactcaaggtggggcctgggggcttggggtctcctagggagtccctgtccctccatgaggtggtcattggtgccaagaagggtgtcctgccttgcagagctcaggtttcatggctgactcactctgaacatctgaaacacaacacctttccaacctaggacccagctgggggcttttgatcaactcttggttctttcttaggcttacttttcctgcttccagttgaaaaatgaaaacacccagctattccgtgctcacaaagaagcaccttgcacagaaggacaaagcctgccactactgctcccaggctcacagtcagcctcctggactagaggcctattaaaatcaatgactttttaaaaaagtggtcccctccaccccctgcctgcaatacgttttccttccttccttcttttcctttactatgtcatgactttggaccaggctgtgtcttaggcaccttaggggtctcaaagatgaacaagtcatacctttccctctttctgactttgtcattctgtaaggtggtgacatgtatgcagatcaggcaaagagcatgggagccagggagctaagtttggaagaagtaactgggagtggcggagatcatggagcgggtgatgtgccagtgggccctgcaaaggagagaaaggttttcccagaaacacagcaggcttgagccaagactcccccagccgccctgtgggtggcatttgcaggtctcaggtagaagactagatgtgagtaggagttttgtacagtggtggggttgggggtcaaggtgtgatttctgggagacttggagagccaagcagagaaatttaggtacactactgtaggcactggggagtcactgcagggaggaaacgtggcataagaagaaagtcatgctccaagtgttcaggatgggggtgggggtagccgaggtagggagaccagaggctggccatttccttgggggagaatgtggttctccatgacacacgtcatcaggggagacaccagcagcctttccccacagcccagtcctttctagcacaatgttgcagttatgggcaagaaggctgagcccctggaaacgggcgctgccacattgcttgagtgtcccctgcaccctacaacacccacagtgatctcaggcagcagcacccagagctcacacaccaaagaggtcagggcagctggaaagggcacgtttaagtgaaaggcgaaacaggcgtccatcaccaacatcacactgcattctgggagtctggaaatgagataatcagcacatgtcactaaaggtacagatggaaagttgagaattacacagggacaccaaaagacaactgaaatgtgaatacagatttttacagcctcagaagactttgctttaagtgttaattaaatctccatcaaaatactcagcaagacagaatggccctagtaatcatgaccaaacttttagccccgggtcctacccatgggattaaaatgtctaagcaaaaaagaagaaaaaaaaaagaaaaaaatatatttttcttgtttttggttaagtctgcttttcatcattacagatttgaaaggaaaaaaaatcagttatcggcagattaactgcttgattcaataattcatttaaattcctccagccttggcaaactaagaagtattgactttttcttgaatcataataaactagaaggtcaaatatctctgagcagtataaaagtgcagatcctaaggaggcgggaatctcttttatccactttgctaattgttcgcatgtcaccatgaaggcccagtggcattcagcggcccctctgcacgccttcctgtcaaggttgatggtggcggggagggaaggaggcggaaggcaggcaggcgcctggcagggaggctctgggctggaggccccccactcacggtgtttatggccgctttgccatggagcatatttgattagcgtgattctcctgggttgttggaaaatgggttaccctagaaagtgctggcgcctactagaagaaactaacagctctgaaaatatcagcctttgtttctctcccaagacagggccaggacgcagagcattgccatgggatcactgttttaataaccttcccatgcagataggatgcaacccactaattgcccattttgaagaaacaagaggcaaagtctctgtgccctggcctctccgagcctgcttcagagcgtgtgccctggcccccattgctttctccctctggctaaaccagctccaagtcactgttgtaggcattttctctatgaagtgcttgctaccagcccaagtccaagtgtccctctctgaatcctcctaccccaaagtgcctgccctgctctggcctcaggaggtcccacaggtgctaggccttgctcctcgtgtggccccagtatactcaggttttaagaaatgcagaaattttcagaactgatctcctgaaggctaattcagtgcagttaagaagccaggctaggggctcggatggggagggtggtgaagcctcacatgtgttgacccggtaggggtacattttcccttgccttctccaaagtgggcaggaaggaagtggaaggatggaggtatgaggggaagatggatgtccgtggaggtgggtcttctggagtaaagagaactagaatcctggagaagcagagttggaaggggcttcagagaccacctactccatcccaggcaggcaaaccaaagccagttcatggggggctggggggagaagctactttccctgaccccctcctttgaaagctgtgtgtccagatggtagtgagcacctctgaggcccagcgtcacacagggcagcaggcacctacgtttgcttaacttgctggggaggctcccatggccttccctgcaggctgcactctgaggggtcagtgttaaggaaacactggtgccaacctgtggctgctgaagttgtcaagaacactcaggttctccctgacatggaaattggctgtcggcaaatatttgattcctgattacttgcaattaagacaaaagtagcatgaaggccctgcatatgcccttcacaatggccccacagagggctgaggataccccgggcggggtaaggcccagaatctgatccacagctacacagatgctgacccaggggtgggctcctcattaaacaagccccttgttaccacttcctccttgtcattaaaacagaatgaattccccactcctaccacaatgatgataaaacagtaatgggaaaggtaaccaagtgagactaccagcaactgcctatagtatttatgaggacaaccacaatgcatgaaaagtacaatgggcttaatttatagtcatcaagaaagccatttactcaggttaaaaactgatcatcttgccaaataagctgctttccaacacaaattaaatttactgaacatggtcagaaatgggaacagttacattaacattatggcggcaggagaaatgagtctattggtaccagttggtgctgaagactccctctgtgatctgaataaggattttcaataagaatgtcacagacccaggactgccatgaactgggagcatagataggtacaggtggtgtaattgagcggttgtggaaggcaagcccgtctgaccccggtggaaggcataaaaggaggctgagtcctgagatgggccccagagagagtgagtctacatccacatggagcaggaagcccctccgttgttctcccacagccagccacaaccaagagcacagacagttgggtaattttgcttccaaatactgactcagcctctgtaaccgcttcctgggcccaaagaaaactaacgagtgctcccttctcagggacagtgccccaagtggcagtgagggaaaacccacgagctcttccactcttggatgccagcggcctgctggcacgttcttcccaacacagcttttctgtgtctcagacctcatctccagcttgactattgatgacagccctgtctctcctgaccaggccttgggagctccctgctcccatctcagccagatgttctgcctaggcctgctcctgaaggctgtcagtgcccccagcacacgacctagcactgaattccacaacctcaccccaactcactatgaggcctcaatgaggtgatggcttggctctgaggaggcagtcactggaaagcccaaaactggctgaaaagagcaaggcgtgaatgcagaagaccagaggcagtgtgtgcagcatcaagaacctcaagaacctcatctgccacctgccacgaaccctggcccagtacagcagctgtctccaccttctgcagacagaggtacttgtccagccaagtgcctgcccatgggcagatacagcccttacacatggccttatatactttatcttccaggtactgacacaccaacacacaggggagcggcagccctcgcctggggtcatggttgggtttctcaatgacccagagcgaggctttgcctgcggaagagccatgtacatgtagccatgtgcagatatgtggggtgcgcatccagggattggacataacggtcccagtattcttccccgctttaagataacttataccctcacacgtggcaaggtggtccagggacagagagtgcctgtcagtgtcgactctctcattgcagaaaccacccaagtgcctggtatgcagctgcagaattcaggtttgtgtgagaaccaggcagaggcccgacgctccagtcccgtgccatgtctaccctaagatggggtgggtggtaacaacggggcacttccgcagttcctgcctgccagctcctcccctatctatccacccaacaaatatttactgagcacctgctatgtgccagtcccgattccaggtgctgaggattcagacagaataggctcctatcctcagggcactaacatgacagtgtaggaagacacacaagagggtgaactggcaaacaaaaaaacaagacaagtgtagatggtgttaaatgcgaggaaggaaataaccagggtgctgcagcgggcacactttactctggtcagggaagcctctttgaggaggtgagattagacctgagacctgacggtgaagatggcagagacctgggggaaggagagagtggagcacccttgggtgccctggaacctggcatgcagggagaggaggcctggtataagaagaggcctggctcctaaagccctgctccaaggtaaacatcaccaggcagactcagtctgcagggagctgtgaggcagatgcaaagtttcaccctgcccaactgtcccacctgggaagtggggtgaggccctgccatcccaccactcagccctcccagctgaaagaggtctatcctcttagaggccagaaaactctcggcacccctcagggctgctggtgggaagagagcagccctctctgagctctgactacaggctaccttggtgagggcctccacactcctagatgccctggatgccggggctgcgtcaggtccacctccaccctgtaacgcctcatttatattcaagggttgggatgagaatctgtaattcctcccaaggacatgtgtgtgttaacacccagccagagaaggccatgtgtaaagtgactattatttactgaggcaggcccaccaggcaccatgctaaactcttagaatctatgagctcatctgatgctcatttaatcctccttaaagctctattaagtagacacagaggccctactcagcacatatttgtggcatgaatatatgcccattttacagattaggaaacatgagtcaagtgacttgcctatggttagacagcaagtaggtggtagagcctagctttgaatcagtctcactccaaatcccttgaacttgggataatctgctcagctggtgatatggtctctgcttcaagttcaaggaactcatgcctggaggatctagatgtccatagtgtgagcttctccaacatcaggatacatccacacatcagcaaccctggcctgcaggatggctgctcctcacccacctcagggacacatagcttagaggcctaagtagcaacttctctaaaggctggaggtttgcagggctgcagaaggaagccctgcttggatctgtgaacatcacaggcccaaacccactccttgtcatgcatggacacctggccattaagccccttacctcccactatgatgtttccatcttcatcacctccctgtctcctctcctgctattttgcctgaaactggacaggtgactgctgggcagatgtgatgtattctcagtgaccacaggtgatttcaaactcaaccggtgagcacagcctgtatgctgaggtgcttgtgcacttgatgaaagcagtttgaccagttctgaaagacttgaccacattctccaatcccaaagctcaacagaaacacatggttatccattgctggaaggtaatgcaacctgccatgcataatgtttacagatcctaacctgaggtctgacaaattgacttcaaagtcagaaatgcctggaacaagaagagagaaggaacacctttcatctgtcaggaggcctgtcaattctgccaaaagagtttctatgtaaccaatttgtatgaaaccaaagcacaaataggtttctacatattgtctaatgtccctgggcacggcttttggaggtggttatttctggtcacagctgaagatcaaacaccaaacacaagtgccaaagcatacttttcaaaaacttaaaaatgtgactgtcacgataatctaaagtgagcatatgttaaagctgtgtttgctttcttaatgagagagcccacagtgcagacgctgattcagaggaggacttgaggagccacatgggcactggagaaagaaggttgggatgagatgcctaggctaggcacacagtaggtgagtgatctgcagggtaagaaaaccacaaactttcgggttctcttttccaccaaaaagaaccatgtgcatttttactgggaacaaatgtgcaagttaacatgtcactgcacagtctgggcctttaatcagcggcaaattgtgagttgaacaaagacgtaaccctctagcctggatcagtaagtaatccttgggcagatctagtaaacaaggtcccagagggaggacttgccaccctctttttcccttattcccaagttttggataattttctcaataccacccaaatccctgcagtaaccaacgtcacctgagggagctgccaaggtctctcatctctttcttctgcctggggcatcttccttcagagcccccagcctcacaaaaagaccccagaaaggcaggaacgtgaggctccaagccacttaactgagacttactgagacagagagaactttctcctgggaaagtcccctggtggagcagagggagaaggggctggagccagaggccacgctgctgtgggggagctgaccgagctgaggatgcagctcctcttcactgaggcgggggtggagcgggggcggggtggggtagggggagtgctgcaacagaacttcctacggtacttgtgttgatcccgctgggtctcaagtaacacagtaacacagtaaaaccttggcctccacccagtcctgtgctccttcacagctgatagttgtgtgagcccaggcaaggttccaccttcttttccctatttaaaagtgacgataacaatggtccttacgggattgccccttacaggattgctttgaggattacatgagataattcatgtagagagctaggcacttagtaagtgctcaattcggacactgaattggtgaaaggttgaataaataggactggaaaagtagtagccatttggttttactgattcaagtgcatgaacatgtggggtagttgctgtcttcgggaggccagccttaatggaaaggtgaacatatttatactgaaagtattgaatggtttttaaaaaggcagatgcaaaatagcatgcttcaaaatacccaaaggaaatgcttcccttgcaatttcccttgcgccagggcttcactggacccttataaactccgcctggcttccaaggtaggggagtctgaaattatacattcttagggcaaagtgactggaactaactcacagcacaaactgcaggctctactcaacacctaagggcagtgtcaggtagtcaccagggccgctggcctgccagaggaaccctggtgacagtttcaaaggcatcccctgacctgggcccaatgccagcgtatcttgcaaacctctcaggctcacctgctacagacaggtcctatggtttctcctccttctgggagccctttgcactgtgtgtcatctccccatctgctgtctgtgacaatagtgaagctacctgactcaccatttccagagctttccccccagccctcccagatctcctccacctaaaggaggctgccaacctgctggcctgaggacccccgctcctgtggttccttagacggaacagcaggccccgaggcagggccccagcagcgccttcacagctgctcagaactccaggctgggcatcaggcagtgtctgtggtttcagggttgggaccaggctccacttcattcagagctcagcaccaggcctggcacagattgggctgggtggaggactgaatctgatgaagatgctgcagagacccaagactggctggatagagagctgagtaatccatcaatggttttacagaaacagacatggtcacagattgagtggaaagagtggagactgtagaaagccctcggtgggagaatagcgacctgggatctacaaggtgtgtctctttcacatgcaaccctcagtttcctcgtgggtacgtgagagggctgtatagagatccctgagatggaaaaaattatcccacatctgtgaattgaggatgtacatcagagcctgtgttttaacttggatgtcttttggctacaataaaactgcacaaacctttttcttttccctctatttgtcctatcaagttatctcaaccggcttttgaagggttattttggagaccttcttgggaagaaaagctgcataaaaatgtcaagtacaatacgatttctgcccttgggagagtttcttttacaaaacggctttgttttagacacttcctccaaatatattcctacccccgagttccttttctttgcctaaagcctcttcagctcgcatctgtcttattccctgtcaccggccctcatttttccttcaggtacttagctcctttgtcactttccccagctcctctgggctccctccgtcttggagccaaggggaccagatgttgctgctctccacggtctgcaccgtctcgctgatgcgccactacgtgggttccttcctgcttttccaccaactaatgattcaaggccgtgacaccccaggctgcctccaattatttcaagaatcactgtggagttactctgtgagccgccgtgatgctccttgtcactttatccttggagacttgccagcacagatggggagctaaattcttccagggccctttacctgccatacaagggccgccccggtccgcaccttgccttggttggatcacttgtcatagatgtgtctcacaataacaacatgcttttctccttcattctacttttaaagaaaaaaatggctcagttaaaatatctaatattagcacagaaaactaccattttctaatcaggagcatttcaatttctcctctcaaggatctgcccttgtctctcaacgggattatcagccataaaaacatgcactggataatatcaagacaaagcttagtaacaatatcggacaatctgatttcatctattctcaacttcaatcccctggctcaaccgagccaagcagtggctgaggcctctgacaggtgggcctgagggttctgggaagctggctttcctgaatgcatgggtgggctggtctgctctacccctgagtacagaagagcatgtggagaccaggggtctccactggggcctgacaacctgtctacttctatgagaagctcacagggtcagcaattgccctatcaggtactctctgtgagaccaccactgccttaaggtacttcagtgttgccttcaaacaggctatggaaaagaaccatatacactgggagctccagcctctgaaaaaatgactagaattacagctactgcagaggaggagtgacaccttaaatagtgacaacaaaataccaaaatgccacgagaatcaagcacagcacaaagaaggcttttgggggaactatgatttttgagccaacaagaaaatcaggagaatttcaggaaagaatttaaggagataatggtcactattgagatgtcaagtcttccaaggttaagaatatcagggcaatttaaggagacaatggtcactattaagactccagtcttccaaggtcaagaagaagacatatctcaaaacctagagtgaaaatagaaataaagaaagtcttaaaatacagtaataattccatttaaaactctaaggacaaagaaatagaagaaaactccttaaatagccaatcactaactgtttccaattaaaatcaggagccagacagggatatttgttatcatcattcttattcataaaggaagtataataagacaagacaatgaaataatcattaacatttggaaaagaaagacagctaacaacgatctctttttgatgattatgtatctgtatacttagaaatccaagagactccagtgaaaaaatattaaaattataagagaattatgaaactagttggacagatgataaatatgccaaaattaatcattcctctcaacagtagcaataaataattagaggtgaaaaacggaaaaaccacctactcataatcatggtaaaaaccataaaatattagtaaacaaatttgacaagaaagccataggacctatataaaaaatggctgtaaaaccctattgaaggtcataaaataagattggaacattgcttattcgtgggtaggaagacattctcataaatacacaaatttaatgcaatcattttagacttagatgaaatgatcttaaaaagttcatttgaagtaataagtgcccccagataaccaaggaaaataagagaaagaatactgtagggggatgtgccttcccagatactagaacattcaacccagaaagctgctgtgataaaatcaatatgagatcaacctaggaaaaggcaaatcagtgactgcagatttggcaataaaatagaaaacaggatccagaaataaatgccaatgtatatgaaaattagatgtataataagagttaccactccaatgggaaaatgatagctctctgatagatgatgctggggcaacctgctatccacctagaatgaaacaacattggaaacctatttcacaccacacaaaaaatcaaatttgaataactataaatgtttaaattatttctattaaataatgagtagacagaaaagaacacttatccactctatggatggcttaagcattatcgtacaacaaacggatgaatccattcatttaaagaaaaagaacggtgtctttcattttgaattttcccatgtgtccctctccagttctattccctcattgccacacagagaccgtcattagcctgaattttgtgtttatcattcttttggtttatctcacctttgtatttctatgcagtatgttgttttccatgtttttgaactttatataaatgaatcacactctatgtactcatcagagactttcttcttttgctctcccacgatatttagttacacccatgtctgcatatagtggtgattcattcattgtccttatagtacccccacataaacatgttatttatttagtttatattagattgtttatttgcctttttctgtggtcctctttctctcttttggttccttattttgaatcaaatacttcaccctgattttcttcttctgctcatataaaaattaaatatctcttttattcttctactgtttatctcaaattttaaaatgtataattaagccaaagtctataatcaacactttaaccctccccatgaagaaccttagaacaccttagaacctttcctgacgtaactatatgacaatactgtatattgtgagtctgtctttattcctcataattccttcttatacctcaaattctctttatgtttgtctaaaatgtctattttatcctaattttaaagagttttttatgctgtgtaattactcttatgttcgtgtattttttttctttcaacttgataaaccttttgttcccctgccctctggctttgttgagatgttacctgatagccttttcattcccttataggtaatccatttttgatgtctggataattttaacatcttctctggttttctgcaatttctctgtgatgcaaacacacatatttctttgcatttattctgcttataattcatcaggtttcctgaaagtgaggatttctatctttcatcagttcttgaacatccttacctatcttccattaaatggtatctctattccattatttttctccctcttttccaggtattctaattagaaatatgctacaaattttcattctatttaagtatctcttatctctttcgcatttcccatctttggtttttctatgttgcattctgtataatttttcaaatccgtcttccagctcttaaattaactcttcagctatttctaacctactgttacactcttccactgagttttgaattttgaattttcagaagttctttttagccattcataaagatgattggccatttgtataatctcttgattttcaatcatatttttaatttttaaaaaatattaaatatacatattttatattcggtatcattttgttattcacagattttgttggttcttacatggcattctccttttggtgttttgatttctttttaaaagagctcacattttctggaatataatctgtgaaaattttttgagatatagtttggatataggctcttcttgattgtgccgggcacccaaggactccaccattctgggttaaactaaattttatgtttgagatttttcaggttactcaggtagtttgcatatgagctacaattccttctggcgatcagtctatggttatacattttcaaggaaatttctctctgtctactcagtgccaagatttgaggcaggaacattttcttgccagtccttgggactgggtggatttctttctttcttgttcacccttacactgcagatatagcacttgaggggcccaggtgtatatatataggggactgggagtgggaaccttccacatatgcctacctcggaaggaccctgggatttgtccttggtatcctgagccacggagggtatgtaaaccaaaaccaacgttcacctagtttggcaaaagccctcaaggtaaagtcagtctcacagctatcttacctctctggattcctgatttcacttgtatttttagcctctaggtagtccttattttcttaccaagcacatcagtgtttaaaaggattttaaaaaatatttatctgctatgttgccagaggcaaaagtcagattatgacttttaaaaacagaatccaacaattaaagaaacacttcgaggtaaataccggggtattattttcaacacggcaccatttagccctttggagaagagacaagaacaattcctattgcagaagaaccctaggagcctgggttattgccagacagcctattttcattttcctgagcccacctgcatgttaaaagcaagtttaaactctcctgccaccaggaatttaaacaataaagagaagcctattaatgggatacaatggaggaaaaaaatggacacatttgttaccaataacctatgcacctctcttccacctccaaacccaacttagaagcccttagcatcagtactttctttcttcgatatgtagatgtggctggctacaaatacaaggtcagtgactagttccttttgagccacttctgatagaagaaatcaaaagactgagttgagtttgaagtatcttctgagcaggcaatgccttgctttaggcaggcccaccacagtgtgggtctcgacctataatgtcatctgatctctcatctatgttggtcaggacaagcctgtttgactgtccggctctcctgagatggtagcatccgaaagtgaaggctttaccctccactgtcgttgatgtatttccacctaaagcttggacaaaagtcattctaagtactggctcagtcttacttatggtggcaaaattagacaatcttaaaaatcaaaatattcttctgagcaggtcacattaaccaaaactaaattatttttgattcttgttaatatacttagatttcaactctaaacacataagaatgactttcacctttttttaattccaaggagaggagattctaactatgttttatcttcaaaaagtcatagtaaagaggaggtggcagagcatggtggtggccaagtgggggtcaaagccaccacgaggaaagggacatcacaagtgggagggtggctttgtcggtctccggtagcagctgaggcaggtggtggcaaggtgggattaggtgcaggaaggtggctgagtggtgcggcagcgtggcaggggcaggaggttatcttatatgcaggagaatctaacagtatataaatatattgaggacagtgggaactaggtttttcatggaagaagagaattacaaatatgaaaagagggaacactagaatgaactctgtggttggactggcattggaggtattgaagtgaactcacagtttatagctcaagatacatgtgtatgtgtctatgtatacataggtccttaccccgctttcagagagaatctgcaagcagcaaaaccccaatagcaaggagcacgtttaacgctcacatctttgcttctcaaaatagctcaccactaagaagaaccaaggctctttgaaaaaatggtttgttccagggaaggggcagggaaaaaataagaatagcctagaacatcttgtaccagaaagtaaggaatcacttaaagaatcatgagatgcatcaaaaaggacataaaaggcagtctgaagaagctcctactggccaagtctgggacattttaagcatgaaaatcgtaaggtcgtaatgggtaatagctttctgttaatttggtggaactgatttttaaaaagtgaacaaataaatggggacaagagaaactcttctttacagtaaattttaacttgtaaatatagaagaaatgatggaactgaacattttcatttggcaatcacagtactagttaattctgattacagaattgagacatgttaatattagcgggtgaaagagaaacaacaggatatttacatagtctcaaagtatctcatccgaaaacatttattacttttatagactttattaattttaaagaaaaacaggacaagtttatagtggagaaagctggcagatatcattttactcaagtgatcaaaattaacattaccagtggtgtcaccagttgacataaattcctacttgatgggatgtggggagaagagctcggcataatttcagtaatattcttgccaaaagttcatgaagaaacatcagacaaactctaatagaaataagtggcctgtaattttaaaaactgctaaggacataaagatcaaggaatgactcaagcactgttctgaattgaagtaggctgaggacagatgacagctaagtgcaatgagtgctctggtttgaatcttctttctatcgaggacatattaagacagctggcaacatttgaatgaggtctttgggtaaaggatgtggggaagttctgtgtactgtacttgcagttttccaataatattgaacatacttgaaaaaatagggcatccaaaattgcgtacacagaattctacttctaactaggatacagaagtttgaaaaagattgttgttctcataacaaaaaatgccaaataaactaaaattcatatctttttaaaagccatggggcagtaatgaaggaatatatgtctaagtcaatcatattccagagaagaacaagcctttagtagaactgatatatacaacatctgaaataaaggattaatgggcttcgataagattaagagctgactggacatagcagaaaaagggatcaatgaattcaaagacaggtcaataataaaaaaggcctgtactgaagcacagagagaaaaaagaatgaaaaaaaaaattaaacagatcattagagaactgtgggacaataagaataggaccaacatacatgtaattggaatttcagaaggagaggagataatgaatagggcagaaggaatatttgaaaatatattggctaaaaatttacaaaactgaagaaagacaactcaatatctgaagcaaggaatcctcaagcaaaataaatacaaaggaaaccacaaaggcaaattattatctaacaactgaaaaccaaagataatgagaaaacataagaagcagccagaggaagaaaagacacattattttcaggggaacaataagaatgaggtttcagctgggtgtggtggctcacacctgtaatcccagcactttgggaggctgaggcaggtggatcacttgaggtcaggagtttgagaccagctgggccaacaaggtgaaacccccatctctattaaaaatacaaaaattagccaggcgtggtggtgcacaactgtaatcccagctactagggtggctgaggcagaagaatctcttgaacccgggaggcggaggttgcagtgagctgagattgcgccactgcactccagcctgggtgacagagtaagactccatcttaaaaaaaaaaaaaaaaaaaaaaaaaaaaaagaggtttcacttatgatcagaaacaacaggaatcagtagacagtgaactaactttccacctcaagaataaagaaaaaggaaagagtgtaccaaaaggaagcacaaacaacaaaagtaaggaaaagacatcactaaactagaaaacgagtaatagagaaaaatcagcaaagctaaaatgtggttctttaaaaaaattatgaatgtataaattcttagcaagtctgatcaagaagaaaaaagatggatattataaattaccgatatcaggagtgaaagaaagagtatttctatagctattacagacatcagaaattattaggtgatattagaaattttacaccaataatttgacaaattagataaaatgaaaaattctgtaaaaagcataattcaagaaacaggtcaatatgctcacggattagaagtctcaatatatctaagatgtggattcttcctaaatttacctacagatttgacacaatttcattcataataccaccagacttcttgaaaaaaatcgacaagctattctaaaaattatatggaaatggttatagaaataaggaaataaactttatatagaatatgcaaaacaatcttgaaaaagaacaagcttggagaacaaatgctaccttaactcatgaattactatacagctacaaaaaataagaccatgtggtacttgaataaggagagtgactgagaggatggaaatagcattatactatacagtcatttgacttttaaggacacaccttcattgaagtataattgacaattaactacacctatatacagcatacaatttgaaaggtttcgacatatatgtacacccatgaaaccatatcacaaccaagacaacaaacacatcacccaagattcctcatgccgctttgtaaccctccctttgcccctccctgtccctccaacccaagtctgatctggcttttgtcatcagacattagtttggatttcctataattttatataaatgggatcacgtagtagatgctcttgttttgtgtggcttgttttactcagcataattattttgagattcgttcatgttatagaatacatcgataggttttagcttcattaaagtttgccatgtgtcaatagttcattcctttttttattttttatttttattttttgagatggagtctcactctgttaccaggctggagtgcagtggcataatcttggctcactgcaacctcccagtttaagtgattctcctgcctcagcctcccgagtagctggcactacaggcacgtgccaccatgcccagctaatttttgtatttttagtagagacagggtttcaccacattggccaggatggtctcaatatcttgacctcatgatctgcctgccttggcctcccaaaatgctgggactacaggcgtgagccaccacacccagccagttcattcctttttattgctgagtagcattctactatatggatataccacagtttgtctattcattcaactgttaatggacatttgggttgattctaatattttacaatttcgaataaggctgctatgaacatctatgtacaagtatttttatggatatatgctttaatttcttttgggtaagtaggtaagagtagaatggctggatcataaggtaaaagtaaaaggtttactttttaaagaaactgtcaaaccatcttccaaagtggttgtaccattttacattcccgtcagcagattatgaatgttctggttctcccagatccttgccaacactggctatggtcagtctgctaactttcaacctgtttaaatttagtggcatattactaaatgcgtagtggtatatcactgtgatttcaatctgtatttcctaatgactgatgatcttgaacatctttttatgtgcttatttgccactcataggtatatatccaagagaaatgaaagactatgctcacaaaaggacacatacaaaaatatttatggaagttttattcatagtagttcccaaatggaaacgaacctaatgtacattaacaggaatcacaaaacaaactgtgatatagtcatacaataaaatactacttagcaataacaggaacgagcaatggattttcccagctacatggataaaactcagtgttatattgagtttgagtcaaagaagccacaaagtttccttactgtatggttccacttacataaaattcaaaaatagctaaaactaatctacgatgctagaaatcagaacagtgcttgcctctgtgaatgggagggttgactagaaagatcattttctaggttgatagcaatgttttatatcttgattgagtgatggtatatacatgtgctgaatatcattgacaaaaatctatgcatttaattgtatgtaaattatacctcaattttaaaataattcatattcaggttttactttttgttcaaaccacacttgtgattaaataatctcaagtggaaatttaagaaatcttttattcctcccaaatcttaacaagcaatccagggcttcacacctgtgcaggctggctggcaggggctctgacccactctaggctctgaagatgaagggggctctcaggcagggactactgtgcaaattccctgacctcaaatgatggtgccaccatagcagcaggagcaagaggacaacagggacctggtgtggtctggagctgctcaaactgcagagatgcttctaacacaggagagggtcacacacccatgctggtgggccctctgttcatggctgcagccagggctggcccacgggtgcatggctgtagagtaatacagggtcccacactcagaagggccttgagcttggggcttactgctggggttcttgtcttgaaatgcttgctgatcctctttgaatttgtgttctatacgagaagggtgacgggacagtggagaatgtgccagggcttgcagcctcggctcatgtgtggccctgactctcacctcctcctcagcatcccaggatggctctctgctgcctgcttctcacccctatcccctgggtggtctcccccactcacccctgctgctgccttcaaccttgaacagtgacctggtcacattgagggagggagcattctgccattgccctccacccctggcaggggcctgggtgtgggtatgggtgaggcaatggttgggcccacaccaccaggcatctcagggcggggcaagggtatggctgtcactgcccaggctgatagcaccatggtgcatacagtgggcctcttgctcaccttcaagtcaggttttgaacacatcctggtacaggggttgcaagctgttggatgttgtctgtctgtagagggttgggcagtgggcccaaaggaaacccctagctgaggctctacatttgccttctgcagtgggtcctacaaattatgtggccagttctggctacagccactgtcgggggactcccctgcctgctgtctgtatactttcccttgcatgatcccaggcccgacagctgagcatatgggataagagtttccccattcgctgagctcttcgcttgcccttgtggtgtgcattccacggggtggccattgccctaacggtgggtaacactagcaagctggtccaggagggggagccatttccaacgccttatgtgctgtcttcagaaatgatctctaagtgctgctctcaggaggataacaagtgagcccatcccgccaccttgaatgacagcccataggacacaaagattggcagcaagctgctttgggtgggcatcatgctcactcattcattcattcattcattcagatacctattgagtgtgtgccaggccatattctaagtgctagagatatagcagtgaacaaaacatacaaaaatccctgcctttatggagcttatatttgagtggaggagacaggcgggaagtgataagtaccatgaagaaaaagaaaactaaaaaaggagatgaggagtgaagggacaagggatatttagataaggtggtcagggagggcttcttggaggaggcagcctttcagcatggagtgagggaacaagctgaagaggatcagagtccagaccgagtgccaagtccctcgggtgggagtgaatttgatgttttcaaggaagagcaagaaggatgattgggatgaaggagagaagaaggacgtgggcaaagatggggttagaggcgagttggggacagagcagcagggctgggtggggagctctggctgtgtcctaagtgtagtaacaagccactggtggattttaagcaggagagtggtacgatatgatctatgttctttcaaatgcatgctggctgctgggtggaggattgacagaaatgtggcaaaaggagaagcagggaggcagcctaggtctgagcaagagagccgggcctggactggggggcactgaggaagagcggagggcttggtgagacagtggagggtagtgtgagtgaaggaggcggggtaagaaggactgtgtaggtttgcagctgaacaatgaggaggatgctgtttaccgtttactaaaagggggaaaacgtgtcaagaccaggtttggaaggaaaaaaaaaaatcaaagaatttgttctaactactttaagaatgggatggctattacgtgtctaagtggggaaaatcaaggagggaggtgtccctggagatgtagaaatggaagattttaaagtcatgggactagaagacatcacctagggaatgagagtaaatagaaaacagtgtcatcctacacaaattactcttagacaattatcgagcatggtaatttgtgaaatttaacaattctatctctacattaggaaaggtgtgtttgacttgaaaatatgtgtttaattgggtcattcagaccacttcaaaactcttgccacgtttatttcatttttcctttatggctgcaagttgtaatgtcttagaaacaacacccaagcccctctgggctgaagtgattgttctgatgaatgaggctttctgtcttctgagagaatgaggctaaatgaacaagaaacaggtcagtgctgtgcaggctctgaacggccgagctctagttttgaagtttcatttgtacagttgctgcctgggggaaatggaaagaaaaagaaaagatcccctggtatttctgtcacaacaggttggagctggcccgctggctttgttcttggactgcacgaatgaatgggcggcttgtttcctggccccttttgactgctctgcactgctcacctggatgaggcgcagtcctgaactggggtcttgggacatttccagcattcgttgacatcagcagaaacttcagtcctaaatgcatccaggcggtacctcgtgctgtcctgtctgccagctaggagctggagaaggcccatcctccctctgccttgctctcttgggtccttcctgccctccttccaagagcctttcacagcactctctgtggaagaggccctcagcctccctcctggaacctcagcgggcagggctgcccaattctgctgctatgtgaggagttagcccctgctacaggagcgacagagtgcatggggtgacagtagtaaaggcacaaaggtggctgtggtcatcgaggggtggtggggatgatggcggtgaggcggtggtgatggctaacggtggtggaggcaatggtagtggtgacggcagggatggtggtggttgatggcagtaaggatggcgatcggggtggtgacgatagacgtagttagaaacagctcattttcttcccctctgagaatgagtacagacaaatgactcatgactgaggccacgggactgctctctgcacagagcaggaagaagacatacataactgagtataactttgtcacaacggagtactcggtggtgcacaagactgggtgtgcacgtgccaggacaagtccctcggtgcacacagcgcacgtgagctggagcccagcatggagctgaggaacagcgctggggtcccggcggttcaccagcttaccaccaggtgtcgctgtgtgcacgagggcaaagggcacccgcagaccagcagggccgagccgggctctgcagaatcggactgggctccctgtggggagaccacattctgtctgacgccagcagaagaagtgcctgtccccaagatttcaggggacacctcagacccgagtcatgcagcagctccgaggcaggtggtgcccctgaactttctagccgttcaaagtcagtgcacatccaagcgtttgctgagtgattctgctgcgcgggtaaccacccagacccgtgaacagtgcaggaggccagttcggaagttatcatgagatgatcacccagtgtgatggaagcatctcctgggaccggctgacaatttgggaagtttacagagcacttgagagagacacaacccgaggggactgttttggagatgggagataaaaggagatgatatttgtattcaataccttagagacaggaaatgacatgttttgtgagctttgcatttccgagcagtctctcagatgatggtctttagaatgtccaggggcacctgggttctctacgacttccctggttgtgctgtcccacggcgtctccaggttggtgacactcaagcactacaggaatacgtgatggtgtcctctgagaggcactatggcacatctcaggccaagggaaggctggtctggacagggaagctggcagtgaccatgtggtcactaggcagcattcccatagctgggctcacttctaaataccacgtaaaggagagagtactggctttggagtctaacgatcttgagatcttgagtctaattctcccatctggaaaatgggagaataagcctttccctgaagcccatagagagaagcacatgccatagtgaaatgtaaggcacttagcatggttcctggtgcacagtgggtgcagaaaatgctaggcctttcctcccttcccatcaaatagataacctaatcaaaagaaaatctgtaaaaacaaaacaaaagatatagcaacatttcttatgcgcatcagactgggtctaactattagactgtggattaatctatttcaagtgagtattgatagaaaagatctacgggctcacatgtattgcacatttattatgttccagacaccataaggacttgatgtagattttgttacagatttttgacaacactttattataaagtttttagtttgtaaatctttttaacattaagatttcttcaaagtgacctaaaaaaaaaggtaccttagctaagtccgaggtttgtcttaagagctgctctcaagctgtttgaatggcctgtcccagcctggtcttgtctcccagcaggagacccagagcaagtcagctagaggctggcagagataatgccatccccaggtggcaaagctgttaaccgcgcatcgccaaaccctccaggcctgaggtttaacaatgccccacagcaggagttgtgctgagatattaagaaagagacaaaagggaaagctatgtcgaatgtgagttcaaattgttcagcagaaaacctggaaaagtaattagcagactcttgtgaggaaagaattaatgcccaactgacctcccaagactctgtaatatctgaatttccactgttggatattcatttctttgaatagcccttctgggttcctctctgaaactctacatttgaactttaaagttaaagcattaattaattaattcactcattgaataattctgtgttcctactgtgggtgagatgctaggtcctgggacacagcagagaataagggagatatggatcctgccctcaaagcttatgatccagtttctggctgtcaagtgtagccgtgtggtttgtccactgcacgataagccaagtggcggaagaaatccagaagctggctgggtccaaagggagaacagggacataggataaagagcctgcatttgaagttagggtgaggagaagggaagcaggaatgacgtggggggctctagtcttcctgtctaagtgctggggaccccccctgagcaagacccttctctcttggccttggtcttctcttcttccacatatggggagctggaagtggaccagtcttgacttcctctgtagctttcaccttcctcattgccccaacatccctgagagtgtgcctttgatctcaaaagaagtcatctttcccagttaggaatttttaaagcacagagtgtgctagcagaagacagagtgttgtccttcaagcctgaccaaaggaaagtctttgccatgaagggaggacacagggagcaaaggatagccgggagtctggggaggtgagagggggagacctgcctccgtggctctcctgggctgtgctgacccgcaggaccagtggcttgggtctcctgcataatgagcccatgtcacttcatgggggttctgggcagatgaatagcgctgccctgccccctccgcactccctaattggagaatgtcatgaagttggtctccagacagagatcattaggaagagactaacaattctgatccctcataacggagctctcatggccaattagcagcagaggaaactgaactgtaccgtgggttggggaatgatcaatgccggcattgtgcattctggcagggtggatcactgggtggctggggagtggaggcaaaagtagtagaagcggtggcaatgggggctatggaggagcaatctctggctggaggcacaagcctcagtcctgttatttcccagggagacagtcagccagttctgctttaataatgcactgatagaagctccagttcccttctttagtttagcaaacaccactgctactgcaatccagaacccaaaccaggctaaaatgtttcctttttccgaaagtcagcacaagttctgggaggagtaagctgagatttcaggttctaaaacaacctaaatctcagcatgtcttatgttctcagtgttccgtctctcaaatgcccaacggcccagaggaattttggtttatcaaaccttgaaataccccaacattcctcacagtactcttccatcctatgaactagctcacactgccccccaagactaccccagcaatgtcaccactggagaacacacaggctctggagtcaggcagccctgggttacaatctcacttcagctgtgtgaccttggaccagccacataacctctctgggcctcagtttccacacctatagagcatggataacaactactatcttccccaaggacgagagacggctcatgtgcaatgcccagcacagtgtgggccaccagaaggtgctcagtaactggaagggtgccttgttttatcagctcccacagctgagccctgttctcaaggaatgaacccaggggcctgagaggatgtagccccttttggcagtagagatataagagtccacttccgaggcttgcctttctcaatttgcagggctactgccttctccagacctcccaagcccaggaaactgttggtaagtgaaagggtgagtgagtgtgtgttgcgggggtgggagttctacacaacacaggcggctctcctcatgagtgcttccagcaattagtgcacgcaatggcggggggaagggcgggaatggcgggggcgataggggtaaaaatgcagattcctggactccacacccagtgactctgttcagtagttctgaggcagggtctaggaatgtgcctttttaactaggaccgtggctgagttaggttacaaagctgtggtcttagatcacatgttgagaagccctacagggttgcaacttctgccatcaggacagacaaggctttggttccttctcagaggtttcatctggccatgtggctccagagaagtgtgagggtttgggtttctctggggaggtgcacacaggacctttgctgtctatagttgcgccttctggaaacattgggcaggcacaaggggtgagaggtggagctggggaggcagctatttcaagaactcttctggagtccctaatgggagaaaaatcacactctatacccagatatcaacttgtgtgagttgggaggtcacaagtaatgtgtgaataacaatacctcaggtgtgctgagttggaaatgagttgttttatgataatgaatttcaagtggatttaaatttatccctgtaataatatcattgccatacacttacacgatgaaaaactgtgtgtgtataaaagggattgcagccaatgtgtggaactggcaggactcttgatctattttacctgggtatgccagacagatgatgtaatctgtcatacgcatcatggcagaagtagggcctgctgcaccatctgggctgtgatctctgactctctggcttgccctagctgccctaagctggtgccttactaagctcaccttgctgccacctccaactggaccatgggtaggggctgcccagggccttgcttgacatgcttgtggagggtaccctgtccagagccaacaggacacgaacaacagaagggtcaggtccattctgggttccagctatccactgtgaggcatctgctaaggacatcctgggcatgagacctgtgtgaactggcacctgtgctgttctcagcatggcagcagctgcagagaccgaggccctgagcaccaagtggtcacacagcacaagtgactgcccaggtgcagaggtgctgcatataggggctcctgtcctcactctctgcagaagcaacctcgactccagatattgagggctctctcatcctggatgctccttgctctatggccactaaacttaacatgactcttccaaagggtttttctgttaattgtcaatgccagcccagggctggcatgtagtgggcatgcaatgcttcattgttaagagtaaactacgacacacagaggcaccatttccgttatggtgtgaaatgcaaatgtcatcatcctaagcagcttccccaagtctcagctgtagtttccagaaataagtgactgccttcttattcacatgcaggaacttcagttatttcttcctggccctagtagtgggatcctaaggatagcataaatcaggggaagaaacccaacactaaagtttccatagagcattaccctgtgaaagcctcttctccggagggccctaacctgggtcccagatgtggttaaactgatttgcccctcgttggctcacatcagcagaaatctgctcgtaggacgcccacagcccatggaatcatgaatgccgaggagctgcccccttcatctttaattcaaatgagcctgaggatgacgatggcaatggcactgatgtgggctgagctcttaccacatgccaagttctgcttaaagtgccctctggaaatgatcatctccacaacaatctcacaagggaggtagaaataatacaacctatttctattttcttggtgggaacacaggctgaatgaggattctaccccaggactgcctggtaccaggtctatgctcgtgactcccccaccccagggatgaagggaagaaaccacataagctggaacaacagccaagccaagagaagatatcaggaatgggggctgactttaagctcactctccctccagaacctgccttcctcaaaagtaggcctgtcctcttgattgtgaatctccaggctcctaaagacttatcaggtcatttggattccctgtactatgggtttctggactcttggatgcaccgtactatgggttgctggactccctgggttgtctacaagaagaacagagcacggtaagtttaggaatccattccccgtgaggcatccaccttcagcatgaggccaccatccctcagtgacctcccagaatccatcagctcactccacctcaagatgtaactcaattagaggataaagtcccttctctcctatttcaggttaattgggtctgtgccagagttcacatattcttgttttcgcatctctattgattaatgggcaaatcattggtaatagacacacactgcatactatgagtatttgagacgtgagctgtaaataaatgctcataattagtacttgagaaagattggacagccataagatatacaaagcacttggaaaatgtgaggtgcaatttttccttgtccaagcaattttcaaactctagatagaaagctgcttgggtgtggaatgtaagttgaaagtgagactttcacactaggggcaaactttgcaacagaggaaacaattgtagaaaaaccaatttagttaattgtctttgtttcacctgctgttcatgtgtacctggagcttgctgctcccctgaagcctagtcttgctccagtttgagtggccctgtggggtaggtcttgctgcttctgcatggatttccacatgtctcagaggttagggttaatgaaaaagtggtatttgcaaagggtttgaggagtggctctaggacagtgatgtttgttgccatggaaatgaatacagtctccaattcatcactatcatctcagcaggacttgggagaggaatagccaagccagagaccttacaagtttggtcacagatgcacccatgaactagcaagagaagtggaggaaaaactgttcaggcatgcctcggcaccacccgtgtctttttagccaaattaataccaaaatcttactccacagaacaaaagggtaaaatatgactttccaaaataacagattggcttgctcttccctccctctttcccttcctcaaattcctgatgtaccttagacacaaaacactggtgatattcactgactgttttttgaagaatgcacccataactggatattgagatgcttagctggctgtgcttaactctaacttggcaaaactatacaggggggtcagcagagtcttcagtaaaggccccgcagaggaggcttagaggaaaaggacaccttatacaaacaagaatttccccttcattcctgcaaagtggtggtgaacaataaagtgttctattaaacttcctggtggacaataattaaatgcaaccagaatggacttttgatggaaaaaacagcacatacatgttgataggaagaaaataggagagacctagaggggtgcatcatgagggagaaatttctaagtcaaagtttgcaaatatagggcccccaggcccccattcccccagcagacagtggtaaacatctggcactttcccactgaacccaggtgtggccttcttatttacctctcacatcactccaggcagccactaccaagagaactgtgttaccacctgtggtagattaaagatggcaacacattctctgatgctccttcctctgagacgtagagtacaatttttctcctctcaaattaggtgtggccttagtaacttgcttgaacaatagaatggaacagccaagacttgacttctgaagctaagaaggcttgcagcttccacatgaatgtcttggaacactcactcttagacccctgagccaccatgtaggagatctgactaccctgcaggagagaccgggaggagatactctgagactacaaggggtggaggagtatagctaagcccagccttccagctgaccctgtcaagatgctagatgtgtgggtaacactggataaggccctcaattatagcccagccagcagctgaatgctactgacactactgagtaaccccagtcaatgccacctgaagcagaaaaatcacccagctgagccctgtcttaattccttattcacacaatcatgaactaaaatacaatggtagttgttttaagctgctagggtttgggggtaatttgttacacatcagtaaataacctgaataccacacaaaacaaaacgcattggccacctgggtctaggtaaaaattgtattcagggtccagaatgaatccttggggtttttttcattaataattacaatagtgatactagcatttattaagtgcaagatacattggaaccattttatatagaagaactcatttatatgcaaaatccaagtacccaagggtagacacaaatccccatgaactgagccaaacactgatggacctacctcagttgagagttaaataacaattcagtaagacagagggtgtaagtataagttgtcaatcacatctgttctgtcattgcacttcactatacctccattcaagcagggcaagactggtttcattatctttaaaaaaaatagattagaaaacagaggctcagagaggttgtgatttgttgaagttcacacaggttagtgaaggaggtaaatttggaatccagatgtgacaagtccaggaccaatggtctttttgtatgtcacaatgcctctctaaacattagctaatggagagaaattctcttcataatgacatttctgcctctcccacaatatctacccaatgccatgaacatcagacaataacctgcaaaggaaataaactttcaaatagacatgcactgcacgagagatttgtagtacctaatttctcaggctcccttctgccaaacctaccttgtgggggtggtgtgagaattaagagttcgagctgctatgagacttgagccaggtgaggcacacagtgagtgctcagtaaatggggaaaatattacttctcctttaacttattcaacaattatttattgggcatctgctatctgcatgtgctgttctaggcaccagggatttggtggtaaaccaaataggcagaaatctgctccttacaaatcttatattccagtgtcaagtggaaacctatggaagataggatgctgggtgggtgggtggctggcgaggcccactcacttggtaactgactgattttcacacagcagcattggattacacttgattcaaatttatccacagcaacataacaaatctccatctttagagatccttgcagtacaccccaagccacaagcactaaatctggcaatttttcatatgcttctgtgccttgctatgtgtggcatggcccagatcttttaagcagtactaagaaatggcttacaaagagagtgcagaaggcttcttgggttctttctcattaaaaggcatctggctcctctattctctctgcccctgactcctcaggctgtcaaagaaggaaagagaaatttcaggagttgcaaggcaaagaaaatctaagctgttctctttttcagtgaactaaaagccagagctgaaatcctgcatgtttaaaactagagctcattggaattcaccaaaacctggacaagttccccagagacctgcaaaagcttaatagtcctatttgtttttgaagtaagggatactgtgcaaatccattccacctgcctgtccatattagtgtcattttctggtctggtgggttagacgggggaaggattacccactaactggcaacggggtacccacgcaagggtagggcaccccttcaagcctggagattttccaaagtatttgatttttttgagcactgttagtaagtcaagctgtttggcatgatttacctttttcagtttcaatgaaatgtttttggtttgatttctatttcattcatgtggcaagcatttattgcctactaagtgccaggcagtgttctaagtgaatatagcagcctgcaatggaatttatattctcatgggcaaagcttagacaatacagaaaggagtcagttaagaaaaaaaatcagatggtcgtgagtgcagacaattaaaatacattgattcgataggtaaagtcagggtggcaactctgggtgatcaggaggcctcttggaggaggtggatttaagctgagacctcaggagaagtcagctctgtaaagagctgggggaagcacggcaggcagagggaagagctggtgtcaaggccagtgcaggtgtctgggccaagaggggaggctagaaaggctgaagcaaggcgggaagggagcgtggcaggagatgaggtcagatagggaggcagcagtgggattccaggggcctccgagccatggcaaagggaaaagcttaggattttttttcaaggtgtgatgggaaagccctggagggttttaagcagaaggtaatacaatctgatttacattgaaaacagattactatggctattgcatggagattggtctgcaacggggcaaaaggggagggagggagaccaatgggaggcttctaagtttctaaagatgaaagatgatggtggctttgactagggcatagtagtggtgatgagagaagcagacgagactcaaggtgcgctttggaagtagagttgataagacttggtttgatggattagatgaggagctgtgggggaatgttataaaataaatggaatgtttttcagagagaataactccacattttactatatttcaccttagtcttttccagttacataaatatacatatgtactttataaaattggaatctggaagtagttttatatcatgcttttaaacttaacattctttttgtgactatttccacaagtcataatttttaatgactgaataatatctcatcatatggggcacaccatatttcctttaaccagtcactgcttgacatttgggctgcttccaaaacttctgctttgacaaacaaagctacagtaaacatccctgaacataaatctttaggcaatctctgatttttttccttgtgataaattgcctgaagtggaattactgaatcaaaagcatgtttaaaaagagacttaataaataagtactgccaaattactggccacagagttggtgccattttatattttcattggctacatttgagagtcccctttcactctatccttgctaaaactgaattttatcattaaaaattgctgatttcatggccaaaaatatattgttaactgttttaatttgccttattttgattattaggaaggttcagaatctaatatttaataatgatgtgtatttggtggatggatgtgaatgtctgtgtgtgtgtgtgccctctgttcatgttcttcacaaacttttctatgtggatggtcatcttttttattgattactaggagctctttctatagtaaagtcattcataactccaactatttttccccagtttttcatttgccttatgatatacagaagcttaaagattttatgtcatcaaatatatcaaccatgtctctaattgtatcttccttttttatgtggtttaggaaagccccactcaccttagtaaaagtacaaaaatatctgctcatatttatttgaggtcttttatgattttatgtgttttatttaactttttaagccaccatttcccaagtgatttctgcagaacatgaaacaccagtctcacaaaatactcaagtaattctgggaatagcatgtgctatagttccctcttgggattgtagcatgcacagtagcaccaaagatggttaaaagtcctgcaataaaaatatctgcttaactttgcttaccatggtgttttgcagatgtatttgactccagaatccttttcttgttatgtttattaatgtcgtgtaagagcgttttgggacaagtgctttagaagagccaccatatccaactgcaatatgaagtcatccaccttattaaaacaaatacttaatcatttggcccagtaccatttgaaaataactgatgatcctttttctcacagttttgaaatgctgtgttaggttagcactatgttctaaggtttgctcctggcctttctgttcagttctactggtatgttaaactctcacactacgattgtgctcctatttttccttttattcctaacagtaatcactgatattgtgttatttggtacataaagctccatgaccacagcatcttcttcatggattttatcaccataaaatggcatccctttttctcatttagtgttgttgccttgaattctacttcccctctaaattgctacccttgctttctgtttttgtttttgacaaacagaacttcgcccactctttttcctttaatctccttatgccatttggctttaagtgtgtgtcttttcattctctcatgcatcagaaatgtattaatacttcccacatgccaagtgttaggcactagagaatacagtggtaatcacaaaaaaatacaatgcttaccctcttctgagggtattctaagtatagtatttattctaagtatagtataaaagacagacatcagccaatagtttcataagtatatgtaaaattacaatggtggcctatgttttatggtatatggcattatgagctaagtgctacaaaagtttacaatggaaggacaatttagtttggtggaattggctcaggaaaggctttcctaaggaggggacacttgggctcagctccaaaagatgtgtttgttaactaaactgggtaagggggaggcagtgggagtgctccagatggaggatgacctgtggcaggaaggagtgtgttgtcagttagtggggttaggcatggagaacaaagagaacatggtgtgagttgaggctagaaaggttaatagggtcagaccatgcaggatcttttggatcctgctgagaatttgagcctttattctagaagcattgagaagttattaaacagttttaagcagaagttttacaagcaatgatatgctggagactactatttataagggcagatgattcgtatctcttcccgactctgtgttccatgacatcactggactggtcaactgaagtcatccacggtagtagtatttacactacggaaattggcaaatgctataaattaggacttttcccaccgagaaccggttgttaaacatttatcagcacaccactgattgacataatcaccaattgtgttttgaaaagaaatcactctggtatttgggtggaaaacagattccaggggagcaagaaagaatgcagggagactggttaggatgtgattatgagagtcttgttgagaaaaaactgtattttgaattagagtggtggtattggagatagagagaagtgaatggatttgagatgtgtgtaatatttagagccaaaaatattaatgatggattggattgagttgctacaggagaaagaggtgacaaagatggctcaaagatctatggcttaggaagatggatgaagggtggtaccaattactgagatagaagcactggttggagaatggtgcttttttgggttgttgtttatttgtttttctggcaggaaggttagtgatggggaaagaccatgagtttagatttggacattctgagttttagttgccggtgaggcactcaagtgcctttgtcaagtaggcagttggacatattggcctggaaatcagagcagaggtctaagtaggagccgtcagtgacagtcaccgcacttgggcactatttcaacctttgggcatggttgaggtagcttgagaaggtaatatggaatcagaacacaggattgctcatttaatctctaagatttgagcttgaagaaagaatatttagtagccaacatttaatgcaaactgtatatagtatatagtaaataggtgttttttttttttttttttttttgagatagagtctcaccctgttgcccaggctggagtgcaatggtgcaatcttggctcactgcaacctccgcctactgggctcaagtgattctcctgcctcaacctcccgagcagctgggattacagttgctcgccaccacacccggttaattttttgtatttttagtagagacggggtttcgccatattggccaggctggtcttgaactcctgacctcaggtgatccactcacctcagcctcccaaagtgctgggattacaggcatgagccactgcacttggccagtaaatggtttttttttttagtcagtttggagtctttgcattgtcattgagaagttgttctcttcactttcttttaaacattttttcattatttatgttattgagctttctccttttgtccttttccttttattattattattgtcttcagctttgtgggccaacttttctttctttggttggaatttatagctactgaattgtaacgtattactctaattatatatacttaattctataattgacttgtttggaatctcatggctcattcttttatgatacaatattttgattcatttatcagttaggtggagcatgacttgaagtacttcttttaaaaaataagaaaaagcaggaagatggtgtatatctgaactcttgcatatctgagaatgcctttcttttgccttcgacatgaacaacatctaggcagaggacaaattcttggatcataatcttttgtccttgaaacattccaaatactgctccattatcttctggcattcagtgcttacaggcaagaagtcatgaattgatttaatttgttcttccagaatgctagtagagttttttggtgtgggtatttcaaaaccctttccaggatatatccatgcagcagatggtattggttggaaggagaatatatgatattggtggtaggaattatattaggggttgttaatagaaaagaatatatgaagtccctgaatttagggacacatgtacatgtcgttaagatgtagagaaatagatacagggtgtggaggaaggaggtggatctggtggaaactgcagaacctttacattcacatgatcacaagtgtgggacgagtgaggaacacagtgggagtttgactaagtaaagatttcagtgaaggctgaagtgcaaattcatcatccggattgccctgacaatggggctcacacctcatggaaatgacattataatgaggaaaacccacatgcaagatataaatttgattttgaggatgagcagaactgatctagttagctctgcctttggggaaggtctgaggaggagttagggaggtatctggctgcaggctaagaatggggttatgtgagaaacaacttgcattatataaaaaagggctgggatgagcgcggatgctcaagatcttctggaacctcacgcgcctttgattcctcctgcccactttggtggaagtcagtgtaggtaataaagcatgtacctgtgaagtcacattgtcttgctcttattctacttattgtaacactgtctagaaggaaacttggacagagaaatggccaagtgtgttccctaatagcttgggatgaagtgatgggctgtagggattttctcccagcccttgctaacatctaagcagtttgggccacctgaggatggggtggggtggacagggtggacaacgggaatagaacaagagtgtctaggcctatcttcctttttatgtttctagaactctatgagacctttgaatctattatttattgactttaaataaaacattctttttagaagccttttgacatgaccgggcccaaacttgccaatatttggttactcctggagccatgaatttctaccttcaatcaggacaaaagctatttgaggcctctgggtgggactgcgattgataccacacattaaatttttcattctgttgttgtcaggtgggaggctggctgtcctttctaccgctaaaaagaaacagctctggaggaccaggttgctagctaacttaagaaaacgccttgccttcatccctcctgcttcagaggtcttcaagtgccagctcgtgggggtaactgggagagtcccttccctcttggggctgatctctcccttcgtctaaaacagggcttagaataagaggtgctgcaagctctggtaccaatatctatgagggcaaagagagggtcattctccaaagatggctgtgcctgacagcgtgcaggctccagatgcacatgggagagcaggccacaccactgggaaggctttgccgaagggggcaggtacggggttttcatgtacttagcccacccccaccctcttccccacacctggcaccatcagtgctagaaatgccttcattaggaattcacttcctcagtagtaggcattgttttattcagggcgtggacaccctgggaggggtcagacgttgatctgtgttagctgtaagcatagaggatctgttcagtcatgctgcagacccacagttcttagtgagcagagccctgggggtgggggacatgctggggtcgggaggaaggaaaggaagagtcaccctggagcacaagccctggctgtggaagaatggcaggtccagctgggcgagtagtacaggagagagctctggaacccggggctacacccattcactgaataatttctgggcgctgtggagggagagggcctcagcgggcaaggtgggccgctgacaaggtgtcttgacaggaacaagacacatcatttgggtggctgtgggcagctcaggggtgcccgtaagatgcctcaccaagcctgtttttggcaagggtttggacttcaaggccctttcttgtggaaggctcagcatctgtcagcttctgctccacaggcccatggggagctctcagcagccagcctaatgtggggctgcactgagcccttacatctggctggccgaccaagctgcttatggcaatgtcaggcttgagctgagactttaaattcaacttcctgggagaagcagtcggtactggacttagcttatcgcctccccaggatggatgtgccaaggagggctaatagttttccatggagctgggtcacctccctggaggcacagggtagtggcctgagtcattccactggcagaacacaacctctgagaggcctgggaatgtccaagcagggggaagagaagacagtggagactgcaagaggcctagcccagacacagcgtggaagacacgtttcaggcaggacatgagaaccacgcccccagccctcacccaccacttctccacacctccactgggcccacctcagcaccacacagaggaggaatgtgtcctagaggctcagatacagtggactactgcctcctgcacttggcctcctgggtctgggtcagggccagccctgctcctgaggatagtcagaaaaaggaagaaaacactcccggtgtcagggcctgcacagcacagggcctggcttggggcagtcttgatgtggttcctctgaaatcagactctgagtaggaattgaatgcaaatatattgggaagtgatatcctaggaagcactggtagggagatggggaaatgaaagaagggagagaaagaagccaagacggggcaaattaatgagcaggttatcactgtgggcagctgggattaagcctgccaggaaggcacctgggagatggggcaggatgccttcctgcacctgaggggtgcagagctggtacttatccagcaactcttgctcattgttggttgaaggctactcctggacacatgaactcccagcactcctggcttgccctgtgcactgaccagacatgcccctgcatcctggtagcaccccgaggggagacagagagttgcaaaagatgccttcagtgtgtaggaaacaatgagagcactgccagtatctgctacagtggccgagaaacgtttagtgcagataggcaaactgtgcctccagccctcacccatcacagtgacagagggatgcaagtggaaaatccaccagcacggagcacaggacaagggagggccacctgcttggaggcctgaggcaagcaagtgatagacagggctactgaaccccggaaaagtccagggaaattgagtcacttccatgaggccctagagatggctggtggcaaggtcaggactagagaactcagatttccccactccagcaatgttgccaccagagcccactccctcccacaggcatgctccagtgcagcagggtcggctgacactgctccgcacatggtagcttcacacagtaagtgactggctacctggcaagcccagcttctctcttgcatggattttagtccaggctggcagggcctgggacaagtggatgttcactggtggagctcttttcatgcctctgaatgggtatgggtggccatgctgccaatcaaccagtgagttgctggcattgtacccacaatggtgagaagctgggctggtagggacagcccctgtcacatggcgaaatcccattctgtggatttgagctgtcaataaattctcagacatgcaggtcagaggcagggccacacagcatcctccaggaggagtgaggatgagtctccatgcaaaggtctcaactgattatctgaggtggcaatcaccttccaatggctaattggctaaggataaactactcagtggttaaatcctacatgtccgtgccatgggataacaagatcctagctatcagtctccttctattaggttacacgaagagacaacaggactgaaaattgatgacacaggcatccctttcagctcccaataacttctctttgttgctaattgtatagttgtggtatctggccattaagtcattagaatgaaagatgctaaatagagctatgcttgcatggagtcagatccatttttattgagccttctcttctgcagcttttcttgagatgtgatgttgatgctttttatctactattcatcaaggttaaggaaaaaaaaaaatcctcatccgtttttgaccagagtcaataaaagcatgttcagcaaaaccaatataatatagcatggtgtcattcttttatttagttttttaaaaatgctcacgcagtggtacataatcttgagccctggtagaagtgagaattaaaaatatggaggcatctgtggtatgaccccctgggtcacagaacccctaaatttcatgtcctcccttctcctgagtcatagaggctcaatcaggcttttggagtcagcaaaacaaaaaccactcagtggcaaagcctgcattatacaactgacccaacaccattagcatctctagactttatacctgatctatctgtttcattttcatcgtatccaagtacacacaccataccttcttcaaagcaacaacaggtatcctgtatatcttaataagtttaataaatgtgagcaaagcacaataagtcaaatctggtgatttttaaagaatacttctgaagattccatttatcagaaaattgttacctctaaatacacctgcagaaatatcattcttgttccatatggaccacctttatttctgcgcatcctcaacctcctttggagaatgtcttctgcacgacaccttgtgttcataaggtaagtgtcacattctaattagaaatcaaacatgggtggtggagtctaaatgtggaatttaaattcactcaaggtccaaaaatagccaatcattcctatctgagatttcttccaggtgcaagaaagtgataagcggagctcgattcctctaatttgccttaaagaagaaattgcaacatttaaggattcccatctgggaaagcaaaaactccaatgttctaaacatccaagcttgaactgaaattgtcacactctctagtgttggcgcaactcattcatggtgttgggaggtccccagacccttctgctaggacatctgtttcttaaaaccagggcaaatggttaacccttcaggcccatccctctggaaaaggggaaatactgagcttttacctaacgtggctgctttttagatgatgttctccaatctgagcctgggtgtgtctggacctggagtgctttggtggtgctctgactcctcctagtcaagaaatccagctcctctcaggccagcctgtctgtgggttcagcccgatattctgaggagggcacagactcactcactcactagtgggtcaattactgcccatagggaccctccagcctcataggaggccccatcccatctctgccccttgcaccatattccagccacacttcactgtctgcggaaacccactaccccatatggggctctgtctggcctgggctttcacctacgcaattctcagttcagaatactccccctcactctcttgcttaagaccgtggtgtgctttcagtttagacattgcttggtcctaggcacccatcctatctctccattttgggacttggggttcctcctatatgctcctacacacccccttcttttcctcctgggcacttgtgctgggctgcagttgctcacccaccatggcacatggagggtaggagccacgtctggattggtgactgctgtatttccagtccttacagtgtctggctcaaagcaggcactcaaccaatgtttgttaaatgactaaacaactgaaaggaaggaagaaaagaaaaataaaaacataacgacagacagataggtaggcaccttcttgcccacagtccccatgggaggattcgccctccagaccgttcatgatttcatgatggttagaagcactgagcacagttgggccacctggcttctccagggcccatgaccaatgaaggccagtcctgggagctccagcaccctccttacctacagccaccctgcctggcagtgcccggccctctttggggaccatactggccctctgttctctctcttgcccagacatgttgtgctcagactcagttaactctgttccatgcagggtgatcaaaaaaggtctgttatgtcttttcattttttctctcttgctagaccaacgtgtgcccccagtgctgctctatccaggccctggccagctttgaatcagaggccttgagctgctgggccctggcttcccctctctgagcccagctatagcctgtgggctctcagggaccaggcaggaatgaaagtgaagtaggggcttctgcagggagctggatgggcctgtccttggggtaactcactctttccccagatacgtggtgcttattagctgtgggcccatggcacagggaatgagatgagcagacacgagggctcaagcagcccctcacccactccactaagcccatggcatctctccttccagcttccatttctggggccaagggaggagggcgagatgccagattgctcctagcccctgtttaacccccactgtctcctactgccgccactgaccttggtgcatagcctgtggaaaggtggaggcagcctccaagctgggcgcagatggaaacacacaccttgtagccagcatgtgtgaaaatacattaagccctgcacctagcacatagcacctcttgaagggtaaggactgaagacccagcaatccagacctgcttctgctcccagtgttttcacattcaagcgaaagagcaagtctgccttcttttggcatgggaggtgccatttactttcaaaaatcgagaagcagaggggcagcttccagctaaaaaagccttactggtgagggtccatctatggggatttccaggtgagggactggcctggctgcaggagtgctccctcagatcactgctgcggggcagcacaggccggggagtgctccctcagatcactgctgcggggcagcacaggccggggagtgctccctcagatcactgctgcggggcagcacaggccagggagtgtgggtctggcctcgtctgggtcacctatgggccggctgccaccccatcggccctgcctgccctgacacctggctgcagtgctggggtatgctgtctcacccaggccctctgttcaaggactcccaaggatccttgtggaacctggggatgaagcgccactcctgggagccagttggccccacctgggagtctctaagataccaagctgagagcagactgggatgggtagctgggagtatgccaggaggggcttcaatcgggggctttcttccccaaaacgtgcacaggccctcccgggtccccaggcctgtgtatttgcctgtcagagctgcagcaatatttaacagagagaaattcttggggattatttaagtgagttttgaatttatacttgagttttaaaggagaaaaaaaaaagacagtcttctttaaacaacttccatgaaaggttataaaacacagataatttacatacaggagcagatggcaggctgggtgccattctaggcaaaccacgtgtcccctggcagttctttttaatggatactacaagtttatatgtggtttataaactcaagggctagccatttccccaagtgattgattgtagggtataaaaatgatggcagtcatgaccttcatttcatctgaggagacttctccaccccacccctatttgggggcagccagagctatttgagccccaccaaaacctgcaggctctcgggccaggctcggtggctcacgcctgtaatcctagcactttgggaggccgaggcaggcagatcacttgaggtcaggagttggagaccagcctggccaacatggcgaaaccctgtctctactaaaaacacaaaaattagccgggcgtgctggcaggcacctgtaatcccagctacttgggaggctgaggcaggagaatcgcctgaatccaggaggtggaggctgcagtgagccgagatcgaaccatgccactgtgctgcaacagagcgagactctgtcttaacaacaacaacccctcacgctctcgtccactagtgggttctgctggctacctgttccacactgtggggctctcttctgctcccaacttgctgacactggcactccccccactcctccaagtgttctctttcgagtggttcctaaccaactatcaggagagcctgcctggaacacactggggctcctccctcccggggccctccgcaggtgggaatcaggagccggtcctctttcaggcagccgtattcccacagcccagccccctcccaaagtctacagcaaaggttcctgtttcagcacaggcccctaagaggacatgtctgcacaccgctgctccctcttctgatggtggatccaggttccaggcctctccccggtcctccccagctctgtggctccactcatcctgtcccctctgtggacctcagtctcaggcactctgaccatccatgactgggctggtggctgagggggttctggaggcagaggaagagagcacaggtctagggtattcagaccacaagtggctcctgtaggctgaagagaaaagacagctcctacaaagtacatctttcagctcttcaggacccaggagactgttcacggtgggctcccctgccgatgctctgaggccacccatgtgctgtgatgtcagggcagcagaagaggcagtaggaagagcagtgatgctgatatacaggaggacttgtgtgccaagccctgggacaagcctcttggtgaggtgtcaccaccagcctgtgtgacagccggggaagtcaaggcacagagtgtgggcaccacctgtccaagcctctatatggccaagtgtccagcccaggtcacctgatgcccaagtccaccctttaaaccactctactattctatcttttcttaaggccaaacttttatctgatgaatcagaatagtacctgatgcatctcccagaaatttccaaatcctgtgcttttgagaagcacctggctggcagatcagaaagaatgacccgcttcataagatggtaggtctggttcctgcagctcgaattccataaagttcaccgaaacacatgataagcaaccatgtatgtgggattataatttctttttcttctctttttttttgagactgagtctcactctgtcacccaggctggaatgcagtggcgcaatctcagctcactgcaacctccgtctcctgggttcaagtgattctcctgcctcagcctcccaagtagctgggactacaggtgcccgccaccacattcaactaatttttgtatttttagtagagacagggtttcgccatgttggccaggctggtcttgaactcctgacctcaagtgatctgtctgccttggcctcccaaagtgctgggattacaggtgtgaaccactgcacccagcctaggattataattttctaagatgtcattttagtgcaagctacataatcccaccattctgatggaaatttcctaatttttcagcagaactctccttttttttttctttcttggaacagatggcaagattttttaatttcaggtaccttcaaggaggaaattgtcatttctcctctttgtttgcatgtgtgagtacaccatgtttcacatttagcatgaaagtagccgtggtttagtctttgctcacacttgagatgctgagaacacactttaaattaagcactatcagtaaacagtgatcataaagtaggaggaagataacattccgttaatttgcccctgctgaaaccatatgctgcttccctccccagggctgccctgccgaatggtttctgttcactctgtagtcacagtcatggcttctagacttctccctgcacctctattttccacaggcccagggaccgtcctcagtggctcaggagatcaccaggcccagcacccacaccgtctgaaggagagaaacaggggggcccccgtatgctgccagtggcacagcccagagtgcaggtgtgtggacggctctttgtaacccatcccttccaggtgccacccttggcttttcaatgcgttccctcagagcacatgatgtcaggtgttccctgctcccggggctcacagtagagggcacacagaagttaaagggcggtaacaacaaagtgaacggcagcagtgggcacttgcctctgtcagagctcagctcactgtcactgtcctcaccatgacaccattgggaacacactaacgtccccactctcgagacagaagactgaggttgagaggtcgctgacagctcccaaggtcagacagtgcggcttcagaatccccaggggtgcgggggcggggggggggggcgctcagaattttccgccttttgcgcaaactccccagatgcttcttaaacacaatgaagtttgacacccaaaggtgataagatggggttttaaattcaggtccccaaatctagttctcttttgaagccacagctgccaccaatgtttaggtaatcagctgactaattctcacccagatgtttaatggcgattgactaatttatactggggaggtaattctgacaactcccagataacatttccattttagtggtagccttcaggcgcatatatatatatattatatagacaggggttgaaagggaagggagcatctctgcaaacagccccactcctctgatcccctgaagatgaccccaaacaagcgctgagtgttctacagaacgatccgccccacgtgcccctgtgcccctgcgtctgtgcacaccataggcctggggggtagggtggcctcgccctgcactgccccttcgcgcctcaccttgaacctgcttgccaggtggattcctggcactgagatgaccccgacacccctcttcagaacgctgggcctggtgccttgtttgggggacatctcaaccccatcatgtggagttccgtggcatcaggcaccacacagaaccctttggggttgtgagagggaggctggcatgacactgtcagctgaaagctagcaaggccaaggtaaaccatggccaaatagtctaacacgcgcgggcctctgaaaggcaggagctgtggctggggttggggcctggagacaagcccgtggtttgggacccaataaagcaaccaggagtgatctccatgtggggaaaacctggaaaacagacagtgactgaaagggcggattacagggagagccttcctcaagcaaccaccccaggcggggtccgaggtgaggggtgaggtctgcgtccctcccgtgtttcaaggtccatcacagcagttcccagacttctgtctgagatggcgggtgttccctgttgggtgcgctcttttcctctcccttccaacaccactgtgcaattcattttccctgcgggtcttttaagtattggcaaatgcaggaaattttttaaaaaaatgaaatggagggcaaattggatttcatcctgagcaaaaggaatctatagaattgatccccaggacctctgctcttggggtcccactaggcctttactggggacacactgtggtcagttgtctagcagaagttacaatccaggcttctctttctgggtttaggtcaagtttgcttcagaaatgtgaaagggcttttgtgttggcagcccctgtacaagtggctttggaatagccacttaccagctggctttgaaagaattctttttgctaagagctttacttaggttcctcaccaaacacaaatactagtctttcctccatctccatgcccaaggaaaaaacagcccatgatgcaaacccacagcaagcaagatgatttctatcaggggagacttttacaggcagaccagctgtagggtccattctctttatgacatgcattatggatctccccaagagaagaaggcagaggaggtcacctgagggtgaacctactgagcccagagtgatgggcccctcaggagctgggaggctcagccaggactgtgccctaatggctgggggaggctatgggctccggccctgctgcttccttttagccatctgcacacacaccgagcactcacggcccacagggcccaggggagctctgagaaccaccactggtcttgtccatctttcataattcagaagaatcagggttaaaaaaagtgcatgagcaatcgacataatttatatgttgcaagtggacgagctggcatcctctcacatcataaagtttaaataacggtggtttaacaccagatgtaagtgcagctgtcctgagcggaacgccattaactccattacaacaggagatggtacttttcccagttcggcatccccaggaaaacatcacacctgtcatcttggtgccacaagcagctgacttaatgcagagtctaccggcaccttttcagatcagatccatcagggagctggagcattcacagaggaggggagatcagggctgcagaccaatgggggagagccaggtgatgccagcccttagtacatgctggacaagacccagaccccaggtgttcccaggtagccagactcttcaccctggagggggaatggggtgagtggagggagacagggacagaggagggagaggcatgatgggagggaggaaagaaggggaactgggagaggaagaagaatggagggagaggaaaccaaaaggatgggagttagatctgggcctaagtaactcggagaaggaagctctttcccagttatggcaaagtccctagagggcaggttgaattgatttaggcaggcagggtctgcacacattgatttgttccacctgcattggctgagggtcactgtttcccttccaatcaggaagccttctgagggcctgctgtttacgaaaggaaagtttgagaatgttggccaggcacggtggctcatgcctgtaatcccagcactttgggaggcagaggcgtgcggattacctgaggtcaggagttcaagatcagcctggccaacatggcaaaactctgtctctactaaaaaaaaaaaaattagctgggcatggtggcaggcacctgtaatgccagctacttggcaggctgaggcagaagaatcgcttgaacccaggagggggaggttgcagtgagctgagatcatgccacttcactctagcctgggcaacaagagcaaaagtctgtctcaaaaaagaaaaaaaagagaatgttaacatcaagaaaaggccaacaggaccaaaacacagcagaaacacatgtgtggagcagagccaccacctctgtctgtacttgggctaagccagggtccgtggaacactttgctgggtacagagcagcctcatctcagagatgagaaactgaggcctggggggagggacaggaacttctccaaggctcctgaggcatttgagaaggaaacagaattgttcaagttgggcggaagaattgaatatttctgtttgtctggcaacggatttgctgtacctctccaccaagggaagagagcatcgagattgcgcatgagctataggcaccaaggtggccacagccaaagagagaaggagccatttgtcctgctgtctgcctgcctcctaatgcttccctgtcaggcactgtagatgcagatacaaaaagtatggtccctcttcccccaggagcccacacctggctggggagatagacctacagagtatctggggctgccgtggagttccacacagcaggctgttggggcacagaggatggagccctcccaacttggcagaagagccttgccaggagaaggagaagctggctgcctggcctcactcccattggaaatataaaaactctagctgcatggcagagtgtcactcttgcctttctgattacctggggagaagcatgtctaagaagatatagactattcttgttgtatcatcctttgctcatatctctcaagtaccaaaccaaacaactgaattttttaaaggcgacaaaggtatttgtgtttcactgagcaatgagaggaaaacaatgcaggaattcttagagggatctgcagccagagaaattttcctgagctaagagatttctgtgcaggcaatttccacaggcacttctcatttaaatggaaattcctccagaaacaccaccaccaacaacagctaacatctagtgctttactaagtgctaggctctgagaggtgcacatgtattaactcatttaatcctcacaacttccttatgaggtaagtgctcgtattaaatgtactgtgtagatgaagaaattgaggctcaaagaggttaagcaatcagtccaagatcgctcaggttgtaagtagtagagccaggatttgaatccaggaaagcaggagctgtgcttgggcagccccagtggatgctcttccagggaccccaggcagctgagtggagtgtcctgttgctattcctgccagagagaacacacatggcacagctctgctgttctcagactacatctaaaagacaggatgatgacagttctttattgcaggcgcactctgtgcagtgtcccatttagtcagagtcctaccaacaactctatgaagcaactgaggcacagcagtgaagtcacttgttggaggttatacaaatggtgcattatgaacttgaattcaatatcagtgcctagaacaatgcctgtgcacatacaggctcaaaaatgaatgaatgaatgaatgaatgaacagatgagtgactccagatccaagcccaggccacccctcagtgtgccatactgtatcttctatgtcactcttcttctacatccaacgacaacacagacagtgagaaggcagtaacagaacatggaattttttctccttcctgaagggccccattcatgccaccttctcttgaagtctgtagttcttcatcatcaccatcatcatcatcatcatcataattcccacggtcttcatatgacatctgagtgtacacagactgcataatagcttttccaagatcttgtattcagactagatgaacttctgagtggatgctcccacccccaggcaatggaacctgtccctgggagtagcacttcactacacctgggcagaggggcctcacatagggacctatgctgtcttatcttgggctatctcaaggcaagtccctcctggacccaggccaaggagctggggaccaatatctgcctgagcttagaccttggggccagccctgactcttgcccacccaaggctgtcaacttggagaaggaaatggaagagaaggaacaagccaccttcttagaaacctcctagtgggtctgtggctgggagccacagcacgccccaagcaagggcactgatccccatgaagggccaccatgtccagcacggagttggtgtccaataaggactcttaggtcatctcatgactaatcaggaagagggggccaggttgaggggatggaggctttggaggaacagtggctgcccagcctctaaggcagtgttttcacagtcctgaaaacattacagcatttttatatttcctaagaagtggaaacaactaagttgggttgggatgaggcatcccagcaacacagcagctgtcagaagagaagcacaaaccattctcagcaatataaatatcacatttcctcctcaatcagcgagttttaatttatttatctagctgagccatgatggacacagtctgcccaaatatattacatgaggataatgcaatctcttatccagaaaaccaccatattatagatactatcacgctactttctcaaaagcatttggtaccctagcaaccaaaaaagaaaaaaaaacaacaacaactaggacataaaaattacattgcatctgcaatactttgttgaaattggttttgcaataaagcatgtattgtaaaaacaaaggtttaatgatatatcagtttggtgaaaatctgagtacaaagcaaaaatacctacatctgagtaaagttgcagagcttttaaaaatgaaacttggcaaggaaatcctggacaagcttcagctggaagggtgctggattttaattttttctgaatggtgggtttgcaccagcgataccccttcctccacacacaacttcggcatcaatcctgaatctgaaccttcagcagcagtcgctggatctcataagctcacagaggtggcagatggctgcctggacatagaaactatttgtcaagaaaggaaaatatctctgccctcaaaggcggcatttctctcaccatggaatcacacgttagctgggaacatttgaagggaattcatgaggcagccgagcgcgagtcacgatggctgccccgctctgtgataagccaccacccacattctgttgacctagaatttgtctgttctgaataccacacaaagtttgccagtcaccctctggggcttgaaggctctttttcttttctgtggggggtggtccctcagcaaccagaccaggcctgcaatttctgagaccccaagatgtgtgggctcctaaagcattctctcctatcacaggggtctcctcatggcatttcattttagagttttctctgttgacaatctccttcacaaactgagatcgccttgagggcagggccttgtcttgttgactcggtgccccactcccagcccagtacttggtgcagagtagccctcactcaacatgggttggttaaatgaaggcatgagtgtcaggctccatactaaaggaggagggtagagagatgagggagacgtggcccctgccttgggaggtttgtggttgagttgaggaagagtggagagggagaggtgcacatggcacattcagtaatctccccatgtttagatttcctcctctttattccttcatctacccaggctcctcttcttggtacttcctagccttcctgctttagaaaaaggacaaactcatcctatgaaaatgctgggcaattatcttgagaggtatttttatttcccaagaaaataataggcaaggaaacgctgaacccataagaatgaatgagagcatttctggcatagtaacttctgggcgaaggtaaaacattgcaactgctaccgataacacagcaaaagataaaataaatttgttttttaagcatatatatatatatatgtgtacctcattgattacatttcttaacatacattgattgcgttttcaaatacctgctagaaaggcccaggcatgcagacttagccagctgaagctgacaagagagggtctttgaaagaggcctgcaaaagagaaatgtctagatggagagaaaagaaggaaaatcccaagggaagttttatgtcagctcaagaccatattcaaggaggcttcaagagcaaaatgatacttaaggtcttagaagagaagtgaatggtcaaaaggcaaagggttggtgacatggaattatgaacaagactcctggcctggtgcccacactccaccacagcctgaggacatggacttctgcaaacctgtgctggcctcctgctcccttgccaggaagggaatgcctccagcctgggctagcacccagaagttcatgtgcatgctccctctgaacccacagggaggctcctggaggtctgacagtcgccgaatacttctaggttcccagctctcgtagtgtcttgtcatcagcaagttctacttgctacgtgtaaggcaggggagggcgttctggggatagtaagttagcaatgcaggtatttcctgtaaagagcctcagccatgtggatcagtcttttgggcataatgtcctggttatattaggaccccagggactcttggaggagctcctcagggtccttctgtatctctgatttctgcagcacatcattcactgactcacacatgcacatacacacaccctagcccaaacctcctggtgggtggagatgaagcccactggctgtgaagctggccgtcctgagacaacaagtgggccatgctcggactggacgccaacttaggccttgtgatagctttggcttctactttttgctttagctttgatgtgctctgggttacacacttggctagtgagccctgcttttgggggatggtcaccctcccctttcttcagtgtagcttacgcattagtccagcttagggagggggaaaaccagctgattctctgcctgctgcctacactgccttcaagacccagacacaggctttccctgctgaggccaacagcccttggtggtcactggcactttgggttaggacccaatagtatgaagctttctttctttcctttttttctgaagacttgtcaatggtcaaggcacatcatacaaagttgtacttaaaaaaacaaaacaaaacaaaacaaaacaaaacaaaaaaccctgaagcacaagtaacacaccacataagcatgcaattttcttcactatggttttgccccagcataggaacgagcccccaactatctgtgacatgaatggttctgagttgagaagagctgggagcacacacagcctggctgcacccagaggatgccccaggaaacctgtctgcttcctacctctggtccatttgtgccctgctgactttttgaatttttgcccttcagatctctacacagtacaggaacttgctgaaagacctcatgaaatatgactggtgagattccattcctctgaccctcagcaaggatggagctaaatgcactgggtggaatttacaacctataattttctgtaacatttttcctggagtggggagatagagaaagaaaaaaaaaaagaagaagaaaaaaagaaagctaagagaaggaaatataatttcaattcattcatgatttatctattccctccctgtggctgcaggggaattttaactcggttgcaaaatggcctggttgtgcaagatgccacatgccatggaactgcaaacagcatgcgcacgttaacctttcctttgctggctgcttccagcctttcaccctgctgctacctggcctgacattttatagatttcagcaactgggcaggatatcacgggccttctggagcacacaggtgggtggtacctggtatgcatagactcacccctttccccgcacaaacaaaactctgtagccaatgtgaaacagaatgtttgaaatctgtgtcctttccacttctgctgctttctcctttatccaatgcctttcctttgaaatgctgtgaagccctgaagggatgcgagtgagctgtgaagaggagcctcttagaattgtcagtttcatgttagccagccaaggcagcggggccaatcaaacgcttctcagctgcctgtgtcatttgcactgatgggctccacctacaaaggagtcgtcagcatctcaagtctgcattgccccacttggtgtaacaaagcccttccccatacatttccccattcaatctgcttctgccatttaatcaagcattctttaacttccagaagaaaagggaacacagtgaccttggaaggagtggatgaggccattaatcaatggtctctgcatgtaaatgaggagcagccaattcctacagctgagcatcagattccaattagtgcacaagaccgagtccgggaggaaggggttaatgtcaaatgtcaccaggcagaagaaacacaggaaaattcattcccatagcctggcctccgacaagcatctatctatctatacgttcagctgaactttcctttcccattctgcgcagtgaacagtcattgtttaaaaatgtcatgataataatcagcttttgcggcaaagatatgaaaaatgtattttaagatcaaaaggatgatattgtcttccagcagattacacattccgcccacagaaaaggctaatctgatgtcctcagagaggaaataggtaaacattttcaacattatcaccatctgtgtttcatttctttgggcctgctcaagaaaaaagttatttatgtattaataaaaaagaatgattttgtccttcagaaaatggtaatggcagccttgaaatatctgccttgggttttacaatcccagctgtgtatgcccaggaagaaacagggatgccatcagctcacctccttgggtagtgagcctccttcctccccgttctctgtcttcatcccaaattgaagttaggtctggcattggccaaggcagcatctcatcccatgtatttcatgaggagagaataggcttccttaatgggaatgccagagaggtgccctggggttggaatccccgtccttctgcatctggcaagccacatgtcctctctgggcctgggtcccatctgtggactggggatggcctggcctcatgggaatgcccccagatgatgggcaactgttttccagttaccagggcctcacagacacaagcactggcatcactgttgtctgtgggagtattatcaccaaacacaaggtgggagaggaggagggaaggattgagtgctgtaaaacctgcaaccttttagattgtttcaagcgttggcttggacagcctcctgtgaaggccccatcacatcctccaggagctctggagcagcagggggtagggtgcacacacacctgttgtagacggggacggaggagaggcgcagcggacattagacaccccagctcccatggcctctgaaagtcaggctggtgctgatggatggctcagacctctgccttagaggtatggtgtcactgcccccacctccaacagaccccacctgcctctggaagcaggagggcatgtgtggggctgaaggctctcgggaagctttcagccagcagtcttccagaaactgcagagattccactgtttttccccatttccttgggcctgagaggctgaagcaaagggcacatatgtttattctgaggctaaaaacaaagagcaaagcaaacccaccgacagtccccgagagtgctttccctttccaccaccctggggtccgtgcagggcagcccttcctccaaagcagtggagagggaagcccccatcagccaccacccatgaagagtctgcatgtggaattaatagcataccaagagtcactcagtatttaggacaattaaatatgacgaggattagatttttttaattccaggttaaaaaaaacccacttatttagaacttcaagtgtcaatataaaataatgtttttttaaaaattgttttgctctcaaaaatctaccttagagttgagtaaattaaatattcaattagcagatattatcaaacatctgcagaggagactgtggagaattaacaacaaagcaaaaccaaacagacagtccttgtcctccagcagtttgtagtctgaggcaatggggtcacacaggagaggaaagaggctgtgggggccaaggctacctctctcatgggagaacaggagaccataagcgtcaactcaggctttgggaagtgaaatgctgtggcgctgagttttgggttatctttgatgaactctggcttatccacactggactagtgagctgtgtgtctcaccaccctcccctttccctaggcaaagaatcatgccacactctccccctgcccctgtcatggacacagggtcctcctttgaggtaggaaaataggatctggaggcaggaaacacatgaggctgattcacacttcagctacgaaaggaaatatcctccccatagggtgtacgccgagtaaatgactttgtaactttacttcatcctcttcatttaaatagggtgtaaaccaagtaaccaatggaatcctctagagggtatttaagcccccataaattctgtaacggggcccttcaggccctatgctcaggcccgctcccacactgtggagtgtactttcattttcagtacatctctgcttatgttacttcattcttgctttgtgcgttttgtccaattctttgttcaagacaccgagaacctggacaccctccaccggtaacaccttccccagtgctctttccaagggcagcaaccaagccaccggggggatgacagcgccacctagtgtgcagctgtctgtccgccatctgattttggggtccccgctcctccttgcagggaccacacattttctgctcctggtcttttgcagtttccagctcagttagtttcaccttatcattgcttctcgcatgaacacacatttcttttctttctgtctatgagctccagggctctattcctagagaagcctaatagtcgcaagcctcatctccgttttaagaagtaacagggcatgttttatagtgaaactgaaaaaaagtcgactttccagtggggcccaacgctacctaggggatctgattgtctctttggaaactttctacagggagtattcactgggtcagggcaggcctgaatgctagtcacactgctggctgtgtgactttgggccaaacaccaaatttctctgagtctcagtttcctcgtttgataaacaagggcttgaattgagctctggctcaaacgccttccaactcttgcatgctctgaggctaacttctcatcctctttcagttaaatctgtttccttcaggttacgccaagcaagagaaaataaaggaacaatttccctttcagtgctacaatttttcttataacattggattccatgatattaattgtatgtataaagtagtttttagcaacattgaaggttaaataaagttttggacactagtgcagaagtcaaaccacattcaggagaatactcctgtggaaaaaaatgcatttttgttttcaaaggtctagatgactgcctaatgctaaactgctgggagcaaaactctcttgtgagttgtggactgcttgcacaaatcacttactcaaattccatctgtcaatgtggctctgatattaaaattgccaatctaaagggacaataccctaactagcatgggtttcaatccacgacacaatattggggcctccatccatcctcccctgtcataacagactgattacctccagaagtggttcttcaagaacagggtgactgtcacatttttggcattttggcctcttgcaagggacttaattacatttctaggtagtttactggagctttaaacatttttctgttccatatcctaactctacagtgcaatctcccagttttagttcaccaatgtttgttgctgtaaatctgtccttgaaacatcctgggatgaatgcaaatttgatttttactccctaaacaaacaaacaaacaaacaaacaaaccctccgaattagcaaagaaattctacggaagttacaagctaggctctgttgctgactgactggacatatctggggcgcccaataagatatttttcactccagtgaccttggagaagggttggatgcttcatccttattcactattctgctattcatatcaaagcattttataccatttatatgatttatcatgccatttgatcagcctgcgtaataagtctcataagttatcttcatttgagaactttactcccccaacacatttaaaaagaaaagaccgagacctaggatgtttaaataagaaaataactacacattctcacaaccacacctcagaacctcctggctctcagcaaggatgagacaagctctaggcctatgcaggtttagaggaagagtcctgccaagcacaggccctgctgccagccatgatatgagaagtaaacaatggtctcaggcagcaagtgggggccatctgctttcaaaaaccatctgacctcacctgagtccatcacagacactgtccaaagaaggggcattggggagagaaaggtagacacagatctcaagaccacgtcctcactgaggcaagagagccacgacaactgcttctgtgacatgccccgatgtcccctctggccccccagatgatgtcttctcaaacagaaagctggccaggtgctcacacacaggcttggcactcatagcccttgaggggcagggcctgggagcttggtcctccctctccccacaccctggagaattcctaggaaatatgccaagctctgtgtccctttggtgccagggcacatgcgtgctcttgttctcactccaagatgtagaaaacaccttaattatctttcagcccattaacactcaactctgtggcccagaattcaattcaactcaagtggactcaaagtagcacatgtggaggatgcaggggttgactctggagcctccacttcactcctaacgattaatcaaagacactcctgaaatcccacttccatgacaacgattggttcgggaaggagccggtagactaccctggccagtgaaatgtgaggagtgctaagaaggattctgaagagatagtctttttccttggatgtgggtctgtgagtgactctgcacggtccagctggaaggctaagctggcccacgaaggatgatagagtggaaggaagccggcgcttgatactgatgatggttctgagcctggggcctgccctattcatggacttggcaatgtgtaaaaataattttccctactatttgagccagtttggggctttctgtaacctagagagcaggtgacctgacaccacactcagtttctgagctgcgcctgggccaaggtctcagagatgggagactttgtgctcctggagttcgcaagcaaccagagtctggcttcatcttccttccaaagcctggctgaggaatgccgtgcgaggcaggaagtctcttctaggtctcagggatttgaccatctttactatgcatgaagcaccagcaagcaatcacggcaggcccaaggccacgccagcatccttagtgactgtgtgtcaggcctcacagacactccctgtcctatgagtacctggtgacagagatttgaacaaattttagtcaggcttttttgagccctctgctttgcagggcctaatccttggtctactgggcccagttttagcaaagaatcctgagaagccaatttatccaggatcctccactcttgatatccaatcaagtgtctcttcctccacctagaagtctaatcaagttccccaccccctacaccaaactaagccctcttggtaattttccatcctttcccttactccaccagctgtaaatccctacctgtccctgtcgtatttggacttgagttcaaccaagtgttagagcaatttctcttcaccactggccatccattttccccttgtacctgtgctttgtgtttcttctctggggtgcaaacccagacagcaaggcaggggaaatggtctgttccctaaagcacactctcctccctcatcttttcctggcttctcaacctcctaggacaaatttcttacataatcagaggactgggtttttcatacagctatgaagattaaagtacaatatcctgtgtcaaggagtttgactttaatatatcctggcatagatgactgatagcctttcctgagagcaaatgaggagagagaacgaatacaagtgactgcatgaatgaatcaattactaaatgaaggtgctgagcacctgaaggcaggctggagaataggaaggaccagcaaagttaggtggaggctggggaagccaaggactggcttcttcactggcattacaaatttggtgcagagcagttccaagccttcttgccaaactattcttccatgtcagtatcgattcattgttttgaattcagtctcaatcacctcccaaggtgacagtccctgaacctggagtgtgtactcactgacatatcacaactgtgatggatcaaccgtctcacgtctcaaggtgcccttggatgttccacctagaagctctgcttctgagatgacacttacactaagcagtgttggggccgcccctccccgtctgcacaagacatctgtagcccagccctgcctttgctctatctgagcgcaaatccaccaggccaggtgcggcagtggaggtgcccagaagagcccaagttactaacttgaaggctgctacattttcccaagaacaaaatcactcttcattgctgagtccatatgcaggtttttctggtttaataatgagaaagacagtcccacccccacaccaccaaataccccaaacaaaaccatagcccaggcttaaaaggttccagttgttcaagggatatctctctctctctttcacaaaaggaaaacctttactggttttacaaacacagcatcagcagaggggccggcctcgtggggaaaagttcatttgactcctgtggcacaagcaactctcccagaacagcagcttccagcactgagctcatactcctaccttccccccatggaggggagaggtgcaggtcagccatgaaggagggagaaagctgctgcaaggaagcctggggaaaacttggtccctggacctggaggccacacagagtcgagccagggagttgctcacccagctgcaggatttgatcggggaaattctcaaaggttatgcaaaagaagaggctgttttcatactttttatgtatgtatttcatacaaaatatagcggactcaactagtaatttaagtgggacctttctgtgaccttccctgataggagcagtctctactcaaccacatctataatacatccccaagaagtcagtgcttggcttccccaacccccacctacctttgctggtccttcctattttccaacctgccttcaggtgctcgacaccttcgtttattaattgattcatgcatgcagtcactttgtatttactctctctctctcctcatttgttctcagtaaagggtatcagtcatttatatgaatggtaatttgcacatagggcagtccggcctgctatctttgctagtccctgaaaggcgttgccacattggtctcccctggcctctgcccatgccatgctcactcctttctttgcctggtgttccctccattgggagcacccattctatttcttacccacccttcaaagtcaggctcaagttcttatggcctctcaaagtctttcctacctgatttaacccatattagtctcctctgagctcctctcatccgtaagaccgtgccacagaaatatgaacaggattctgtgctgtcttgtattatcttgttactttccccccaaatagagaataagcttcctgaggccaggtcccatgccacatattccacgaagccccaagcagggtgctgagcccagcccatggtgggagcggtggttgttcaggagtgaggcagactagctctgggttctagtcctgggtgggtgacccagaatcagttcttgctctgggcagggggtggggaggccactccccacacacatggaggagcacagtggggttgggccagtgctcactgtcctggtaagggagcagttcctctcagactttggtgagtggcagcacagctgcaggtgggcctgggtgacagcgactgtgtgagcctgaacagagggtcagtgctgtctaaggtgggaggaagaaagtcttaatgaggaccctgacaaagcagcatgcaacatgggcactgaaaccaactctaacagggatactggatttccaagtgattttatcgatggttgaaggctcaacatcgtggctagcttatcgtagagaccagacctctaatccctatgccaacaagcttccagtgcttatgggagagattaagttaggatttgtacattttcctgcagtggggcagggggaaggaataatttgtgcccctcacttggttgtgagtggaaggaaacgggacatggcctctgccatcaaagtgtttacccacttcttgagcaagtttctcaccacatcctgctccccatatgggaaaggagggggcagggtggggacagagtccctgatgagccaatccatcaatctctctcttccccagggttctcattttgagtggagttgaggtagaagaattccttgggacaagaacacttaccggccaggtgcggtggctcaagcctgtaatcccagcactttgggaggccgaggcgggcagatcatggggtcaggagatcgagaccattctggctaacacggtgaaaccccgtctctactaaaaatacaaaaaattagccgggtgcggtggcaggcgcctgtagtcccagctactcgggaggctgaggcaggagaatggcgtgaacccaggaggcggagcttgcagtgagccgagatagcgccactgcagtccggcctgggcgaaagagcgagactctgtctcaaaaaaaaaaaaaaagaacatttaccaatcctcagggttactcattcattcaaagttcatccatccacccatctaccatgtatccggtcaacatttattgaattccctctgagtaataaatagaccctttgccacatgacaggagtacaaagtgaacagggcaaggccctgcctctctcaggctgctcacaatctggcaagggcaacagagagacaaatggatgcaagacagtgtgaaattgagataagtcctaagcccagcacgctggggaaggcttcacagggaaggacgcctggcctgaggaatgaggagcagtctagggtcagagtgtgagtgtgtgtgtgtcagtgtgagtgtgtgtgtgtgtaagtgtgagagtgtgtgtgagaatatgagtgtgtgagtacgagtgactgtatgtgtgtgtatgtgtatgagtgtgaatgtatatgtgacagtgtatgagtgtgtgagcatgtgtgagtgtatgtgagagtatgattgtatgagtatatgtatgtatgtgtgcatgtgtatgtgtgagtgtaagagtgtgtgtgtatatatgtctgaatatgtatgtgggtgtgtgtgtgtatatgtgtatgtgtgtgagagtgagtgtatgagtgtgggagtatgcgtgtatgtgagtatatgagtgtgtgagtatatgagggtgtatatgagcatgtgtgagaatgagtatatgtgagtgtgtgtgtgtgtgtgtgtgtgtgagtgtgtatgtgtacaccactgcattccctgggacagaggctcagtggcatgacagagtgaaggtgtgagaagccaggtttcccacggctgggcctgcaggaggaggctggctctcccctccctgatgccaagggttgtctgatacgttgtctcctagcttacaggaagccacaaagccattaagaagtggcaaattatgatctgattgtgttacttgtgtcttgggccgcccctactgcgactgaaaggagggcagctgggaggaagacagtgacctcagcaggggctgctgcagaaatctgggtcacagagggtgggcctgagtcaaggctgtgacggaggggatgggcagaagacagaatccataggtcttgcaggcaagggggagagaagggcaggagttccctcagagaagccaggagtagaggcttgcacccccaccccgatggagcacacggctcacctcataaaggcctcaacctcctgagcagcctgtgctccctggtgactgctttctggctgtttgctcagacactgctggctgtgaactaaacactcctaaaatgtttcttatacattgcagacgtttttctaccttgaaacactcgggtggtttaatttgttttctgaaataacaaaagcaattagagtaattgtcttcagaatggggcactcctagggaacaacctcaaccccacacaggaggcgcctggcagattcattccaggttcataatttatggagcaatttgcctgtcctctcacaggcaggagcctctcagcaaggggaaggtgtaccaggcaccaggtgacttacttggtagcctgtttgtagctcctcttgctgggaagatgaaaataagagatagttacttcccaccatggggaaggctgggggaggcaggcagggggaggcctgcccacccagcacaggacctctgggcaccaacaagggctctgtgggtcttgtcttagtgccctgtgggtgtccctgccccagggcatcgctctcctggtttgcagatgactccatcccactgagctagaaccagaccctgggtgccacagtccaggatgggtgggaatgataagctggatgtggtttgtggctgtctgtattttggttcatttccaagacaggtgatcagcagtattagggtgagttaagaatggaagaaggtgactgtggcttcatctcttcctctgttttcttatgaaggccgactcgaagtttctctgagagaattactagacctgccctctaaggcagaggagcccaagccacggagccactgccttttctccctctagccatgtcagcattgtatcagcagcaccaccattcaggccgcaggtcagctgctcagcaagccacaccccagcctaaggtccaggtcccagacctgagactcagtgtggcagcaccgggcaaactcccccagttgttcctgtgctgcaacctctgccaagggacttctgacaggcaggccagctatgaccaagctcacctccaggactttccagctcagtgcgggaaacagacggctacccaaccaacatgcagaatgacctatacgttacacaataacacacacgagggaagagctgagagggtggagggggtgagagattccctacaagtgcaggaatcatgaaactttcttgagaaatagcatttaatccaggccctaaaggaagggcagtatttgaaaggcaggtataattactcttaattgcaaaaaccacaattacttttgcactgacctcacagaagtcagtgcatctcaagctgaacaaatgcacagacatgtgaaagcagaagatgtgtctgagaggggactgctggtctcacttggccagagggcaggagccagaggaaagcagagggaggtaaggttagaaagacccctcaggaccggattgtgaagaggccgaatggcgatcaaggtgatagattctcctctgtgtgctgggagacccaatgccgccaattctgaagaccgtgggctgcattggccagggatgcaatggagccaggaactctgttggcaagatctgctcaaggagaagagaacagtccaagagctcataaccagagctgcattgagatgtggctttgggaaagggatgaatgacagatgacccagttttccactttaagcaagtgggtgaattttggtgctgttccctgcagccagcatgactggaggagatgcagatagtgttggacctggcagaggggatggaacagctttgctttgggcatgttaaactgggaatgccacatactaatattagaaagccagatgtttcaaacattttaaaaacaaaaggagagggttcaaaatgacagggtaggtacatgcatttctttcgcctgctgagactcaattacaatgtctttaaaagagtaaattacaacagtaaagatagtggaagaggcacccttggtgagcaagggatttaagtacatttccagaacattcactggcgcacaggacagaggacacctcagtccacagcccacagcccagaacatatgcagaagaggcagccgccgtacagggagcccacctccaaataacacctccctcagaggcacagtcaagataaggatggggaaaaattgaagcgctatatgtggaaaactctcttatgcagaaaaaaaaaacagaagaattttttgcctaaagaaatggaatccacagcccgcagagaaccacggtggttcctgtgggtgttagcaccttccatactctggaagggcattgcgtaggggctgctcacgtgacacccagctcccagcctgctcatcctaaagtggaaactgccagctgacaggccctgccctggaataagagcttccagtcaacccttgtgctgtccttacttccgtattggagtggacaaccaagaattgccagacccgcaacagaaaacacacagagcagtaccacagatgagctgaaaacaaacagatgaacaaacaatgacagctgactaaaaataaaacccaaacagagataatccatgtgacagaagaaaactaaaagtaaaagcataattcccaaagaaagccaaacactgcaaactagtatcctcagtcggtttcaacaagatgccacttctaggaatcagaaagcaagaaagtgtgcttgaaaattaaaagcatgagtcttaggctgggcgcagtggctcacgcctgtaattgcagcattttgggacgctgaggcaggcggatcacctggggtcaggagtttgagaccagcctggccaacatggtgaaaccccgtctctactaaaaatacaaaacttagtcaagagtagtggcgcgtgcctgtaatcacagctactcaggaggctgaggcaggagaatcgcttgaacccaggaggtggaggttgcagtgagccaagattgcaccactgcactccagcctggggaacaagagtgaaactctgcctcaaaaataaaataaaataaaataaaataaaataaaataaaataaaataaaataaaataaaaataaataaataaaaacatgagtcttgaaacaaaaagttcaatactcagatcagatgataaagccaagagaattttccagaatatagaataaaatatatagaacagacactttaagagaaaagtaacagaaaatattgatacaggaggtctcacatgcaattaagatttttagaaagacagaaacctgagaagaggaagttgcttaagaaaattataattgcttttatttgaggaaggatatatgtctttaggctgaaggacccacaaaaggaaccacaaagtcagacacatcattgcaaaattttataacatcaaggacattaatgttattttgttcatcatggatttttttgcattaattttgatttgtaaaatattgcattaaaatattatttgttttaactaccgcgtctttgtgttggaggcacgcacctcaattgcctcactctgatcctcgccctgttttgtgccaggcatagaaactggagataagtgagtgaatcagcttctactctcatgaaccttaaagggttcatgaagggattgctctggtcccaatgctgtgtccccctcaactcatatgttgaaatcttaacccccaaggtgatggtattaggatgtggggcctttgggaggtgattaggtcaggagagtggaattctcatggatgggattggtgccctcataaaagagaccccagagaggcctctgccccttctgccatgtgaggacacagctgaaaggtgccatctatgaaccagaaagtgggccctcaccagactctgacttggccagtgctttgatgttagacttctcagccaccgaaattttaaatttctgttgtttatcagctacccaggctatgcgattttgttatagtagcctcagtggactaacacagggatgatcctaatagcttccagatagattaaatgggtcacccacaaggaataaggatcagtctagcattggactttttaccaatgacactgcttgcttaaagatgatgcctttaaaagtatgacggtgtggtttttctctcctggatacacagttaacactacacttttcatcccccttgctctagagggggccattccactaggtctcacatacagggtgtgagtagaatgatacgtcacctctgggctggatcagttaagagctgctgggccttttccatgttctttcaaatctccctctcatccttgtccatagtgaccttgggggccacactatagaaggaatctggtttcagaattaccgtgtggagcagagaactcctgcactccatcaggggaatgagcaggctgtgctgtgagtatacaataaactgtattatactactgatatttgggggttatatagcagttatactatcttgactattagaagaaaaaatttcaacctggaattctatatccagccgatctgtcaatcaagtacaagtacagaatgaaagcattttcaaatatgtgagtaatagaaagtggaactcctgtgcacactttctcaggaaataacataagggtgtaccccagaaaagagaaagtgcaagccaagaaaggaaattcaggataacttgggaaggagagtgcgagcaaaaagaacattctagattagaataagaaaaagaggctccagaagaaaggactccataaaaaacacaactgatgataaaagaaatcatattagtgaatgcctagaaaatgtgaggatatgtggaaggcaattgatggagggtaaaaaaggagaatttatttcagcctgataccagaaaagagtcttcactgaatggctcagagttggtatgctggatgcatagagaactaaatgaaatactaggacatgatttgactctccaacattggcatctcacagtcatactaatgtaaatgcgatttatttgtcttcaactttcagaatcagcttatagacaaatgatagaagaccatccaaatgctgacatggcaaggacatcttggtcatcaagtctaaccccagccttgaaagatgaatacaccagggtttgaacagggatgtgattttcccaaggtccctgagtgtgtagcaggggttggagggcaatggccttggtgcctgtactcccagtcccactgtgccctgactcttgtactgttcaccttgcctggactcacactcacaagccatggcagggggagctcctgcccatgaccttgctttctcagcaaaggctattgtgactcctgcagggtttatcacctagttccagttctgacacgccttcccctccctgtttctttagacacttttcctcccagtaggggcagctgttgatttcttctctagagaagataaccttgcctgtccaatgtgttctaatctagtgctctgtttctacagttttcagatgctattggagagactctgatttgaaaagaaaagaaaaaaaaaatcaatggtgtgttttgtacaggtgacacgtcaaagcatgtcagctgcttggcagtttgactcctaaccagctggtctgcagtatcagcgacagggtagaatgcttggccctttggtcgtgactggacaaagtggctcctagctgcatgcagtgtgtccctcccatggtctgagatcagcaccgaccagtcatgcttgaccccgtaaccacttcgacagccatcagcacacgctgcagcaccacacatgcagtgtgtggtgagggctgcccaactgcttagggggtcaagaggttattaggccagacctctgcctccgcgtcaacacattacctacatatgcttgaatagaggagtcttccacatttggaatctctaagaaaggtgtaataacagagatagaatctctagagaaatcttaggtattagtctgttctcatgctgctgtgaagaaatacctgagactgggtaatttacagaggaaagaggtttaattcactcacagtttcccatggctagggaagcctcaggaaacttacaatcatggtagaaggcacctcttcacagggtggcaggagagacaatgagtgcagagtgaagaggagaaaagctccttataaaaccatcagatcttgtgcgaactcactcactatcataagaacagcatgggggagctgcccccataatctaatcacctcccatgaggtccctcccccaatacatggggattgcaatttgaattacaactcaagatgagattttgggtggggacacagccaaaccatgtcatcttgctacagggatggtatgatctaacccacagtaaagaaaacagattctaaatctcacctcaactccgcctgctgtattttctttccaccttaggctcatcttcagggggagctgagacatggggagtgcagcatctggggtggcctcttgcatacaggtggtgcctaataaccagggaatgggacattcacacaatccctccatgccccagtttttgacccctgcatcaccctctctcatcacgtcctccacgcatgctgcccaagaatgaacaaacgggagacagggccaggctcttgctgagaactgcaagtgccagtgcccagctagagagcacagcaccccccggaacacaggttcaggctgggcattttcatctgtagcccccgtgaaggagtgtccctagctccatcagtgcactgagaaatgcacaggccagtggaaaatgccaggatttgctcatttctgttaatggttctattctgtagctgtcattaaaggcattctgtgctcaaggatgggcaaaactccatggctttcgtgacttacaggcaggcactgcaacattaagcagctacttgtgaggaagagccttcattttctgcttccctaccctggcattaataaggaaagcacatctaattgccaaaaatggttgatgcaatgagagaaaactccgagcaccagggtcagtggaaaggactggctcaccaatgattactcttaaattatctctcctctgtcttagcagcttcctttaaacgcagtaaacaaacagcaactgctttgcagttttgactgataagtatctcatgaacgaggcccgtaattttaattgatggcacccacttcctcccggtgctcccaacacccatgggggaactcagcctcacagtgttcgcggggaaacccaagtcattccgtggccccgaagtcatcctaatgttaggttcccaaaggctgtcctcagcagagagagaataaaaaggaatgcctcagctcatgtgtcacaagcaggctgtgagcctcgtgtgcagcccaggctggccccaggacatggcccgggcaggcatttaagtatgggaagcaggggagctggacgtccgtcacatgtctcagttaggaactaaaactaagcttcaggctcctgttcccgagaatttgctccgtcctgacaaaaaccgcatcaattttcccagttaactaccaataggtgggagagaagggcacacaccaaaatgtcatttataatttaaaattcattattgaaaagggctctgcagtaatagttcaacctcaatcatttcaaagatgctttcacaaaggcggcgtccgaccgtgggaacggggaggccaggagggttttccagggctgccttccctgttccctgtaccgtgcctccccctcccctgccacaaccctcctgtcagaaagctattttatctctggagaagttttatgccagggatatatgaccagaatacatgaaggtcttttgaatttattttcaatagccctgctactctcttctctatgaaatatttagcacttaactcgttatttctgctgctggcaaagtctcaggtgcaggtggctttgtagacatggcagaatgtcacaccaaggtaattgtttctctttatttcctctagataaagaataagtaataggcaagtcggaattatcgggtggtgcttccatcatgagctcctgtgataacataaactgggagattgaatttggagtggtctgcataatcagccctccccgctacttcaacaatttgcctgtgagtgaatctgcattcgtgagccacctctgctaccctgctctcacgcgtgtgtgagagttcctgccttctaggagctctgagtggtggaactggcttttaatgtccaccctccagaggagtctgggcgaataaggcttatcttgtggggctctctgagaaggtggcaggagggtaaggtgggtgaggggtgcacagcagaagcaaagttcaggaaaggaggaggacgagagaaaaggaaagtagcagaggcaaagaaaggtgctgaggccagcagaaaggtgtgaagagagaggctgctggggcaaaaacgggcaaaaatgagatcatcactcccggataagaggcttgctgaacagctaaaccaaatggaatcagtctccaaacctttggaggctctgtcattcagcttgaggcaaattccattaagctcagttacaaaaagatgaaggaactgggcggctagtgagtgctacatcttgggcaacgagcttatggcccctcgaccgccttgtcttgtgtataccacattgcagtttggttttcatgcatggctgacatgggcttgacatgaacactggtcaaggccctcagtttagcagcacattgttataccaatgctttcatagctctcaggaaaatttaagactgagaacaaagtttgttcctccaatccccagcattttaagcaggtgtaaatattcatgcatgatgggaaagctagttagagagaagttgttgtggagaatggttctgtgaattttttatagcctagccacttacctccttggtaaactcacacagaaaaaaagtgcacagatgtcaaatttccaccttcactgacatatgtccattctctcaggatagaggagaaatctctgtccatgtccaacatgtccttctgagccctatttacccaactacaattcccctattcaagggtcagagcttgtcctttctctgtagagtggacctcactgaccccgagtcagtgagacactcattgagccatctttatatatacatatatggtggtcatgggatccttcttcacctgaagaaggatcaagccaatcagaatgaatctaactgacccacctaaagtttacacccatgaccttggcctcttaggcaaagtgcctcaacatctgggggtggggctgcatctggcacacagtacgtcctcagtaaatcattttcttattgaagacttttgtgcccctgcagccttattctgctgtcagcattttgcttaagaagcaagcaaactaatactattgacatgaagatgtttacctactatttaggtttaaaatttggtttaaaatatgtttaaatgattcaataattattagtgagtaaaaatctagaaagaaaaaagaaaaagaaaaagcttaaaatatattcttcaaatctgcagatagcttagttggcttatacaaatactactctgatttctaaaggaaaggagtcaaatttctcacagataaccaataagcagttcagccattttctctctcatttgctctactattctaacaaattccattctttttaggtcttttcaatagactaccattatgttgggcatttactttaggcctgctagtctgtgttcaatgattttcatacaactcatttaatcctcctagcaaacctatggagacagggtttaactatgttcccaatttacaaataaggaaactgaggctggagagcacatgtggcttgcccaaggccaccagagttgcatatcaaacagtgctgtgtgattcccaaaaccccgctcttaatggactcaagttattctcttctcaggaagacacggggggaaaatgaccctttaatgttttgtctgcttctcttctcttagagaacaacctgctgaaattttatttggtttgggcggcaacttttctgaaagcatcttcttcaaactttatcttcaaaactctgcaaaaaatgtttttttttcttttcctgagaagtgccaattttccagagaattcagacagaaatttgcccaaataattaaattaataactctgtcttaggtactgaggcatacctcttgttggggacatttcatgtcactttatgcttcaattactggaaagttcccattgtctggccagtgtggctttgacagcgatgacatctgagggagacgccaatcattaatgccagccatacaagtatctcttcctgattttcactgtggtacatatcgttgtgtgagtgagtttcattaggaggcaaattatgttcttctactgaaggtccccattgaaccaagaaccacttttgatgttcttccaagatattactaatgaaaaatgtgtgggaatgagccacataaccgattccctgattttttttctcttaataaaatgtatgctgcataaagcccacattgtggccccatttggatttaggctcactcagctaccttcatcttcacgatttatggtgtggctatacacacaaacagtttaaaaatatcttgactgctcatctgaaattctaactgtattggtgagcaagtcgtctgtctctggactgcttccataacccactcgggttcagaccacaggaaggagcatccgtagctgtggtaacaggcggggataaataatgcattttcaggagagagccttattttgctgtagttgttagaatgcattccccatattacaggcttgcaaatttaatcttaatttcttctgtgagtttctctctaagattctccattgatcccctgagtcaagaaaatgtgtagtttatcatctgcctgatcaacaatagctgagttcctccaagttgcctcatccttttccttacatcagatcaggacaagattttaatttttcatgaagagtaaaactgtagctttctacatggccagataactggggtaatttgctcacacacacgagtgcagtttctgcttggggctattgaggcctctgcgatgacccggattgctaaatggaaaggagggtgccttgttaggcaggggtggcagagggaagcgaggagtccttcactgaccccacaaagtatggagagaagccgccccatccacagcagtgtctcagtccctaaagcatacagataaaaatgatttctcacctctcaaatctttgcacattttccatgtaaagtgaaatgtatttggataattctttaagtaaaatagaaatgtctactgccggggagaaattgagagaagtttaactaaaattaaaaagcagaaaaattctaaagtccttattatatgtctccacattatcttatttgatttccttcccagcactcatcactacctaacactcacctgccttgatttgctcacttactgcttgcctgcatgacaatcccatgaaggcggggaccatgtgcgtcttacttgctgcagggctcccagggctgagcccagtgctgggcacaaaaaaggagtaaataggtgtcagtttcgacacctattttgagtgaatcaaccagaaggcaccggcctgggccagccagactccactgatgatgtctataccgaggccgtaagacttctctaggatgcagttctttttccatctaaagagggtaatacaatagccaaagagtggaagcaaccaagatgttcatcagccgatgaacggatgcacaaaatgtggcacatgtgatggaatatgattcagcaaccaaaagacatgcaacaacatggaagaacctcaagaacactgtgcccagtggagaaagtcagaaacaaagtgacacattgtgtatgagtccatgtgagacatgcccagaggaggcaagagtacagtgacaaaaagtgagttaggggttgcctagggctggggtgggcatgggggtgcctggatatcggcatcaagtttcttttgcaggtgatgaaaatgttctaaaattagattgtagtgacaaactaattttagaaaattctgcaaacagaccaaaaatcattgacttgtacataaaatggatcagttttctggcatgtaaattatatcccaataaagctgttagaaaatgaaatactatgttaatgccatgagtttttgagtttttttcctgtggtctttgggaaatgcacagcagtgtggctaatgtgtcttttatctgcttaaacaaaataaattgaataaaaactccaaaaaattagaaaagacggggacactctaccctccctataaggatccaatgggacaatgtttgtgacaggacctaacaccgaatgcaagggagaaaggcagatgtggaccccaggcgaagttgaccctgctggtcataccacccccgcatgcagtaggcagatggggagggactcacaggctggagccagactgcctgggttcaaatctcagctccaccactaactggcctgatgcccttgggcaaattacttcacctctgtaagcctccgtttcctcatctgcaaaatcgggaccataatattaacctttcaccatgagacctgtacctggtgcagaataagccatatgtaaatatttgccattactactatttgagtttctcgcagaaaccgaggcacttaaaataccaccaaagtgcttcatggtcatcctgcggcactgaaggtgagaggtgtgggtataagagacctctggaatagcacacatggctttcaaagtcaccaaggttttgcctaaggggacattctctgattcaaccccagccactccttgtcctggttatacctggcttggatcaacgtgaagccggttctacttgtgggcccagctcctggagagagggtgacagagccctggtatggacgcggtgggagccaggatctcctctgcctcaatgttttccactgtattctccccagcgaggcctctgggcagtccccttgcaatctaacatctagaccttaaacctctgctccggatgctgccaccccagctgaataaccttcttcatgatcctgaagaaatgctttagtggatgatagttcttctgtttctctgggaagtggaaacttgatttttaaatgagatttctccctaaggcttcacctacctttcagcaaaacttccaagaaaagagcagctcccgacaccaaacagcaggtgccgcacatcacatttacggccccgtgtgtggaggaaggcaggccagcccatgacatagcagcggtccgagtaacccgctgggttccagtggaacccaggctggaagggaccgtggctgttggcctaataagccctaacaagctagcctgccaggggctgtgcactgcgctgtttaccaaggatgtcctgaggtcagtacatgtgactccatgagcagtgagcatgttgctctctggccttgagatgtttaactcttggttggcgttaatctggattgcaagttttatttctgagactgatcattcaagagctatcaagcattggtcaggcacggtggttcacatctgtaatcccagcacttggggaggctgaggtgggtggatcacttgaggccaggagtttgagaccagcctggccaacatggcaaaacacctatctgtactaaaaatacaaaaattaggtgggcatggtggcacacacctatagttccagatacttgagaggctgaggcaggagaatcacttgagcctgggaagcagaggttgcagtgagccaagattgcgcccctgcactccagcccgggtgacagagtgagactgtctcaaaaaaaaaaaaaaaaaaaaagctattaagcttttttaagggaactcatcacaggtagtcagctgctcagcttgaaagaacattctatttatttgtacattcaataaatgtttattgagtgctcactatgtgccaggctctggaccactgtctgggttcacaagggtgaacaagtcagacatagaccctacctacatggagcttacagtctgatgaagaagccaacagagcaacccggaattgaccaattgacctgtcatcaaaaggaagaggtctgctgctgggacagcagctcaagtgcagtcataataaaaagggctgtaaatctccaatgcctctctgtgccatctaaggcattcataccccaacaaaaaccatgagaataggcagaaagtgctgggtccaagctttggggaatttatcttgagaaggagggaaggagcaaaggaagctgccaccaacatggaaaaggaaaacatctgaagatgaactgtgctgcggtctggcgatgtctgcctgcagatgcagtgccagtttcactaacagctaatgcaaactgatgcaaaaacgtccatattgcaaaggaaaagtggaatcccaagactgttgatggaatctgctcagtatggaaggaaatgccatgcaaatgtgtgtttgaaagataatcaggaagccagactgcaatgccaagaaaaataaacccagtctgataatccagactatcctgggccaaagagccagatctgagcattgcacaggtttctggctggcactaccctagcatcaatgctgcagagcaacatttactacaagcaactgaaacaataggagaatctgttaaaaataatcaggctcccatgaaacataactggcaagggtaggggctgcccagaggttagtctgggctcagccatggttgttgcaggccctcaagagttcacagaaatggactgcttccagagaatgctgtagggcttacagaggctgacccctcaccttgcccatggtgcacttctccctgccagagaactagccaggccacccacagcacagcctcacagctccacagcagaaacagacgccaggggccccagctatggtgagagtgagcaggtggcaggggctgtctcaccacagcacatggcttgcagggtgtgcaggtaaggagaaggtgttggtatgcacgagagtggggatcccaaggcctcccagggagggcaggggctctgagatccctcagctgtacaaattggcaggagggaacttcagagcaagcctacagggaagctctgcatttcctgggaatgatgactcctgggccccttgctgataatccagactaccctgggccaaagagccaggcctgagcattgaaaaggaacttgcaggctgtcatggaccaaagccacctatggagaatgatatggtttggctgtgtccccacccaaatctcatcttgaattgtagctaccatcatcctatgtgtcgtgggagggacccagtgggaggtaactgaatcatgggggcaggtttttcccatgctgttctcatgatagtgaataagacttatatgagatctgatggttttataaagggcagttcccctgcacaaactcttgcctgccaccatgtaagatgtgcctttgctcctccttcacctcccaccatgactgtgagccctccccagccatgtggaactaagagtccattaaatctctttttctttgtaaattgcccagtcttgggtatttcttcatagcaataagaaaatgaactaatacagagatagcacaaatgcccagcaaagggcatgtgacagaaggccggccttgttcagggatgcaagtgtacatgcccctacatgtgtgtggactgcagaagcccattcctagcacccatcccaataaaagggctaggataagctggctggggctctgactggaccctctttaaagcctgaccatttaagcgcactccagtcccccgtggatgggctagttatcatctattctttcatcacagtttaccctctgacactggcttcagagttgcctcattatttagcctggaggccaaggccaggtcatgatccagccttttccttttggtgcttcggagcttctcatgataagtctttgtgtttcagtaaggcacaggcgggacatggtagtgggagacatcagtaggtctccagggcaggtaggggcctctgggtaggggcagaacatgctcagcaggaaataaaatcctttcctgctgccagttctgttatacagctcccaggctgcctccttggctctcacccagggcaaggccttgcccagcattctgcactacagaggtgctggctataaaggctttcctgtctgtggctcctccctgcagcctgccaggcctccaagcgagaatgtccactcctgctgtctttctctggactcttctctccctacccccacctcaaatctccagctctcctcatcctggctccagccacctggctgcctttcacttccttctaccttcctccacatacacctctgcctaagtaggaggtccatatagattctctctccctgggtgtggcaccttctctgctgtacagcaaattgggcaatgtcctcctctcccaggcatggactcctgaagcaaacggaaggccctgcacaagtggcaccatcatcatctctgagccctctctttgcagaacattgaaatggaggaagaaaaaagctttaagcagcatttcattgaaaggcttctcacacagaactttgacgatgacactgggagaggctacttataaaaataaaactttttaagaaatagagtttttcttcactcggttttcttaaaccaagatttaagaaatctcggttttcttcagtagcccaggaggaaggaagaatagaagatatctactagcccacatgagagaaaagctttattctcttacatttacaagaatcatcatgtgtcaaagagaaatatgctattctataaggtttaaaacaggtcatcttagaattctcatcctgcctttgccaaaacataaagagaatttctcctgctttctagacctccactgctgtatctgcacttggtggaagccctttctacacgctgctcagcaacatggtctctatcgtctcttaagtaacaacataacacagtgaaaagagcctagtgtcagcggtcagggtcaggacacttgaaatgtagccacacttctgcaaccgatgtcagtgtgagggcttcatattccccttctgtaaaatggggattccttccttcttactttgcataggtgtcatagaattagttgagatcgtgaatgtgacagctcagagctttctaaatgtaagcaccttgtatttattaggtaacagttcttattattgctgcagggaaaggtgccatgcagttcagaatcaagctcaattcaggcatggtttgaagggtaacttcagccaaagaactttctagctcttctcctttttctttgtcaaggattttaaaacattaatattacccttgacagtaaccataaattttggtttaaaaatgaaatgtgtctgccccaggtagtgccatttctctgtccagaaaataatttcatgagacattctaagagtttctttcaatggccacaaagaggacacttcagcagccgctgctgtaggaaaatttgttctcttaagcatgtgcttctgaacaaccaaggaggcagagttcacattcacagccagctcttgggagcagatgctgaagaatatctgcctggagactcacagagaaagcaggagggaaccctttatgggcaggtaatggcgcagcttcccatgcaggcagaccttgctggttcaggctaattgggaggacagccagcctgtgttggcaacagctgaatttgggaacattgaaagtgaaaagtaatttaatttcagtacatgcagcaactcaaattaggctaaggaagcatggccaggacttgctgctcagcagaggtcctttaaacccactttaagagaggtaaatgatttataatcagcacattccaagcaaatatgcaaatagcaggagccattgcagctgcaaacaagctgcggtcctaagtgggctggcagggcaggcaggaggcactccttcaggctgcagcaacgttcgggtcctcggcaagcactctggccctggaaaactcagcccagctgctggctaaagagtcaaatactgtacaggaccagggctgagttgctgaggtttgcctcgagtgcctgggagcatcttacccactgtacatggacatgttttgttcctgatccacagttatctgacacattacttgtcacagtgggcttcttccagaaaacaaactctccttcaagtggcaaatcccaattttctccagttcgggactatggagcctgtcttcccattggtaaatgggcatattcccaagggagcaggaagtacaaaggcccagctcctgggggaatggcactcacggtgagaatggctcacactcatgaacatgtggccttcatgcgaccatcggtaaaaacacgggctcatggaggagaataagcaaggtgtgggcagaggcgcctgagagacagagacaggattgggggaaggaaggagagagagatcgggagcaagagactgacacacacagacacactacgagagtatcagagagagacgtaaagaggaggacagggtacgaggggcggggagaaacagagaccaagagagggcaaggaagagagatacacagagacagtgagagactgaaggagagtgatgaagagcgggagggagaggaggggagagacaggttgggggagaggaagaaagaaagagagacggcagaggaggggggattgatttctctgaggaacaggagaaagggacataattgcagcaggcgttccctctcctgttctgtccttcattttctttaaaactagcttaatcatcaaccacatctgaaagcgcatttgaggagataagttgaagaaaaacgtgtttccctatgaaaaatccatcacccgacacaagctactctcatctcttgtgctaagaaagccaaaacaaccctggtgaccctttacagttgtgttactgcaaaaacctagaaacggccccctcttcaccctgccaaaccccagctcctggtctgaagtgatggtctcacaggggtcagtgatcccagagcaggagctggcggtgggtgggcggagcagaaggaactttgaaccacaccttcttaggcacaaacatacatattgaagcgccacaaaacagagcaaagtagtgttatccctgtttgacctatgaggaaattgaggcccagagaggataacttgctcaaagttatgcagccagtaggggagaatccgggtcccacctgacatgtgacactggcaggaggcccctgaccctggcttctgagaactgcacacccttacagcacacagctttgccatggagtgccacttacttatattacccttgccagcagctgtatctgggggtagtgggtctgattctggaatcccatacaccaatgaactgcatagaaggaccctgtgagcacattgctcaagaggacgctctgatgtaggcattttcctctctgagcacgtggaaggcctgacacagagctcctggtctcactgcccaagtcatgcccttacatctccctgcacttggcacgtggctctgcactcctcccagggtgactgggttcaggatgatcacacacagcaaagagaaggtgcctgtgacgtatgttgctgcttgatattcacttccttctgcaatctgagctgtcaccatctttccttgcagatgatggagcatgagccactctgaggttcagcatcactcacaaagtccctgcatgtgcaatggcagagtccttgtcttggtgaactgttctgctgttcatcaatctctgtgacctcaggtgagctcctgcctctgagcctcaggctttcatttattaaatgtagaagctgtaccccatagggttgttgccagtgtctcccaagttgatgtacatttcagcacggtgcctagttgatgacgagtcctctctcagtaaaggagggttggccatggaaagcttctccctatgcaggtgcttctccctgtacaggtgtggccagggactgtgttcacctcaccatctcaggatggtgctgaccacccccagcaactgccccactgagctcatttccagccctccactgagccacagctaaggactagcatgagcacttcgtgactgtctctgagctacttaaaatcctgcagacaccgggtctggctctaactctgctgctgaggacacttgggcaaatctccccactggtgtgggcctcagttttgccatctttagaaccaagcgtagatcatcaggtctgaaagagaccaaccagtcaaacaccagccttttgcagatgggaaaactggcattcaaagagggaagtgctcactactaatacaaagatagtgaaggaaatagaattcagacctcttcctgaacagctgatgctttaaaggactggagctaatttgaatatctgctaccatatacacatatggtttttaactggcattttataattttgatttttgctgatataattatcctgcattgtttaggattattttaaaaaagaaaagccaagatagctaagataatctttgcgacgagctctctttttttgagatggagtctcaccctgttgcccaggctggagtgcagtggcacaatctctgctcactgcaacctctgcctgctgggttcaagcgattctcatgtctcagcctcctgagtagctggaattacgggtacccaccaccacatccagctaatttttatattttggtagagatgtggtttcgccatgttggccaggctggtttctaactcctgacctcaagtgatctgcccaccgcggcctcccaaagtgctgagattacaggcgtgagccactgcacccagccaagctctctttttatggtaagaaatctacacagattgatgacgggacatgtcctttcatgtgtagggtagaaatcatgtttatctctagatgagaaatatgctattaaaaatgtagatttggaagtaaattcccaaaccattgtcaatttttattcttgaggaaaatgaaaacatagtagtaagagcttctgtgggatgggagtgggtatgggggtgttggctgcaaatgagccatgagtgcttcagagggccaccctcaccccaatctcatgggccccatgatgcccctcacccctcccactgcctctagataactaatcctactctctggcatctggagactgcccgtgagagattcacagagcctgaaaactccaaagctcctgctgtaggacctatccaaaaggccatcttgtcaaccccccattggacagagggtaggggtactgagaggggccaggtagcaggggttaaatgagcacaatcaatgctattagatggttgactcctccttcctctgggtcctatcctggcacggggtgccactactaatcaggcccagaagcatccaaaattcttaagataaataccaaactctggacctctgaagtgatagggcagaccctctggagaacccgtttctcggctaaccttctgtggggcatctgcctggcctagtccactgcagaaacctggttcctgttcagagatgttcattgcactgagtgttgggatggggccaagtgtcatgagaggcgaggaagaactcagtcagctaaataatgtaataatcctacacatgtggcagtatatgcaagtgacttccattgccaccacctaaagtagcacagagggcctccatttctcttttcttttttttctgtcacatgtctatcccaggggcttccatttttcaagtgagaaatgctagaatgcctttgaggtactatctagaaggttctgctagcagatatcgcctgtaacattcaggagaacttggggctaagactctcaaaatattcttaagaagacatgcaaagagccaggctcagggaccaatgccagttctggtggaggaaagttcccttttagcacatagacagcacactgagctgtctgagcaatggatacatagtatgtcacccccaaaatagccccagcttctccactccatgttgaccaagagagctccttggctctacctgtagggccctgatgccctccctaggtggtgacaaaagacaaggagacacttatcactgacatttgaacagatgcccatgaacattagtgagatcaaaggcttacctctagccctgaaagccagcctccagcctgaaaccagtgacatcatctcctacaactgcaaccagtgacatcatctcctacaactcgttccttttgccaggaaatacctgtttctatgctaaccttgactgccaggaaacatctcattccaggttctcagtacaggacattctcctctttgtcaaatcagtttcttgcctttataaacttaattttacctgctctggtttacatgtattttcctcataagtctcccatctttgcctcattgtttttttttttttaaatctgcagggtgccatgaaaaatgccggaatgtcctacaatagaagtgttttgttcaggtgtcacagagtactagtagctgtgtggtgaaattaataacaaactgatctacttcttaggtcattttgacctttgagtgaattaaaacataattcacatagaacagtctctggcacataagcgtttactgccagtcttgtcagagtttgacaattttaaaagttttttttttttttccagggggccagattttgattttcttgatcctcactattgcttctttattttctattaaggcacgctcttttctttattatttttaaagtttgagatgaactactggctctaattttctaaaattatactgaaggctataacttttcctccaagtattgctttagcagcatcctatatacttgaatatgtagtgaattcattattgcttgcttctaaactttcagcgatttcagttaggacctattctctgatccttgagttatttcaaaatatgtttttaagtttccaagtgtatgggtttgtagtgggctttttattaatttatgattttggtgcaaattagttaaggaatatggcctatcaattagttggtatttgttaaaacttgttttgtggccaagaatgtggctaatttttgtattgtgcatgcaaagaatgtgtattaggtgtggagttttacatataatgaatggattaatcttattagtcatcattttcaaatatccagtttttattgagtatacacggacacaaagaaaggaacaatagacaccagagcctacttgagggtggagttcagatgaaaggagtgtaaggactgaaaaacaactatctttactatgctgtttacctgggtgacaaaattatctgtacaccaaaaccctgcaacatgcagtttacccacataacaaacctgcacatgtacctctgaacctaaaataaaaattggaaagaaaaaaaaattgtttttaataaatttttgtttgcttgacatcattttataaaaatatgtgtcacaatatcccattattgtagattgtaaatttgtcgatgttattgtataagttcctaggctttgcattatgtctgtttaggagctgtgttaagtgcatataggtttatgattattatgtgttcccagtgaattgtttcttttgtcactgtgcagtaaacccaataatgcttttgtgccttaaacaatactttgatattaatgttactacaaacaattttttcttttttttttttttttgagacggagtctcactctgctgcccaggctggagtgcagtggaactatctcggctcactgcaagctccacctcccaggttcatgccattctcctgcttcagcctccagagtagctgggactacaggcgcccgccaccacgcctggctaatttttttgtatttttttagtagagacagggtttcaccatgttaaccaggatggtctcaatctcctgacctcgtgatccacccacctcggcctcccaaagtgctgggattacaggcatgagccactgcgcctggcctaattttttcttttagtatttgttagcatatattttcaattaatttcatttcaaattttgtgccattatatttagacatgatctttgtaaatagcacatccgtgtattttaaaaattcaatctgaaaattgctattgactaacagataaatccaatccactaaaacatattactgatatattcagtttttgccaacttaatttgagtatttatttaatattatttttattgctatatattattaccacttatgatgcctttactttgcttcattttgtctacttctctgctgtctactgaactgcaatctactgagctgtctgaatgttatttatccaactctttttttccagactcttctgttagaggttatattctatttcttttcttttacaggttacccttaaattttcaatatacattctgacttaacgcctaaagttttttaaggcctagtatcttctcaaataacacaagaagcataaaattctttagtactgaccatcatcaccatctcttgtttcatattttaaatgaccccaaattagtcattttattatcaatgcttttcttcagtcaacacttacttataattatgcctatgtttttgcctattccctttctcactagcaattattgtattacattattttcttctggggtcaattgccttcctcctaaagtatatatacctttagttctttcagtaagagtttatgtaacctcttcagtaacctcttaaatctttatcagagagtatctttgcccttcactctcaaacagaattctaagttgactattttacctcattgtttagaagatattattcaattgccttctggcttccattgttgctaatgaagtttgcaattagaaattgttcctttgcagagaatctttttttcttctttggtcactttttatctttggtattctgcagatcattgtaacataatttgtatttatactgttcatgatttggagtgctgcttttatctaggcatttatatctttaaaaaaattttggaaaaggtctagctattatcatttccagtgtttcttctccctcacttcctctacgcttttcttatagactaccctacttgttcttcaaaactcttaataatatcttttaacaatatttcttaatatttcaatatcttaatattttctcttaatatctgttttatattttctatctttgtgtctctctgagctctttcctgagtaatttcagagctatcttcctgttcaacaattctctcttcagctgtacctaatatgtttttaaatcatttattgtattattaatttaaataatgttaatttctagaaattctacttttccaaatttgcttgtttttcccctacaattccttctttataattctcttctttttattattctaataatttcaaacatagatttttaaatagttacttttacattgtgttttattacgtgaagattctgaaggagctaaccccagtgtgtgagtctggggttaactcttcccgatggcaaattagttccttatgatctgcaattttatgttgtaggttgagattttctttttcccatcggcatcctgtatattctggtgtggagattgtcctttataatgggtttgcatgtatttctctaggagctctagtggttttactgatctgggacctatctttaagtttatttctaggtttagaatttctgtaacgtgtaagtagtgtaaattcaatgtggttcaaagtctaggcagaccacaagctacttgccacattccttgaccattaggtaaaattttcttagtccccattttcacagagagggcagtcctcccaggtctcagccttaagtagaatcctttctgtattgtgcaggcccaaagtacacttgctgtcctgggatggagataaaagcctttgccactagccctgaggtggcccgtgctgggtctgacgctgccccctcaaacctcagggtgccatgacattggcttgctcactcgtcactgcctttgagagtggtttgttcatttttgtacctagaaatttctctaaccttcaagtccagtcatatatttagaaaaataaacattttccccagtaatattttattttctatatgtttggattgaggagaatggaggggtccagggtcaactcagatcgtccttctgccggatattgaaccttctagcccctttcttcaatatttattttcttctgagacagaaaccagcccccagccaatcactgcttcagactacacaaggttatgagaaagaaatcccaatagtgaattacagagcttcagcatgtgtaaaaacaatagcatatttactatgtgccagaaactgttttaagcactttagccatactaagatatctggttcctatgacagccctgtgaggtaggtattattatccattttacagttatggatactgaggaacagagaagttaaacacacctactgcgtgcttaataacatgtaaaccacagcagaaagaaaaaagaaaaggaagagatttccacttcccctggaatctgggatgatagaggacttcatgtgtgatggttttgcaacttttacctgccactggggccttaacactatgttatcctgcctaagatgatacttgtgatatcttttttttttttttttacaacactgtgttgtatgaatgtgtaatttaatttccttaaaagctttccaagtctagcatcacacaggagtgagctcactgaatcactggtgttgttactaatgtccccagcagacattaacacaaacggagtcctgcgctgaaagcacattttcaggcatttttggatatcctgccaccacagaatacactgagaggcagtaatttttgaagataaaatgttcaacaactgcgtcttttgaccttctgggattcctatcataggttttgatcaacttagtctgaattccatggggctaaactgtatgtgagaaaatgtgaaatcctgatatccctttgaagagtatgacctggtttatgtgcacatttatttcaatatgacatttaacagaagagggcctgtggcccgggtgtgctgaggaaaccccgctcctgagactctcaccttgagcacatccctctggcacacagaggggcaccggcttgcattttaaggcatcttatgcaaatgtttttatcaacatggaaagtgaactgtgtgttttccttcctctcaatcctggaactgtaggttacgtttagtaaatattttgactggtgaggctgtaaacaactgtctccattctgaggcagaaaagcaaacatatccatgttgaatcaacaaagcggatgggatgtctcatgtcttgtcccatagcatcctgacaggaatccatccggggaaacgagcagccagaaacatttgtgagaaggatccacacacatgctagcccacttacacaccggttgggaatgagggattgtagccagtatgagagatgggagaatcgtgctattaatgagcaaggccaaaactcgaccaggcctctgcggggaagggctgggtggataagtgggtaactctgagctcagagaaactctgcaactcatctccaggccactcactgtgattgctggagaaaggagcaaggatcccacgatgtggcaggcacacccaggaggcagctgttctaacagtggaagaagtaagtgccacaaatcattctctaaaattggttcatttgcggacatctctaaggggatgagcgataatccaaataactgagcttaaggcctttacatgacaaaatatgttttattctaagtgtaaatattttggatggagttcctgctctggggtataacacacttccacaccttctacaaagagagaactgaaaagtctctggagcttgatggggaagttaggatcatcacagtgaacagcaatgatgagcccatgctctgctccggggaccactccggggcctaacgagaaattagagggaggtttgaggcaaccttgtgtaaactagtggccttctgtccacttttgcaatttgcatttgggtggccacctgtcccctgcactgtgaccaaaatctgtctctgagagctcctttcctgcatctaaatgtccataggccatgaaatcagatgatcaaggtggttagaattatgtttaaagcaggagacactaggctgtgaggacatcaagtggggttcctccactgaagtaagtaagagcataaacgcagggacagtggcctcagcatgggtagcttaggggtctttggggctcctgctgggtttgaggatgttcagaggcagaggagggcagatgtgttgtgctgcagctctgacgctgggagcagaaggaccaatgccacctgcagcacataacctgagattccatcctccgatcgttcacttctgactatgccactacactccacagcatgtgctctgacatccaagcccacctacacccaattcctttaagtagaatgtatgcaactctgtaaaataaagcagggagatgtagcaaatgctctgtaggtatggaaacagtcaaacaaacaaagaaagcaatcttgtagataaaaatgcagggtgctttccaagatgttaacttggaagagaagaaactgcccaattccgtggtctgacactcagctctctctctctcatgctaacccccttcagagggcaggtgtgcagacatctaagatttaagacaaaaaaaccacagttgacttagcctctccactaaacctggccacatggccctcccaccaaaggaatcagggagccctgggacctgtgttgtaggcaaagatctgcattcatggcatgaggctttgaatcaacccaggaccaggagaggaggctcctgcattccctgacgtggtatctctggccacaataccctcgcagatgccccatgatgaatgtcatgggaggctccataggaaatgcggacacgaggacagtgagggaggtgatcctggcctgctcttcccctgcctttgccccattctgagactggggctgtcccaggagggaggttctaagggacgctcaaaccacttgcaaccaggctgcactgccagtctttccccaccaagccatcgtaagccactgtcccgccctctcccactcagcagctagtcttgctcttgtcctccctgtacgtccagttggactgcccaaagccctgactcccccttactgcctcccgcccatcttctggtcttagccagccctaccccaatcctcttccctcacttgtcccctaggggtacctgggctccccaagagcctctgcccacctcagcccagggtctgctgttccttcatgggtgccgtgctataaacatacttatactgacaaagaaaccagaaatctcttcccctgggcccatcctcactggcactgcccacggtgcccagctctgaagcaatgggtctaccacagcattagctgagacccccacttccacatgaagaaggagccttccctggagggagcaggtcactgagctctaggctcaggcacatctgagttccaatcctggttctgtcactcaggtggctgtgtgaccttgagatggtcaccttccttgagtttcctctcccgatggaagaagatggataataaagcctatctcatagaggggttggggaaatcagaataatatacatagagcactgctgaacacatagtgcatgctcagtaagtggtagccatagctgctgagagtatttttgctgttgtttgcctgaggggcaggagaagcctctgcatccccttcagcccaagctcaggcagctcctgaggcttgttccttatcctcactcatcaggcctctttctgggacatcagatcctgaatctgtgggggtcacgcaggcagacaggggtactggggctgaaaccctctgacctggcactgggggattggagtctatgatgcatagacatccatctctgataaacttagaatatgattcagacccagatgcatgaacttgctgcttccagagaagccctgctacattttcccccttgctctttaaatggcaagcataatagaacacggttatacaactaaaaagaaaaatgttttctaagtaggagatgctctcaagaaagaccagatttaggtgaaggtttacagaaaggaaattcgcatgaaagattttatctagaaggtgcttctgctgaacgcatactaagtggtcagaagggtttctgaaggcccagctctgtgcactgggcttgtctgtgacttgcggggtctgtctccatgcatggcacccagcctacacactggtggcactgaggggcagctggagagagggaagcctctgctatcccataatattctttagcacccccccaataaatacatactgggagttggagcagtgggtgtactgtgcaaatgagacttccagataaatcctcaggtgcctcaccgcacggtgactgcctctccaagctcttctccttagagcttccagagctgctgttggggctaatcccacattctctcatctctgtcttcagtgaaataatgtttgagaaagtttcctctccccaagactcattattcatggtcttgcttactaagaattgcaacacagaggtggatagaagccaggattattattacagactctatacatctatacattattgatacgtctatacatttaaagttatcctttaaaaaataatagatcagccaggcatgatgtctcacacctgtaatcccagcactttgggaggctgaggcaggcagatcacgagaggctgggagttcgagatcagcctggctaacatggtgaaacccagtctctactaaatatacaaaattaactgggcatggtggcacacacctgcaatctcagctattcgggaggctgaggcgggagaatcacctgaacctgggaggtggaggttgcagtgagccaggattgcaccaccacactccagcctaggtgacagagtgagactcagtctccaaaaaaaaaaaaaggatcatgccttttaagccctttccaactttccagagtacttttcagttctcataagtgaccatattctcccctccctacatattcaatccacaccaactcactcactttttattgagcacctgctggggcctgtcttctgtgaggtctgttttagcagaactagagatgggagtaggaacagacacagacccttgtcctcagggaggctcttgggaatcaatgcctggaatcccaaaggccaccatgttttcatcagcaacaaattacacacacacacacacacacacacacattgcactcgcaggtaattttctaaatatgtaacaacggatatagcatgagcagtgaccaatcagaatgaatccaagtcatatatgcccagttcgaccacacagttgcagactgagtgaataacaattcttctcatgaccatgtttcaaaaactacacacaggagatctgcaaagcagctttcacgccatccctgtctaatgtcctgggatggctggtttagctcaaatctctggagggatctgaccatttgaacagagccctctcatggctacacacatcactgggtcctggaagtgcctgggagatgtggtaggattcccctagtaagtaacacaaggggaatacacacacacacacacacacacacacacacacacacacacacacacagagtgtgtgagtgtggatctaagcaaaagtcagacatctatgaatctgtgatccgggctctgagggtggcgcgtctagtatcagcttgcacaaattggaattaccaactgcttccccaaatccaaacccaagaatcaacctcctaggttgcagttcagctgaaatgtgctgttcataacagtgacaactcatatttgcttcagtgaagcacactcttacatgattttcaattccttctgtgactgagcacaggctcaactgattaatcctgtgctggggatttggggcctctgacatgctgccaaggccatgccacccaagcctctctctcatccctttgaagtccttgaggcagcaatgatctctacccatctctacctccgacagtacacattttagctttattatgagatcctggaaaggtagagcctaaatcctgccatgtcatattttgcttgacattcatttattcgatcaaccaatatgtatttaatggcccgctctgagcactctcatctttaccactagaccagacgggctgcaaaccatgccgcatatttcctttttatcacctctcatgggccaggaaaaggctggggatgtatagggcgcttcataaacacttagagcattgaatcaatatttgctctgctacaggagtagagcaggagttctaagagcatgtcctgggccccatttcaagttgaaggcttacgttgagtctttttattgcctgggcctggctcaccatcctcctcttccctgaagtctttacactttcatttctgtgaactcatctgatccttgagtgtccctggaagagaaactgagctttcattttgcagacaaagaaagtagttagctgatttgtccctggttttgtatgccaacgacccttagcattgagactggagctcatgcttactgaactctgaacttgggcctgtcaccctgcctgactctgcctttgaacaaaaggtaatgagatctaaggtatcggttcaattccttcctcagaaggaacgcctcatcatcctttcttcacagaatgccccacaacacaaagctttggtttccatgggtcctgttagaccagatatgcctggaactttacctcggcaacaataagacccagcctcctgactctaggggtgtcatgtcatcttgggggtacaaaaatcaacacacatacccacaaaataatgaaggtgttaattttccaagcttgcactctcaggctattttacaaaatagtcatgtcaaaaaaaattaaactgattaacatattaacctttgagaatgtaaaagctgataaaatagccaaacctatttccaaaaaagatttcctatgactaattctacctctaacctttctggatagagtagatgatcatataataatttagcacaattaaattctccaaaggaaattgcccagaagagaacaaactggacacacagtgggaagccattcagttttcaacactcttgtaaagcacagaaactgacaagactcctgtttgcttcatgaaaaaaaaaaaagtcatctgctttaacttttgaatttgcttgacatctggaggaaggggagataaaagggagactctaagtgccgtgcaattttagccagttgcagatggaacatggctatcactcatggtgggaaatgtgcttctggggaagatgaaaagagagggcagatcacaaggtggccatagagatgactccagcctgagcctgagtgtgctaaagagtgaggtacagcagacggctggggaaaggaagacatcttccaaccaaaaccatgtgagagaaaatgcagagcaatttgttatatgccttacaattttaagaaaaaaaaaaaataaaaagcaaaagcaaactttcctttgctggggattggagcacaaaattggtcatgtttgaaggatggaagagttcttcattttcactgtgtcttgtaccaaatatcgtaatcagctcaggcactgagtttctaggagtctgtccctctggaaggagaacagtgcagtccatgagaaagtcctgtttgttaggcagacaatactcaaaactggaggaaggaggaacaggtataaactgaggtcattcaaggaggcaccatggatgacatgggatctatttttaggtaagtcagcagatgagacaattatttaaagggcacctttgaagactatggtaggcagaattctaaaaatgcctcctcaccacccaatattccatgccgtaacccctgggaccaatgaatatgatgaagtaccattcatgtgattatgttctattttgttacatggcactgttatgggttgaattgggtccttcaaaaaggtatgttgaagtcctaacttccagtgcctgtgaataggactttatttggaaataaggtctttgcagatataatcaagtaaagatgaggccattggtgtgggccctaatccaacatgattactgtccttataagaagtgataagtttggacacagacaccacagagaggagaacgcagacacacagggaagagaccatgtgaagacagaggcagagatgggaatgatgctgccataaggcaagggacacctggggcttccagaagctggaaggggcaggaaggcctcctttcttagaggctttggagggagcacagccctgaggacactttgattttagaccactagcctccagaactgtgagagaataagtcattcccaatgctttaagccacccattttgtggtactttgttacagcagccctaggagactaacacaggcacgggtgatgcaaagacagaaaggttatccaggtaggactgatagaatgacacaagcccttcaagcagagagctttgtctggctggtggcagaggagaagtcaaagggaatcaaatcctgacaaggatctaacatgccactgccaatttgaagatggagagccacacgggaagggaagaatgcaggtgacttttaggagcagagagcatcccctagctaatagtcggcaaagaaagcaggtgatatggtttggatctgtgtccccacgaaatctcctgtggaattgcaatccccagtgttggaggtggggcctggtgggaggcaattggatcatgggggcagagttctcatgaatgggttagcaccaactccccagtgctgttcatgtgaaatgagtgagttatcatgaggtccagttgttttaaaagcgtgtagcaccttctccctccctctcttcctcccactctggccatgtgagacgtgcctgcttttcctatgccttctgccatgactgcaagtttccttctcctcagaagcagaagccactatgcttcctgtagagcctgcagaaccatgagccaattaaacctcttttctttataaattactcagtctcaggtatttctttatagcactgtgagagtagcctaatacagcaaggatctcagttctactctcacacagcactgaattctttcgattgattttaactttgtaagtccctaagcagagaacctcattaagccctcatgaggactcctaatctccagaaactttaagacaataaatttgtgttaagttgctatgtttgtggtaatttgttacagcagcaatagaaaacttatacagagactgaggaggttcactgtatcaatgtaaagtcatttgcttactcgctcattagcagaaagggctggtaatttacgacaaaattagagactttccagagagatatagaaatgatcacagatcatgcttactcccagattccaagggaaagaacccacaaagttgcactagaagcaaagatgagttggttagaaacggagatatgatggtaaatgttaaacaaccagcactccaggaagagggaaaaataaatttaaaaccttgattagtagaatttgacaatttccatgtgtgattgctcctaacatggccagtatcaaacaagcggctcacaaaattcctgcaaatttaacaataagctcgcataagccagtgtgcactggctccggcacaccaccgggatcataaagcaaatggaggaagttgtcttgagggaattcagacaggcttggtgtaaaagagacaaggagactcagcctcaaatgcatccaccttcccatgaaagaggtcagtggctctggctctccaggccctgtggtagaccttcttctcttcagattctaccttcttgccccagacaattttagccacttatggcttcttttgccatccacatgctgatgactcccaaatctccatattcagcccagttccctgtgatgcattccagcccaacatagccaacagcctatgtgctctctcctctcccattggcacatctaacttaacacgtctaaaccagagtccatcattgtattagtccattctcacactgctatgaagaactgccagagactggataaattataaaggaaagaggtttaattgactcatagtttcccagggctggggaggcctcaggtaacttacgatcatggcagaaggggaagaaaacatgtccttcttcacaatggtgggaggaatgagaagaatgagagccgagcaaagggggaaaccccttataaaaccatcggatctcgtgagaacttactatcacaagaatatcatgggggaaactgcccccatgattcaattacttcccatcgggtccctcctaccacacgtggggattatgggaactacaattcaagatgagatttgggtgggaacacagccaaaccgtatcaatcatttacccccaaaagacctggtcctccccccgaaactccctgtattagtgtttagtgcctctgtccaggtgaaaaaggcaggaatctaggaagtatccctgaagctcctttttcactttccatatccagtaagtcaccatatctgatcaaaacgctcctcaaacatagggaaaaataggtagaatccatctatttctcctatgcctaccattgtactattccaaaccacaagtgttgctcttctaggttattatagtagtttcctaactcagcctccataatccccattttttacaacagaataatcctttaaaactataaacctcatcaagtcacaaccctgattacaacctattgatgcttaccactgcttttaggatcaactcaacattcttcactgggactctgagcgacctagtcactgcctacctctactgcattaccttgtcccatgtatcccctcactccctaacccatgctggctcttctcagctcccagagctctcgtcttcctcccactcctatcctgggctctctttttctagataacttttactcagctaccagctcttggccttcatgccacttcctcagggaagccttcctgatttccccagactagtcaggtgcccacagccctctgttcttttccttcatagctcttatcacaattgcaatcaaataattactggtacaattatttgtttaatgcctgctctccccctgtgaatatgaactcgagtagggtcaggactcctgtaagagactggtcattgttgtattttcacagttcagatgttgtctttatgcagagatgcagaatatattttttaagtaacaataaagaaaaaatatagtgctaagtgaaaaacctcaggtcatagaatagattgtacaggaagatttcaatttgtacaaacaacataaatgcattaacagagaataggctggatataaatcagaataataacaaagactatttctaggtggtggtattacaagtaatttttgccttcctctctctctctatttatatattcaattttttctaaaaaggacaagttttgtttttataaccagaaaaaaactataaaaggtattatttttaaacatagcagaacaggcattgtgtctgaggttaaagaacagaggaggttcctgtccttctccattctccagtcatcagcaagtcactgaataaatgagcaccctcaaagcacatctgtggcagcagcaggtttcacaggcagatgtctgtgtcccagaaggtgcctgccccagtaggtgccgaagacaagattctcttcctaaagtctgattagcccagaagacaaacagtaagagaagaaaagcccatccttacaagtccttcttaatcaaagcccaggagatattctgagccattagacaggatttttatttccactgggatgaagatattttggaataaattctctgtcttattccttagaatgaattctttaaaagaagggatgcattccctacagctgcccaattttttcacaagtggatgagaaactgcaactctatcacctacgtgataaattaaggttcctactagcagatgaagcaacggaaggttgtttataacgttactgctcctgaggcctggaatcacagcatcagggttacatatcaacatctggcagaaacaaatcagttgcaagataaaatccaatcaactacacttcttctcaatccccatcaaaaatacccatcctacttgcttctgaatatattcttcaagtaggtttatttaaggaaagacaactatagaatcccagacagtgggcaagtaggctgcctgccaatgctggcaaggtgggagtctcttttggagctggggaaggaccttcaccttcaggaagtcttcattgaatggaaaatcatcagagctgtcacccaaacccacctcttacagaaaatgctggtaattgttttgtaaaaaaataacgactgtcaattcatttgattgtccagggatttgtgacatggcagaaatatgctcttacctcgttaggaagttttagtccatgtgtttccctaactctagctaacacaggatccgttggagccaaaggcaggggatttgtttgacaagctgaggaccttgtgccaggatagcagcgaatgcacagcaggataatattaagccattattagcttcccaaccattcacacagatgagttgattctatcaacttgtcactctgaaaagtcaacagctccactcgagaggaatgagaaaggggacagatttggtctgatgagcagggaggaaacagaagaaagattggaagctcaagtgggtagacaagacaagcaggacgaataaaaattctgggtttttccacttattcatatggttcatataaccgctacacagtcttaagctccatttgctcacctctgtaacgggggaataatttgcccagcattgttatgagagcagatgtgacacaaagtatttcatgaatttgagggttaaggcagggcacaaacaaaagtgagaattaggttgaaaacaaagttgtctaagcatccatcttggctctcagtgctcagatcagtgcctggcaaaagtgaggtcattcaataaatatttgttggataaatatttgttggaggaatgactggctggctgaatgaattaacaaacagcacgtatttctgaaagattcacctgaaataaattagactgggcctttaaaaagcaggcaataggccaggcgcggtggctcaggcctgtaatcctaccactttgggaggccaaggtggattacctgaggtcaggagttccagaccagcctggccaacatggcaaaaccccatctctactaaaactacaaaaattcgctgggcatggtggcacatgcctgtaatcccagctgcttgggaggctaaggcaggagaatcgcttgaacccaggaggcagagattgcagtgagccgagatcacgccactgcccttcagcctgggtgacagtgagactctgtctcaaaaaataaaataaataaaataaaataaaaagcaggcaatataaatattagtttagtttaattttttaaataaaaatgaacagaacaatgcagcatgctgtaccagctcttgataatctccccaagcaggctgaaagtgtttgagccccttgggtcctttctgcagacggatcagaaagatgctttggaactagctcagaaactaccttcgccatttccagagtctactgctcttttttgaaagtaactacgtacagtcggccctctggatctgcgggttccacatctacagattcaaacaacggagacttgaaagcattttttttttttttttttgatactgagtctcgctctgtcgccaggctggagtgcagtggcatgatctcagctcactgcaacctccacctcctgggttcaagagactctcctgcctcagcctcccaagtagctgggattacaggcgcccgacaccatgcccggctaatttttgtatttttagtagagatggggtttcgctatgttggccaggatggtctcaatatcctgacctcatgatccgccctcctcggcctcctaaagtgctggggttacaggcatgagccactgcgcctggctgaaagcattaaaaaaataataataataaaataaaataaaaaataacataaccataaaaagtagaattttttaaaaatacagtataacaactatttatacagcacactgtgtgaggtattacagtcacagattgcttaatgatgggatctgttctgagaaatgcatcattgggtattttgccggatgtcatcattgtgcaaaattgtattatgaaagggaacagcaatgaatttttcttttagctacactggtccctggttgcatgagtgtgggccctctaattatgttactaagtctctttgcacctcactttcctcatctgttaaatggggattagaatagcaccaccccctcaaagtgatgaaaattaaattgcaggtaggattggtgcctggcactcagcaagcatgcagtgaatgttagctaactgttattaactattattctgccatggggatgggtgggaatcatcttaaattgcaaggattctaaaatagccctttcctttgaggtcaggtctcatgtgtcaaatgcttggctttctatcttgaaggtctgagctacctttgggagggtcaactatggataagctaagtactccccagcatattttgcagtaggtttgtttacaccagcattgccacaaacacgtgaataaggattatgctgtgatgtgatgacagctatgacatcactatgtgacaggaatttttcaggttcagtgtaatcgtacaggacttccactgtacatgcggtctgttgtcaactgaaacatcattatgcagcacatgactaagtaatccagagatcatttaaagtgtatggaagaacgtgtgtaggttatatgcaaaaacgacaccactttgtagaagggacttgagcatctgaggattttagtatctgtggaagtcctgaaaccacatgagtgagaagcaaatagctttaaaatagcattaacagtataatctgtttaatgcaaactgctaggatgtattttgcccagatcctgtttaagcaaggcttgatattttacatgctccttagagtctgtcttgttgggcctttcatcttactcttatataaggtaagtgctgatcttgttaatcatcttactcatatataaggtaagtgttaatcttgtaatccttccttgtttctcaaggaaggaaagcatacctctagaagcacattaaaggacttgctattggtttactctgtaaaccaggaacctgacatagttgctggtttctgagtaaccacagcagtacaacaaatgaaaggaaataaatctagttttgattttcaaaatgcaggcctattccagccaccccatcactttcccatccctgtgtttaagcctccttcagaccacagcagagctgccctgctacactgggtgagcccttctcctgcagttttgccctggctacagagctgcaacccccacacctcatctcctctgggctctggattctcaagagacagaaacctcctcttttttacaacacagcaaagacctggccaaccttctccgtctcctctttttcatggcctgtccagatttttgcttttctaatttcctcttctgattctttatcagagaggagcctttgtggtccagggcctgcctcctccttgctcatttcagccagcacccagaataccctcacagagaagcaaatcactcagcaagcaccaatttatcccaagaaaaccttttaaggggttgagaccaatgagtgttcactctcgctatttaaatggttattgctctcagcccaggagtatggctgttggagctttcacttgttttctcctggaaatgattcatttcataacaacagagtccttcagcgaaggactgcaatagcttctgggttgctaaacactctgaatgtttcattatggataatgggcctaacacgataacatatgtaagcaaccaggaaaggagaacagatacaaagacagccatgaagctgggcaggcagtgtgacagctctgtctctcctgctgccctgggcagtgcccactgacccagagccttgaccctgaaatgcttgctctgaaccttggcaggaacctcagaagtcatgcacgtgttcactgaccacagagctctagggacaaacatctggtttccgatatggagtgtaggcaaaagatctggtccactcactcatacttcataatcataaccaatgatttagtgcccactgtatgctaggccctgtgccaaggtatttagtacgttatatcctttaatcctcagaataaccctatgaggaaggcaccagcattatccccattttacagttgaaagaactgaggcatagtgtgattaactaatttgtctaaggtcacagagttaagtggcatggccagacaatggaacctcgttgccttaccctcaatgctgtgaaacaatagacaacagcccacagcaacaccctctacacagtggttctgggcaaaacaccttgttggcatcatatattaacaaatccactgacccccaaaagaccatgtggtaagttaaatgagctcctgcttatttctatataaaaaattacctttcaaaccccaaggactgtgcatggatattcccaggttgggctaaagctcatgttgtccaggtggtaccttcctgtcagctctccacgattcatttatgagtctggagtttgctactggacctacccaacaatgttcccagccttccctgagaacagaccatgcaagctttcaggaagatcaatttttccagcagaaggagaaaccacaaacttagctccctacccagattttatctcccactccaagagaactgggggaaaacaaaacattttaaaggcaaacaggaacaaaatgtagtgtaaatgttactgagagcgctctcttcatggagccccagggagtcctttctggaagacaggagctttgcgatcctgtcctctgcctctaccggtgagtcagcaaaatggatctgagcgcaaggctagagccacagccgtgtcccactcgataaggtttccgctggttctctcctctgacgtcaaaacccatctgtgagatggggacatgaaagccagctctcgctcaaaaagggtttctgtatagctctcgggctggcccctgtttcagaagccattcttacagtgattttgtagcaactgatgtttctcttgcttggtcatctctcacctccagctcaaggagtttttgcgagctcagtttctgggcctgagatgagatgtatcccctctgagttccatcaaggccacaggccatgccttcaagggcaccccaagcacagccagaccagctgtgggccaggctcctctgggtccctcaacctaagctggcatctctctgtggcacaagtggtctgccatgggcctgggtccctggttaggacatgatcagcaccctgagatactcaggatcattcagcgatggagttgcatgtgctcttcttctttccagccagaccttaaggacaaagaaccaggcttctggatttgcgctgttccctcttctcctccccagtagccagcaacatcataccaatcctgtcaaccacgatccttaccatacccacagcctcttctaaggaaaactgtcttgaccgcagacccaactgaataagtagctccaggcagccatattttgtaccccacaacttgctgtgaccacgtctaactggagcaaggggcacacgtgacccaaaggctgcaactccaaagactctcccgtgacacatcctaagaggtgagcagagccagctggacagaactttttgaaaatttacactgaaaaaatgattaatttttcaagtgattaatcagtttgccccaataaaagtgagacttggaggaagcttcaaaatgaggtatgccaggaaccagagggatccaagccaagctgagttaggaggaggcagaagccaggagtattcagaggctgagaggcagaggaaagagacagggcagcagggatgcagccagctgacatggccatggtgggtggagcaggcagaagggggccagaagtgaagacagagctgagcgtcattcaaggtggagtgatggagtggcgggtgagcaaccacagctgcatggtgggagccaaatgctttggaccagttccagtttcatggctccaccatgtttgtagtgttcagcattctgcaaggtccttgctcccttattgcccctcatgtaacccacagtaccctccttctacatccttcactgaggaagattctacaggacatgcatgcaggcccacactgggcaaggccattcctccctcctccaaagcccaaagcccacgcatcaccctgcctcgccacagcgtcactctttccctggggctgtaggcggcagaccgtgcttctcacctgtgtcctacccacctctctctctgccacatgtagtccaacacacagttcagactcgatactgatcatacaaatctccccacagctcactggattctcttcaagaccctcaataggtgctgcagattcccaaatgacacagtgagcaaacaactatgatctgtgatcttacttagagggcttggatctcaaatagattggagatttggagttgaaaatcagctactgtccagtgaatttttccagtttgttttttaacaagagatttgacatagaataatgtgggtaattctttaaagaattttacacattagacttttatagtacatgtccttcaattatactgctacatatcccaagcagtattttaggcacttgaatgtgtttttcaatctcttttcactctgcatcataaattatgtagtatattctgtaataagataaatgtgtaccttcacacatatgtatatacccagatacctgtacactcagaaggaagagcaatggcttatgcatatgatgctgcagtagccttagttgccaacagggaggtaggactgggtggaaaggtgatgcccagagactggataagattttcttcctttttttttttgagacagttttgctctctctcgcccaggctggagtgcagtggcgtgatcttggctcactgcaacctccactttccaggttcaagcgattctcatgccttagcctcttgagtagctgggactacaggcatgagctaccatgcctggctaatttttatattacttttagtagagatggggtttccccatgttggccaggctggtcgtgaactcctgacctcaaatgatcagcccgcctcagcctcccaatgtgctgggattacaggcatgagccactgtgcccggcctggataagattttctagtatctcacagacctcctccagagagctgcgcctttgctaatcctcttctgtaacaggcattttgctttgatgacgcctaactccaaactataagcatggaatatcttggtatacttatattcacatcatatatgttccaatagggcagaattgtttctttttacaaatatgcatattattaattgctatatgaggagaaacgttgaattgtattctttggtcacagagaagaatggttaccactaggacaagcaggaatacatgaaattcacaccgacacagtgggtaagagcagagaccccagcagcagtatacactatgaactgcagtgtgtcctgtgcccatccatgtgttcagcagggcagagcagcagccagtggggctggaagaggaactgcatgaagtggattcttcctatagaattcttccaattccaattctatggaattggatgctattaaacctgtcttcagccatccacatggacagacggcaaggacaaaggcttctaaacatcctgactattggtcagcagtgactgggaatggatcacttctttttcagtggtaagtacacgagatttaaacccaacatgaggcctggtacaaaggagtggggatagaggtgggagtagaatctgtacattgcgacaaacagaacattatcctgaagggtcctctctgagaatgatctactttagaattcagaagaaaacgtaagagaacttcggcacctcaagagaattaaataaactgtcggggccgggcgcggtggctcatgcctgtaatcccagaactttgggaggccaaggccggtggatcacgaggtcaggagatcgagaccatcctggctaacacggtgaaaccccgtctctactaaaaatacaaaaaaattagccaggcgtagtggtgggcgcctgtagtcccagctactcgagaggctgaggcaggagaatggcgtgaatccgggaagcggagcttgcaatgagccgagatcgagccactgcgttccagcctgagctaaagagcaagactccgtctcaatgataataataataataataataataataataataataataataaaccgttggttcagggagaacaggaggaatctctagagaagaggaacagatgaagaaacaagagggtgaatcaaaggctcgagagaagaggataaaggaaaaacatgaggaaatgagaagtgaggtgacttagaaaaaggagtgcaagaggtggaaaatgcatttgcataattagcatccacataggaaccagtaaagagcagaactgaaatgatacaaaactcagtcaatgacatgttggacaaactttagaagctgtcccagagtgcagagaagaaaaggagcagatgtgcagggcaggcaatagagtttccactacacacagacaatttcagaagacaaggctagaacaaataatcaagacaaagacatagttgtgggaaatgttcctaaagactgaagcatagattaaaagcattcatcatgttccagaagaaaaaatggtaagaaatcgatactacacttacccaaataaacatttggataatgaagacaaaggacaagtggttctagcattttagccagcaaaccacaaaacaatttattttttaaacaaaggaaacaaaccaggcctcccttagacttttattctggaatacaaaatactggaagataatggaccaatgtctacatagttgtaagggaaagtacttttatttaggaagtataataaggaagctcgtctttactatataaaagtaatactttgtattcttggacatgcagtattcaagacaatataacacccatgcattcttcattcaaaaacatcgcttgaaaatgtaacattaatataattaacctaagaaaagaaaattaacatctgaaactataatatagaagaatccccgataagccatgcaaccaaataaataacagataaatctaaataaatgctataatgttggttaataagctgaataaattgtcagcatgttttagaaagaaaagactaacaaaaagtctttcattggttggctccaaattcctaataataatagaaactaagaagtggtacagggctaggcatggtggctcacacctgtaatgccagcactttgggaggctgaggtgggaggatcacttgaggtcaggaggtcagggctggaatgagccatgatcacaccactgcactccagcctgagcaacaaagtgagaaccccatctcttaaaaggaaaggaaaaaaaaaaaaacttccaaaatttttaaaggtaacctatgggagatttaagattagggaatatatgaggcactgagagatgataataaaataacaacagtttatagagtacaatacaggaaacaaagaaaaagaaagcataaattcagaaaacaaaataagctgcaagaagcaattctgatcataacacatattataataactataaataggttaaatcttcctgtgataacataaataattctcagattggctcaacaaatatcacctgctttttttttttaaaaaaaagcaaaacgtacaaaaaatatagattaaatgataaaccagtaaaaattagtatttagaacatagtatgcactcaagaaatatttgttggcaaagtgaatgtcagaaaaaccaaatgacaaaaaagcaaggttggtaataacatcaaagtacttaggagggcaaacaatattcaacaattccgtatattgaaaaaattgagtttcttaactcattttcaaagtgcatcagccaccatatgagaaatgaaatgtaaaaactaaaatctacagctcatgaaaagtaatgcaaaaataaataaataaaaaccttaagtaaagaataccaaatcaaacctagcgctattttttttttgaaagactaacgtgccatgaccaaggaggacttattctaagagttcagtgataatttaccaatatcattttaatgaaccacttaggagcaatccttttacttttagaattaagacaaagaagctcacgtactatgtactaagactttgtttcctggaaggtctagaccctgcagttagacaagaatacaagataatagtcaaaaaacattgaaaagaagaggagaaaattatcatattttctggaaaaaaatctacagttcacaaaattactattagaatttgtaagagatttagtaaggcactgtttacaatataaattaatacaaacacatacacaaaaccagaaaattataatgacaaaaaatccaaaagcaaccaaaaatataaaatgtctataaaatgtgcaaaacacctatgaagaaaatgacagaaatttattgagaaaaacaggagggttgagtaaacggagagactctgtgtccctgaataggaaaattcaggattgtaaagatttaaattttctccatattcccctataacagtaacacaattccaataaattgtgaatgggatttcttttgggaacataacaaaaattattcaaattcactcatgtggaaaacatttctaaaaaaagattcagaaaaggcagtctgaggtgttgacttctctaacattaaagtgcattgtaaaactaaggttaccaaaacaatggggtatggcagcaggaacaggcagatcaaaacaacagactaaaaatctaggaagatacatgtaaatagggtgtcatttcaaggaaaaaaagaaaggatatgtcatttaatttatggtgttggaacaattagttaaccacatggaagataattaaatcaaatctctgcctctctgccttgaggctgggctcctataatcccagcactttgggagactgaggcaagaggatctttggtcccaggaattcgaggctacagtaagccatgattgcaccactgcactccagcctgggagatagagtgagaccctgtctcaaaaaaaaaaaatcggccttatagcaaacattgaactctcaaccgactaaaaaatgtacaaactggccagggtcagtggcacatgtctgtaatcccagcactttgggaggccaaggtgggtggatcacctgaggtcaggagtttgagaccagcctggccaacatggtgaaacctgttctctactaaaaatacaaaaattagctgagcatagtggcaggtgcctatattcccagctactcaggaggctgaggcagaagaattgcttgagcctgggaggtggaggttgcattaagccgagatcatacccatgcattccagcctgggcgacagagtgagactccatctcaaaaaaaaaaaaaaaaaaaaaaaaaatatatatatatatatgcacacacacacacaccacacacacacacacacacacacacacacacaaactgaaagcataataatactaaaagaaaatataaataaacatttacataatttttggctgtatattattagagttctatagagaaatagaactaattgtgtgtgtgtgtgtgtgtgtgtgtagggtgattgagagagagggagaaatagatcttttttaaggaattggctcatgtgattacagaggctggcaagtccaaaatctgcagggtaggctggcaggctaaagtcccagaaaagagttgatgttaccactcaagtccaaaatctgcagggtaggctggcaggctgaagtcccagaaaagagctgatgttaccattcaagtccaaagcagtctactggcagaattatctcttctttgcgggagctaagtcttttttctactaagaccttccactgactgggtgaggtccacccacattatggagggtaatctgctttactcaaagtctagtaatttaaacgtcaatctcatctgaaaagtatcttcacagaaatatctagaataatgtctgaccaaatatttaggcactatggcctagccaagtggacatacaaaattaaccatgccaaattggaaagcactttatatgcatataaacgaatgctgataccataaaggaaaaaagttaaacatttttgactaaataaacattacaaaccttctgtttatcaggcctaccataaacaaaagacaaacgacaaattgggaaaatacttgcaaaatgtttgctgaaaagtcaatgtctttaatatataaaagtgttattttacaaatcaataataagaagaaatacatcaatagaaaaaagacaaggagtagtcaaactacagagaaatcaatacaactggtgaataaacacatgaaaaaaatgttcatcaccaataatcaaagaaaggctaattaaaacaatgaagtaccatttttatactatcaaattagtaaagatgtttagaaatgttagcacccagcaaaggacaggtggggaagggggcagcattatcttcaatttctgggatgtgaattgaataacctttcaaaatggcagtttgacactatagttctaaagatctgaaactctgcatatattctgctctacactccaacaattttactactagactctatgttaaggacaaaattaggagtatatggacaaggatataagaacagagatgctgaatgcttgtttttcttaacccgtgcataggaaaaagcttggttgggagatacatgccaatggtaatggtttttaatgtctggatgataatttaaaaatatttttatgtgctttgctatatttccaaattggctacaatgcaaatttatccattttgtaattgggggaaaaatttaaaatcgttcttaaaaccaaattacaaaggatatttattccctgaccccccatggaatgcattaaattaacaataatctttgtatgtggttagtacttgagtctttcatcaatccagtgaaagaagaaagactattattagcaccactttacaaataaaagtatgagacctgaagggaagaaaaaacttttgtaaaaccaagctctctgttttgaggctcacttgtcaggcagagtacaaggtgctccatgcaaggagggggtcccctcctgcctctgacccttaacattccattgcttgtccttataatctaacattgctcatggtactttccaaaggccaccatttgttctgactgttgtaaaaacacacaacacatttccaccccagggcttctcttctataagctggaatgcgcccctgctttctggatgtacactgactaattgggcactagaagtcacacatatggctggcttcctcccagatgaacacctctcagacagggaccaagtcccttctgttcctatcccagcacctggcaccttgtgaggtgctgagctggcctcaggaagcaggtgctgggttagtgccttgaggctgtcatgccgccaatcaccaacgtgcacgcttctttctgtctgctcgctccaaagcagcaacataaaggaaagccgggatggccacagttgatttcaacacgtcagcctttccgagaagggcaatagcagtaatgatggtgcctgggcccctttggtatttttcatgcaataactacctgtacttttccaaccaggtattatccctccttccccagcaagatgccttttatagagaattttgttgtttagcaagaaccatttctgccctaagaggcacaatcaggaacaagaaatcaaaataagtcatcctaagatcttctaatcggagagcaagggcactgagcctttgaccctgcaagtcacatgcatttcattttgggtctaatgacaatacttaggcaggagatgtaggtgtcaccctagcaaggcgagctacagaagattgagggtaaattttttacatgaaattacttgggataaacaagtagctagagtagaccgtgggcaactctgtattgaaagagtaacaacataaaacagatgcacatgaaaagaacctgcaggtggcaattgcaggtgggtttccgtatttcttttctcaatttttcttctgctttttttcctcttttcttctcctttctcaggaccctcccttctccttccctcattttcttgttttgcaatgtggctgcattgcttatgtacttaaaaccacaggtttggggaagaaggtgtggagtggatgggtggagagctctcagaatttgtcacaggacactggaggaggtgcagtgagcagtagagacggccctgtgcccactccttcccttccatgctgcaggcctcttctcttcatctcgagaaagccactccactcaaccatccagagcacaccacggagggctgtggggagcaccaagatgggaaccccagggctgcccccagagatatttggcgttggggtgggggtgggaggggccagaggagaagcagccagtgatggacagcactttcataggacacaaaggacctgccctggagtgtagcacttcaggaagaaaaaatggtgcattcttccaatggcaaggtgctaagtgtgaaattagggggctggtgggttcctgctgtcagcaagtgtaatctttgcctgagatctgtcagaaggcaggggagggtgaagagtgttcacagaaggggtttttaagagcagggttgcttttatgaaaagtcacatatatcatccagacacaggtatgtgtgtgtattctgcatacatatatttctcactgtgcataatatagaatgatgtagcatttggggcagcacaaagctaggcactgagaaggaggtgtgggctagatgggttctgatgggatggaggggtgggtctgaatcactggaaaagctgatgtggaggaagaaggtggttctggcagcggggactaggcaaatatttctcctgctgcttcctgaagaagcaccatgtaaggaaagatgtgggttcgaagtccctgtgtggattaaactttctgaagtttgtttaaaaactttaaaaagtaactaccttaaagaaatttttttttcatcaagcattcactgttccttcctagggcaagcatgtcctgagcttgctttagcaaaatgaccccagccccactcttagggtgaagctgaccccccatccccagcagcagggggaaaacatgtctccacttaaccttaggtacagcagtctttccttctctatataactggtgttcagggatggtcccaggacccaagctggtccagcaagaggaaacctcagagattcagctgagcagtcgggcaggctgtcacttgcttccctgctgagccctgaatccaatccagcaataatatggaaccagtgatcactagtcttcccagttacagatccttttctcctggcttaaagcactttgggttgcatttttgtcacttgcagttggaaatcctaattcatgaggacttgcaagctcaccaaggcaggagctttgtactgcctgccaccctatcttcagcaccggggagagtgcctggcatctagttggctctcagaaatctttgaggaatcatcaaatgaatgattccaaaatagcaactcctttgtgaacctaatacattttaacagaagaaatgattctcaataaacattatttccttttctattttattgcccattatcctatcaactctttctaaattaactcccagagacgaaccctattaactctttatttggctattaatgtcttgtgagaatttttatttagtttcctctcatggagaggcagagtgagcagccatgacactgcacccatctttaatttctaagtaagaaagccgctagatgttttcaccacaaaggggcttcacaggtcatctgatttgatctcctgcctccaggtagatggatttataaactgcagggttgtcccaagagcactgtgatgcaattgagaagagatgccagaaggcagaattagatgatgtaaagctctctaagtgccaaagatgtggaaacttcaggagacactgtgcaaagcagaataagggtatagatccccaggccctcagagttccccacagtgacatatagctgtggggaaaattatctatgaggagcaagaattctaccaggtgggagaggcttgagtctatgcacatgaaccattccagacaaatagctgtcaagacaggaccaccgatagtgcaattcccttgctgggaattaattcagcatttaatcacactaaaaatcaaaatgattgcttctttgccccctccacttctcttatgctggacttgagcccatgactcctattaaatttcccaagaaaatattaaacagttggtcagcattcttcctttaacgaccctagaagatagtaattacctatgtgccacaatctcttgggcattgggatttaaaaaataaaaaatgcaactcttatcaccttttctcatagcattattttctctcccttaattcatcctgttgtttatttctggaccttctccagctttctcacattctgcctaaattctggaggccaaatcatgatataatgctgatgcagacatctctctgatgtgacttgcagactaaacaattttcagtagcatctttcacatttcctatctcagtggctgccactttttaaattaagctaattgattatccaattgacacgttcttagcatgtgtctgccccagtggcccttcagggctgaggggcttcaacacgggcatccagcattcattctaaaagccccaattatcattaataaagcacacaactcaatgagtccgagatttgaaacgctaagtgcctcgggggcagggatcacatatttcaatgttttctagccctcaagcactgattgggaactgttaatattacttttgtattttaatcagttgggtataattaaggcatcggaaaaagtgtttccacagaatgtgtaagggactgaattgtgcccctgccacccccgagtcccccctaccccacattcatgttaaaatcctaaccccagtgttactatatttggagttagaattctcaaggaggtaattaacgtaaaatgaggtcaggagggcagggctcaaatctgataggactggtgtccttataagaagagacgccagccgtctctctcccggcatgcgtgcagaggaaaggccatgtgaggacacagcaagaaggtagctgtgtgcaagcccaggagagaggcctcaccaatcctcccagtaccttggctcagacttccagcctccaggaccgtgagaaaataaacttccggtgttgaagccacccagtctgcaatactttgtcatggcagcccaagtagactaacacaggacagacataggagaaatctgaatggactggcatccatgcctggagctgcgtgggtgcagagtgggagagaaagggaaaaccagccagcagggaaaaccaccagatagtggatgacatagcaagttacctacttcttctttagagaaagggcatgggtttctgaaccagtcagacctgggcttgaatccaggctgttacgcctattacaaaagtgaaaatcatgtaacatttgtgaatcttggttttttttaatatgtttttatatgtaaagtgaggttgacagcactggtcacttgggtttggtgtgatgattaaatgtggagcctgacacataacaggtactcaataaacagcaactactcctatcattgttgccattcattcattcaacagcagtccagggacctaatatacaatttattatttattatgttacccatttattacaattgtaaatttgaaacacattttaaaataccaagtctgagaggacatttttgtcttagagccgacatcctagtccactgtacagacattaaacaataaataagacaatttcccataataacaattgctgtgaagaagctaaaacaaagtcacaggtgggcagggaagacgggtgtccttgtgacaggaacgtcagtggtggtctctctgggaagttaacatctgggagacaccagatgagacagcagcagtcacaaaagatccgaggggagccgctcagggagaggggacagcacagcatgtgcacaggcccagggtgggagcaggtgtgtcctgcttgaggggcagaaggaggacaggtcagcgtgtctggagcatgggaagctggagagagagatggacgggcttgaacggagacaggcaggcagaggtgagatcacacaagcccttggaggcctgggaagaaattggattttatcctaagcctaatgggagatcactgacaatttaggaagataaatcattttcatgactgtgggttttccaaggtctgacatgataaagggaaaaggctttgtgatgactgaagagtgaagagccagagtcacagcctctggcaatgcaagaagaaaggcgagagcggtgtcaactctgaggagtttgtagggaatacacaccatttgcccgtgtgtcactttgcctcattcaagatgctgtaacttgcagaacagagggctaaaacaacttcgcgcagagaagcctgctgtagacaggggcaccacagaacgtgtgcttcttccaagctgcgtctctttggacccgtacttgcaatactaacaggtgcatagagggccctccagaaatgcaccccccaccccgcccctgggtgggttgtacaatactgcagtgattcaaacgtatagcgctaaagccaggaaaatcacaaccaacagacagcccccatgggcctctgcacacaaaaggcagccatcccgctgcctggcccagctagtgagtgaggccacccactgggcacccactcagatgcactggcagatgttaggtttcaggactgaatttggcctcactgtactcagtcctcctcacagccctttggagtcacctaatcttgctaatatgtctgtaaatgctttagatgaggagtccctgaacagacacatgcaccactaacttcatggatcagaaagtcctctgaaactttacctttttaaccctgttacatggagtcttcccagcagacgggtgccccagcctttccgctgttctggcaaaacaggcccacagtcgatatgtcagtttgatgtctcaagagctaccattaattatgtatccctttggttagaaatgcaaatgacccttggcagtcatttagatctccatgtgaattcgcttatcacgcacattccaccccaaacagagctggccaagccaagcgtgatgcttgatgagggctgggttgtttccccctgcactgcccaagtccatgtctggttagcctgtgcctgacttctacctcacaaggatacacagagttcccactcaaaggcagcttctttgtttcccactgagaaagagctgcttagggagaattagagcaagctaaattaggggcattgaaaccatcctgcccagtggtgttccccagctctggatccatagctttctcatttgatggtgagtggggggagtttcttattcatcttaagcagtctcctcacggtctctgttctcctgagactggcaaatgatcatcagaaaccgtcctggccttggcaatgatgccggcctcactaaacaagctatatcgcagcagtgtaattgccagttaaagagcacttcgtcctaattaacctcttcagggaatgagtaaaagcatcaagaattccagagttcacagaacctgtgcacaagcccttgtcatgcaaatgaagaaattgagtcttggggtgagcaggacccgaggtccctcagctgaccagtgcaggactcggaccagaatctggacttctagactgactcctgaagccctggtttactccatcagccagtgggaactgtcaatattctcctagctctttatgccttcaaatatgtctgtcaaagacatattagttgagcatgtattacatgctcagcactgtgctgggtgctagggtcatgggggagacggagcagcttgttattctctcaactgtctactgagcacctctcacgggacacacacactgagggccctgaggaaagcacgactttaacagatgaacagctttgatacctagcactgtgattttctaactacaatgagacattgatacttatcacacacagttattggacatactaaatgccatgatatttatgaggcctacggtaaatgatcaatacactgtggctatttttattctcttcactatacagctggggagatgaagcaattcatgaaaccaagggggtagcctcattatcaagcactggacaatgaggggtgggttttgagtgttgagggaaagaaggtgaacaggagggaactgagaagtctttgcagagatgagatctcagctgggtcttggaggaagaggagaatccattcacaaatagggaaagcccaaatgtacagccagaacgaaggggacttgctgggttagggtgcgactcctattggagaggtagggtaaggatcccccacggatggtcttgaaatttgggcagaaaaaaagtgagggttcctaatgacccctggaggccatttagatctccacgtggattagcttatcacacacactccaaccccaactgagctggccagtggtgagaagataacatttgcggacgagttgtgaagtggcgctatgcaggcagggtcagggaggctcatggggaggcctttgcagggagctggggatgaggactttgaccacatgggagtagcaggaggagatgggatgaatgcgaaacaggagaaggagcagaacttgtcggccaacctggacaattcagacttggaccaacaggagctggtgaacgggctgaagttttgagcttgagtggacagagttgccagccaacttccttcacctccaaaaggctctccggaggcagtttccaagtcctcctttttcctacccaacagagcggcaactggcagcaagctgccagttgtgtaagtccacacagccacaatcactgtggatgaggatgaatcctgagtgcagccctctgtcctgagaagctcatcaggtctgtgtgggtatctccaaaagactgctaatgcactcattctcagtccccacatgtcctctcgtctcttgttttgtttctacattgctggaaaatgagaggtttcagcagaagatggaaaattatcctttattttgattctgtgtttgaacaccttccacttctctgcaaattgaggggtatattttagtataatgcttggctcatggaaccagagaatcaaaaattagtcaaggttccaagaagactggtgaagctttatgcctcaaagagacatgctactttcactagaaactgcttctgactcctcatgaagaccagggttcacccccaaatcaggcagggctagccagtgtctgttctctcagcctctcagttgtgatctcttttgctctgagatgtgcacgtgtacacacacacacacacacacacacacacacccataagtgcattcactgcataactgaccgatgttataagcattccagacataaaatgctgttaaacagccaagcatcatccctggaaatgcaggcctgaactgatcctataagaattataaactgaacagctgagggaactcagagtagcaagagtcattcacattatagaaatattctccccttctctccattgcacttttccttatttggaaacatgaaggtgaaggtgcaaaagacacatcacacacagactgagctatggagtgataaccagcagggtgcctggcccagacagctatgtcaattctgggcccagacaaaagagtccaagtaacccccctgatatccaggggtcagccaccccacatggcagccttggccttgcttggcttcccacccccaaggaacactgggcactcacctgcaagttattaagacacaaatcttattaatttagctcctccaagccagatgcctatgttgggaaggagggtgaacctggtcatcagggttagcccaagcaccacagaataaccttgataagtgttatcatttcagggatttggttcaggtgtacacagtggaacaggtggaatgtggttgcaggtaaaatgccatgtcccctcttgctgtttccgtaacaatttcaaagacacactattatggctctaagaaataagtcacctttaacaaaggggggatttcccacagaaaggtgagctgcccattaggcctcactatggcctacaagctctgccaacctttctggtaactcttggcttcttctcctccatttaacatctgctcatattgagtttttgttcctaactcaagccatgctctcttgctctcatggaattttctctgctttaaacaccctccctccacctggcccctgccccaccctgccccactgggccatctccttctgttctctggttagatgccctgtccttgggaaggatgtcctgaccaccgcgtctggattcgacaccacatgcaagctctcatgctacatgtcacgctgaactgtgattcctcctccctgagcttgtcatgggatgactacatccctagcacccagggcagagcctggcacgctcctctgtgaacactttttgaattgagttgtgctgctgagacaccagcagaacccctgccccactcttctgcaggccaaggccactgttcccagccaacaactcccttgtccacacagctccttccatcccaggtgacttgatatccattatagtgcatggttcccccaacaacccgtgtaagtcagcatggcagggataccacctcatattttagaaataaacaaattgagatgtctagtaaaacctgttcttgtttggacacagagctgttcgctatctccagcctctcttgccattagatgtggccatgtgattaagtctcctccatgagaatgtgcatggcagtgagcagtgccacctccaggtctggcccatgagaacgtcccacaggcatgggggagcctccatgctcttgctccggctgcctgggatgctgatccccagggtaatcttggaagccattgtcagcctggatccacgaatggccatgtggaagacagctgccttgacaatctgaacacctgctcagaattgttcctggagcaagaagtaaatgtccattgtgtgaagccactgaaatcatggagactatttgttattggaacctagcattccctgtgaatacccaaaggctcagaaaagataaatgacttgcccaaaatattaacaacaaatgccagcaccagaatccatgttttaattaagaatcctcacatgactctgtggggaactagcattcatcacaaggtattttattcaggtgtctccttctctgtcttccctatgagacaaaaaccaacccagacacaaacagtcagcccaggaacctaccaagctagcaccaggcctggtacattgcaggctcccaatgctttcttgagcacacactgacataatgcttactatgcaccaacctctgttttaagattttcataaattttaatttattgaattctcctaactttatgaggtatgattattatcatctccattttatagatgaggataattagacaacactgcctccctggtgcctgatcaaggagctaaaagatccccaacccagacagggcatttctggttctaaaccctctcctaaacagaggctcagcaaatggtaaagttctgcttcgttgaagactcacccttcagagttgctggttcagaactctgttgaatggttttttgtatattgctattcatctgtgtaatatttattttctatgggaaaggaaaataaagcaataaaatgtttcgggtttttttttttttaagcgtcctgtctgattggatttgtgcagcagtcctcagaacacggatccaaaccagtacatgaagacgtgactttgtgtaaccatttctcttttctaaggcagcgagtccagctttttggagtgtgacacccaatttgcttgtttggattttgttagactttttttctttcctgcctccaaattcagctaaaactgctgtattctgtgtatttgttttttgtttgaagcaaatggttttgagacttctgtgccagcccttgagacagctggagacaccctggggtgctgtaaaaccgacggtgggaatcactgatctcagagagaagaaaaaacagttcagggaaaactagcaaatcagcatcttctgaagctgcagcatgagccaagagcactgcggccctggatagcaccgttaggagccgcagaaatgcctccccactcatgctggaattcaaggttacagcaggttaaaaacaccttgctggactccaggtgcccacctcagcaccttcgctgcctgctcagggacattcacaatggagcagttctcagggcccacgtgtaatcctcagtcacgtgacatgcattgtgtgctcaacactagcctaggtgccttgaagacaaagacaagtaaataagcttaaatgaagcaaatctagtttctgccttcaaggagattgtggtgaggaagaagataagacacaggcataatatcttgcatgtgtcctggagaacatatgagtttagctagaaagagaacctcatctcctccagctagaaattgctgtgtggctgtgccacttttaggtggacctatggccagggaccctgccccgacaacagggacccttcaccatggagccccaagataaacaaggcacattgacagaggagggccaagaaacccctaactaagggctatacccaggccccacaccccagtgcagagacctggcaggctgagctgggccagagactcagactcacacaggccctgagtgggctctccgtggtctttccctctaacacccacagactctgatatgggatcttgccccagtgccaaatgctgcgcaagcctggaccacagtaggctgtgcccagactggacatgggccagactcacatctagaaggtgggactgaagatgaggctcggccctggatagggccgatattcttctttgccgggagagcgaatgcagaaaaggatgggctcagacacacggactgacccctccttgtgtctcactggctgatcattgatgggatgctctcttcacacggtttctttcaacatctttccatcgaaatcttagcaaccttcttgtcaacatgttcctttaaagcaattgttacaaggcacctctttggaagaatgtgctgaccccgtcccccagtggtatgagtgaggcatgaaaggggaggaagtgagatgtctggggccctgactttggccctaatctctgtggtcaccttgtcagagagggacccacatcatgagtttcaggattattcttacccatgactcatgaggccttaagcgtcctacttctgccgtggaatatcccctggaaagactgagggccagagctgagtgtggagtgtggatccctccacactggcagcagccaagcccctccacactgcatttgttccctaaaagaacatttttctaagcaggcctctcagctctggggaatgaacagcgatggagtgagcaacaaattgtttcatttgctaagactgtgagctacaacttgcaataaatcagtgtgaaatgagaaagtagaaagggaaagatgatccttctccaattgccagtcaagctttagtttacagcaccacaggtttggtgatagggcggaaatcatcagactcctcgctcacagtcatattctcaaaggaaccatactgaaagcattccagtgagctcattcctggcatccatccccgtaggacacaacccttcaataatctgcatgcctttactgtgggaaggaaaaccaagtacactccaggtcagggatggaacagggcatgcctcacaatagatggaataacggccccacagatatccacatcctaggcctggtacctatacatatgttctcttacactgcaaaacggactttacagaagtgagtgaggtaaggatcttggatggaaaaattatcctgcaagatccaggagggctcaatacaatcacaggtccttctaaaagagaggcaggagggtcacagtcggagaaggagacatgatgacagaagtagacaagtagacgtcagagtgatgtggggccacaagccaagaaggcaggtagcctccagaaactagaaagtgcaaggaaatagattctcccttagagcatgtagaaagaagaactgcctctgcacttgttggcagccccataggccaactattataaataacttccaggaatctacagtcaccacaaaatgccccacattatcccctccatgctgtgtattttctacattcctaacatagagaattatgttcaatatcatctccagatctgattgggaatagaaacagcttcctttttggttgtgtaggcacacggcaaagcctctattgtagaacaaggccagggagggaggtattccggttaacccaggacactggttacttaagagctcccaaggaagaccctgctagacagaacagaggcccctctcatgagccactcataaacaggactctgggcgtcagaaccaggccttatctaccccataaggacttctgattctctgaacacaacaggacaaaaatgtacattgcacggtaaacatacgctggatttgctctgataaccaaggtcagagcctcctttaacaacatcagtaggggcaatgtcacctgtggccatcctggctcagaaaggccggtcacagatgggctggccagccagagtcctagagtaccaatcctgagtctcccctttggtcaagggccctggagtctcccctttggtcaagggagtacctggagaaaaaccattcagaggacaaaacacagccagggcaggtgatctccaaaccccaagcatccaaccagaaatgaaccccagagaccctgtctcagctgtgaaacttctagggcacagttccagggattcctgctcagcaacaaacagcacttcgtggattctacgagtttatgcaagaaacagaggggacttgtgggctttatcatggaattagagctaccaaaaataatcctcatggtcatgatgtagctttcacaatctacatgatgtagattttagcttagtgaaactgatctcaacttctgacttccagaagtgagataataagtttctgggtatttgttgggttttgtttgtttgcttgtttgagacagggcctccctctgctgtccgggctggagtaaagtgatgtgatctctgctcactatagcctcaaactccctggaatcaggtgattctcccatctcagccttctaagtagctaggactacaggcttgtagcaacatgcccagctatttttttgtatttttagtagaggcagggttttgccatgttggccaggctggtcttgaactcctggcctcaagcaatccgcccacctcagcctcccaaagtgctgggattacaggcgtgagccaccatgcctggccagtaagtttatacttaagccacccagtccgtggtaatttgttacagcagcaataggaaaactaagccaggctctccatgttcacagttatctccaccctgctttgggcaggacagaccttcagcaaaacctagtgaggagcggaacaaacattcgcttcatcagcaacctcatcccacattggaaatgagtcaccctgagtgcccaccccagagcagatggactgtgagcctcaataaggaagagtgggtggtggatctaagtgcccctgaggagtcttcatcctgccccatcaccctttcctgccccaacttctctctccaggtgctcccacagctctggctcccccgagtccttgctcctgctgcagtgctcctcctgcagtgctcctcatctacatctcctcctgaaacctcaggcctaatactgtacattgggcctaacattctcctgcagcacctacttgtcttcatctgttttgtgctactataacagaattatctgagactaatttataataaacagaaagttattggcttatagttctggactcaaggaagtcaaagaacccatcacctggaaaataaactggttgtattaaaaaaaacctgattgtaaaaaaaaaaaaccaaataagtaaattgagtctcctatgaaatagtggagactccatgttaaagctaacaaatcatcctaaactatcagatgcacattatttttctgtcacttgagtttaagaaaaggtcagtaagaaattccctctgctgttttccagtgagtcgaggccttctctgccttctagaatttggttctaactctgggacaagtccaggcacggggcaaactgagttccaggataaaaagtggatcttttctaatacatttaactacagtaatgaattccttatattctgatgtatttcttcacactattcctgttacttttatgcctagtgatgaagtttcagatagctctgccctccatgtgcccatgatgactattattgtggaaccattaaattcagaactcataaggtccagcctcagaagaataatgtggttgaaggaacatagccccaaggtcaaaaataattttaacaacacaaattctttccttgcttttttcaaaaatggttactaggatacaaatacctaattcatggagacatttgataacatcccttcttttctcccccagttccctcacacgcccagctgtccccagcatcacatccccagctgtccccagcatctctcccaaaattgtcttaatctcttcactcccagcttctctgcaactcccttccttttttccatgcaacctccttttcatccttttaatatgtgagccaacctgcctcttaatgagaaaagaaggaaaaaggggtgctatgaactgaattgtgccccgcctaaaattcgtatgttgaaattctaatccccaatgtgactatatttggcattaagactttcaagaaggtaattaaggttaactgtggtcgtaaggaggggggttatctgacaggatggttggcctcataagaagaggcacagagaactctctccctctctctaccatgtgaagacagagcaagcagacagctatctacaagccaggtagagcaccctcaccagaaatcaagctggtcagcatcctgatcttggactttgcagccttcaaaactgtgagaactgttgggagcaagccccccaaaatctggccataaactggccccaaaactggccattaaaaaaatctctgcagcaatgtaacatgtccataatggccataacgcccaagctggaaggttgtgggtttaagggaatgagggcaaggaacacctggcccgcccagggcggaaaaccgcttaaaggcattcttaagccacaaacaaaagcctgagccatctgtgtcttaagggcatgttcctgctgcaattaattctgcccgtcccttcgtttcccttaagggatacttttagttaatttaacatctatagaaaccatgctaatgactggtttgctgttaataaatacgtgggtaaatctctgttcagggctctcagctctgaaggctgtgagacccctgatttcccacttcacacctctatatttctgtgtgtgtgtctttaattcttctagcgctgctaggttagggtctccccgaccgagctgttctcggcagagaacaaatgtctgttgcttaagccacccagtctatgacattttgttatagcagtccaagtagattaggacaagggggatagaaattgggttagaaattatgggattttctttggtggactgaaggaagtgaagaggaagtaaacattctcatactaatgagtgtcgtcgttttgtgtcataatagtgcatatggcactaggttattatttacacagagactgagagactgaactgctccagagtagggacaatgccttgttcatctttctttcgctatcaccaagcagagggcctctcacacacagtagatcctctgcaaatacacacggaatggtgaataagcaagtgaatgaatgaatgaactgagcacatgacggaaaggcatgcactggtctctggttagcatcagattttacccccattataaaagtagtatctgtttattgtgggaaaatattagaaaatacagataataacgaaggaaagaaaaattattccaactgactagtcagaaataaacctcaatttttagtctatattcttccatatttatctcatttatttatttattcagattagaaactggaaacctacagtacattctatttttagaacttgctttcctcctcccttaacagcatattgtgaacaactttctatttcaacaaaatatttgtaaaggtgtaacattgttttaaatatttgtttagtatgctatgacatgattgtattgtcattatttcagtcaattacttttgggggacatttaaaggtactttattattataatcaatgccataataaatatttaaaatttctttaaaattatttaaaattaacttatgaatagaagcaaagtagttataaagtatatgtggcatataaaataacaatacagtgattatccatgtataatttatgtataataattttacttgtttttgtcattgcttctttttgccaaatattatgtgcctgagactcatcaattttattacatgtaactgtaattcattcattttcactctgggtatagtattccagatctatctctttatattctatatattattataggataattgctatattctttatcactgtagactatatcacaatttagaatttatacattcctctgttgctagatcttaaaattgtttataattttaaattatgaacagaggtgctagaactttcttgttcatgtctcccagtgcaaatatggaaaagattctatgagaggttgctcctgggagtggggtgtctggttcctagagtacggcattttcagctgtattaaataaagccaaactgtttcccaaaagagttgcacaagcttctgctctcaccagcagtgtcttgtgctatttctttagggtggccatcattatttctggtcctttggtttccacataaattatagaacctgcttgtcaaattacacacactcattcatatactttctataacaagttaatacactgttcattttgggggagaataaactcctttacaatactgaccttcttattaattaattagccccttcaacaaagtttcataattttttctccatgaggaccttacacattttagttatattcattcttgctttatatttttgatgccagtagtggtatcaattttaaattacattttctctttgttactgttatacagataagcaattacattttgcatgttgattttgtatttaacaaccttattaaaagatattagttatcctagtaatgtattcacagagcatttggcttttctacacaaccatatcatttgtgaataatcacagttttgtttctctctttcaaattttcatattgtttatttctttctcttgccttactgcactagctaggacctccagtgcaatattaaatagaagtgagatagcaggtgctctcatcctgctcatgtttattttgatatcatttcaaactcacagaaaaatagcaagaatagtataaggatctcctatactttatctcagatttagcattttgccccatttgcttatcatttctctctcacatatatatatatatacacacacacacacacacacagagacacacacatatatagtgtgtgtgtatctatatgtacacacatatatatataaatatataggcatacatgtatatatttatacatatataaacacagtacatacatgtattttggggggaaccatttgagaacaagctaaagccccatgtgcctttaatcctaaagcgtatatttcctgaggtcaacacagcctcctacagtataactgtagaaatcagcattgttatgatgcttttacctaatccacagtccatattcaatttttgtcaattatcccaataatgtctttatatctattttttttttcctagtccaggttcgaacccaggatcacagattgcatttagttgttatgtctctttagtctcattttatctggaacagttcctcagcctttctgtctcttgaccttaatatttttgaagggtacaggcaagttattttgtagaatgtccctcaacatggatttgtttgatgtttcctcctaagattcaagttataaatttttcacaggaataccaaagaattgacactttgtccttcttagtatatcacatcaagaggcatatgatgttgattcatcccaatattggtgatgctagctttaattgcttggttaaggttatatccaccttttgtaattaaaaagtaatgtgtggagaaacacttgcagaatatgtaaatattctgttcctcatcaaactttgactgttggttttccgtatctgctgagactttttttttttaactccatctttccttctatatttcttatctggcattctaccaggaagagctttcctttatgtccatctacttatttattcatttatgtatgtagggactcatgcactcctattttattcagtgtgttataattattttccagttatgttttgttgtgtaaccattcaaaagcctgggagtttgacacaacacttattttattatctttcatggtttctgtgggttgggaatttgggatggactcagctaagtgattctggctctgggtccctcatgtggttagagtcagacaacagccagagctgggagagcggggggctagccagctgggggcttgttgagcgtctctctttctcttcgtgtggcctcagagcatctccacgtggtctctacatgttggctcacttgggctccttcacaagatggtaacctcagggcactgtttatatggtggttcggggatccaccgtgagcaatctagccggcaaggtgatgatttgtcatttgtatgacaaagctttagaagtcatatagaatcacatctgccacagttacaacctgcccagattcaagaggggaaatagatcccatctctacatggaagaaaggtcaaattcatgttataaggatatgcgtgatgagagatattgctgctgccatctttggaaaatcaatctgctatgatccaccctctggccacaattcacatccctcccatatgcaataatcctctctctaatatccccaaatctattagtgcagcagcacaaaatccaggatcgaaatcaggttatctgttatctaaatcaggtccaggttcagacaagacttctcatgtgaggttcctaggattcagctcctcgcacaccattcctctgaatctgaagacctgtaaacactcactccacaggcccatgcataacagtggggcggcacaggacaacttctacagatattttcatttaaaaagggagaaaatgtgaggcacacatcaggtgctgatgcatagcagttctgcaatttagccagtacttgtttctagtcccttgattagggctccggtcgactccaggaataattctccagggctcttggctccacccttttgagtctttcttcctttccatacaaagtaacccatgttaagtagttttctcagcctgcttccttcttgtagaagttaggacattcagggacctcttcattttgcactgtctctatcacttacagtttaagcttgtataatttttgaaaaaacaaacttgcattcttttagtgtatcagtttacaatgtactctgtggtgattagtgtgtcatcttggctgggtcatagagcccaaatatttcatcaaacattttactggatgtttctgtgaaggttttttttttttctttgatgaggtaaacattttaatagcgacactttgagtaaagcagattatcttccatagtgtgggtgagtctcatccaatcagttgaaggccttaatagaacaaaaatggacctcccccaagcaagaaggaattctgctagcagacatggcctttagattcaaactgcaacccttccctgggtctccagcctgccagcttaccccatcagattctggatttgccaagcctccacaattgcaagagataattccttaaaataaacacatttttaaacacacacatacacacacacacacacacgcactcattcattctctctctctctctgttgattctgtttctgcagagaaccctaatacatactttttccaagaaaagccaaactcacaaatctcttcaagataaaccctaccatttcctgggctccctatgggacaatgctcttaagatgctagaagccctgttgttcagcagcaaggcacaccttaagatctgtaaaagtcctcctttttttcctggatggaagagtctatgataccttgaatatttctgaggtttttaacaaagaaccttataggtacccctcatggattttctttttgacctgaaatcttttcttaatttgacaacttttcaccacctttgagaggctggaaatggaacaagtttgactttcaagcctggtgagtcttggctcctttatatttaacagtttgtcctccagctcacctctccctctcatgttttaacataggcaaaaaaaaaaaaaaaaaaagaaagaaaaaaacaaacaaaaaaactaatctggtggtactttctaagttctgtctgatagcctctttagtggaatcatcaagtttatttagcatatttcctatcttactgcattaccagaggtgacaatattattaaaccacccactaccccacatccagggttcttccatccaacttcttggaacattttcctcccttgactttaagtgcccactgagagcctcctcaggactctgccagcccgctctcacagcccctgcaagctttcaccagcagtctcaatgcctcctgccaccaaaaccaaagtcaggtgttttgaggttttgtcatggtgtcatctcatatttttgtccccaatctattatgattacctattgctatgcaaagaattgccacaaaacgtagtgacttaaaacaacaacaagcgttgcattatttctcgatatttctgtaggtcagatatctggggagggttcagccaggtggattcagctcagaagcctctcacacagttgttgtcagatggtagctgaagctgttgggggctgatgtggcattcttctcttttcaggctgtctcaggctctttccatgtggttcttccacatggactagtttgcacagggacctcaggacagttagacagttgacatggtggcttaggctccagcatgagtgttccagccagcatggtggaagctaccctgtcatctacgatttggcctcgaagtcctacagcatcacttccacaaaagtccccaggttcaagacgaggggacatagaccctgcctctcaacaagaggagggtcaaagacacattgtaagaagaatatgtgaaatggaagatactgttgtggctagctttgaaacatacaatatgccacaaatccattaacatgtttttttctttttaaagctcaaattgtccagatgtggccagcatgagtcctttaagttgactattgtatcgttttgacaagtccccatgatgttttgagcgctgctttatttttctgacaccaaataaccttccagattcattgtatactttttctgctccatttccccacttctcaaggaagcttagttcccttcagtggaaaacctggctgctaggggtgtacattgctactggagtatcactgcttctgtgccttctcagcacacagagctagagaatgttacagacacacacacacacacacacacactcttaactttaagcaatacttaactgatacttccaactcccatctgaaaacaaatgtaccattctagacttcccactttccatatctgtaaaaccctttcctaacagtgaaaaaccttgctcgcattatatactaaatacatttattatttgctactggtttaaaaaaaatggtgtttgaagttaaagaagttcccttctatttggttctcctagtgtaagaattttttcttacactaataaatgaatggatattagatttttaaaatacttttcttatatctattgagatgattatatgacttatccacttaaaattgttctgtggtgaaatacatcaagagacttctagtggcaaacaaatatagtttgagataaatccaaattgttatggtttatcttttattaatagactgctaaatatagtttgctaatttttgcttaggacttttgtatttatgtacaaactggcatttaaaaaaacattcttaccaggttttggtgtcaagtttatgttattctcatcaatatacccactttttctggattctggagtagttcatatgagatgaaaattgttgttgttggaaaatttgttagtacccactggtaaaatatctggatctgacatattctttgtgggaagatttccagttagaaatctgattatatttcttgaatgatgctaagactgattaggttttttatttctactgaagtgagtttggacaaatttttttttcaggaaatttgaccagcagagctttcaaatatattggtgaaataagattctattattgttttgatttctgcagctttaattattacatcttcttttcatttctgatatgtgtatttattccctcctcctccctctctcctctttcctttattactcttgacatagttttgttagatttattggttctttcaaaaatcagcctttggctttgttgaacctttctgttgtactttttttttttcaattttatccattcctttttattattgttctttattacttccttccttcaactttatttgggtttactctgctactcttttcctaacattgtgaggtggagatgtttaactcatcaactttggtcctgtcttattttttcttttccttgctctgccaccaggctggagtgcagtggtgccatcagagctcactgcagcttcaaactccttggctcaagtgatcctcccacctcagcctcctgagtagctgggacttcaggtgtgtgctatcatgcctggttaatttttttatctttttgtagagacagggtcccactgtgttgctcaggcttgtctccaactcctggcctcaagcaatcatcccacctcagcctcccaaagagttgggattacaggcatgagccaccatgcctagcctctttcttctcttctaatggaattatttaagattatgtaatagctcccattgtgatcatgagcttatctatttctccttataagtctgtcaatttttactttacatgttaatctgatcttactcggtaaatacatacttggaatagttattatcttcctggtgaatttaatctattattacttagtggtcctcttactctctagttatgctttatgcctctattatattgtgtttcactttattatacctataccaggctctttctgctatttttctggaatattgtttttcatcttttattttcagcctttatccttgtattttagatatgtttgtttgtttgtcaaatagctgggccttttttttctattctgataactattatctttcaattggaacatttggtttgtttacatttattgtaattactaatatacttgaatttaaagctaatattttgtattttctattttttctgccttttctatttttcattttctcccttgaattcttcctagattttttgaatatttttctcacttcatttattgtctactactaaacttgaaagttatgctttgttagtggtttccttagacatttttaccctctatacttatcaaaattaagtttataggtatcttttttctttttctcaactatacaaggatttcagtacaaaaatttgaagttgtccttttttgactgatctgctatattttcacatattttctgccaaacttttaaagttatgagacattattatttcaagcaattaatacttagattaacacaaatattcccacttttaattaattaattaaaattaaattaattcccaaatattaacccaaatattgccactttctttactcattattgcttcttatatcttagactttccattcttcctgttggaaaacatccattaaaattgccacaaatgaaggtgtgttaaaaatcttttatttttttttcagaaatgtctccattttaaaattttattcaaagatatttgatggtataaagttctatactgaggaaacattggcaacttatggttctggcttcaataaaatagctgttgtttgacttaaaaatcactgtacagctggactagaacagtaaaacaattctttctaggccctggaggcaggcatcatgtgctgctattcttgaaagaaagaaaacacacgagatgagcaccacactcacccccgttttcttcctgagggtagtttttaatgggttcacggcccaaaccttgtcacagggaaatggagctcaagtagagagcagcagtcttactaggcagaagaaaaagatgtcaaagtctgagatttctgagactggaattgagctcaggataagagcaacttacagaaaaggagccccaaaagcctgaatagggtttctctttggtcccggactaaatcctaagctgtaggaacagcagcaagatttcaggggcctggaaatatttggggagctaagagctcaacagagattttacaggttgtatagcactgagtaggtgaaattctggcccagtcaaagtatagagagcttggtaaatactctgagcttttgggcagtggagacccagtggtataataaagaatttgactggtatttgtccctggtttctgaaagggagaaaatccttggagtaataggagtatctttattatttatcacaccttatatcacacccttatatcacacctgagtttacattaagagatgagatggctcaggacaggggctggtcaccagaaatatcaaccatgtgagtagagggttaggtcttagagctagcctgacttctggacaaaaagagctcccatatatggtttgagagtgctccccaagattccagcgtgagatctggtccctggtgtggcagtgttgggggtagagtctttaagaggcgattaggtcactaagagggattcatgccactctcgcaggactggattaattctcgaggaagtgagtgagtccttgctctcacaggactgaattagttacaagagtgtgttattataaagcaaggcttctccctgagttttccccttttcacacccacccacttccctactatattatgtcatgatgcagcatgaagccctcaccagaagtcacccagatgtggctgcctgatcttggacttctcaacctccagaattgtgagccaaaacaaacctcttttctttatacgttacccactatcaggtatttagttatagtaacagaaaatggactaagagaaaattgacacaaaaagtggggctactgctatacaaatacctgaaaatgttgaagcagcttttggaactagacaatggaacaattttgtgaattgttccaaaattgttccaaaaaagtgaatgctagaaaaagcctatattgccatgaatggaggatttagggtaattctggtgaaggtgcagaagagaaaactagggatagtctagaacttctcagagattatctaaatggtcatgaccagaatgttcacagatatgtggacagtaaaggccactctgacaaggtctcaaatggaactgaagaacaaggtattggaaactggagtaaagactataaagttgtaaagaacttggctacattgtgttcatgccctagggctctatggactgtagaacttaagagcaatgaattagaatatatggtagaagaaatatctaagtgtcagcaaagtattcaggctattatatggctacttttaaccacttacattaagtagtgagagaggaaaaagtgacttacagatgaaactcataatcaaaagggtagcaaagtggaaagacctggaaaattctcaggctggccacataaagagtgaaaaagtggctggatgcagtggttcatgcctgtaatcccaacattttgggaggccaaggtgggtggattacctcaggtcaggagttcgagaccagcctggccacacggtgaaaccccgtctctactaaaaatacaaaaattagccaggcgtggtggcacgtgcctgtaatcccagctacttgagaggctgaggtaggagaattgcttgagcccaggagacggaggttgcagtgagctcagatcatgccactgcactccagcctggctgacagagcgagactttgtctcaaaaaaaaaaaaaaaaaaaaaaaaaagagtgaaaaagtgtgttcaggagaggaaaccaaagatgtggtccagcaatcttttgttaaggagattagtatagacagaagggataagcaagacaatagaagacagatcttgaaggtatttcagagaacttcaaggctgctccttgcatcatacacccacaggcataggagagcagaatggtttcaggaaatgagcccagggcaccctccacaggcttgcttcccagggcctcctgaggtctctgttccccacattccagcgtagcactcctctgccaacccagccacagcttcaggtatagctagtgccactgctctagaaagtacaagttgacctttgtgacattcaagtggcatcaattttgcaggcatgaagaatacaagagatatgggggcatggcttcctccccccagatttcaaaggatattgtgaacaccctgggggcccaggaagagacttgtcagaaggattgagccactgcagagagcccccattaagtaatgcctagtagagccatgggaatggaatcaccataaagacttcagaaccatggagctacagcatgcaacaccattctgggagagctgaagtgtgagacatggagtcaaagaagattattctgcagcctcaaaacttaatgttgttccctgtagggctttggacttacttggggcctgatactcctttcttcttgcctgtctgtctgtctctctctctctcttagaagggaaatgtctatcttatacctgtccattcattgtatcttggaagtagataactcattttgattccacaagctgctcataggtaagactttggatttttgagtttgtgctggaacaagttaagacctttgggactattagaatggaataattgtattttgcattgtgagaagaacatgaaattctggggggcaggtgtgaaatgctatggtttcagtgtgtcccccagaattcatgtgttagaaatttggtccccagtgtggtggtgttgggagatgggggctttaagaggtgattgggttgttaagagggattaacactgctcttacaggactgggttaattcttatgaatgtgggagtcctccccttcatgggactggattaattaccacaaaagcgagttgctataaagtgaggctgtccttgcatttgcccttttggcaagcactcagctcacccccatgttatgatgaagcatgagaccctcaccagaagatgatcagatttggcaacctgagcctctggaatcatgacccaaaataaacctctttttttaaaaaaataaataaattaaccagtctcaggtattcccttatagcaccagaaaattaactaagacaagaggggaagctggattacatggccaatcattaaagttacccggccaatcattaaagtgataatacctacaaaataaaatcccaataaaagccctggacacctaagctcagaagagtttcctggttggtgaacacactgatgtgccaggagaacaatgtagcctgatttcatgggaagtgggcatggaagctctgcatttaggaccctcccagaccttgctctatgtatttcttcatttggcttcatctgtgtcatttacaataaaatggtagtcaaaaatatagaacttttctgagttctgtgagtcactctatgaattatcaaacctaagggtgtcatggaaaggatttatggtcagtgtttatagtcaagaatttatagtcagtaggtcagaaatgcaggtgacttgggggaaccctgaacctatggttagcgtttgaagtgagagcagtcttatagaggactgagtccttaacttagggtgtctgctaactccagggggttagtggcagaaatgaattgcagcatactagttgatattcagactacacaaaaaggctttgtcctatgggtaagaatcatatcctaggaataaggcctatacattacaactgagggagaaaccaaaaaaaaatctcctaacaaagtctaaacatgaacagcaaaaaatggtaacctgtaatcatgagataaaatcatcagttgaggtagacctagagatactaacactactggcattagcagacagaggacttcaaaattactatcatctgtgtggcaaagaaaagaaagagtagctcaacggagaactggaacccataagacagaatcaaaaggatctagaactgtaaaatattatattgaattttaagaattcactggctagaattaacataaaaaaactctgaagaaaaggttaatgaactcaaaggtagattgaagcttgaagggggaaaaaagaagggaaaaaacagaaaataagagtaagagtgttgtggaacatggttaataggtctaaaattctagattgaccaatgttttctcttagcatattaaagatattccaatgctttctgatttctactgggaaataaactataagtctctcataagtaatctgttttttctctctagctactttgagggttatcattttgtccttagtattctgcaagtttttgttgtagatagccttacgtttctttttgtttatcctatttgggatttactgggcttcctgtatctgaggatagctgtcttcctttagttttgcaaacttttttcaaccattatcccttccaatattactcttcctgttttctctctttaaccccaattacaaatgactgagtcctccttatcctagtctccttgcctcctaaccttgatagctttgtctcctccttgcattctggttacattttcagatgtatcttccagttctcttcagttatgccctgtttgctctgaagtctatcctttgatttttaaaatttcaattaccttttttaatttctagaaattctatttggttatttttcaaataatcaagatagtttctataggtttattctttgtttatattttcagctccctttttattgcttataacacagcatgcacagttttttaaatgttaattctattatctggtcttcatagttcctttctgctggctcttcttttggtgttttgcatcctttcatttttacaaattttaactgggagctcatattccttggatggaaaactgtcaaaattatttgaggccaatactgaagaagagttcttttacataggatttgtgtttgctctaccatgtacctaggaacactatcaaccaggactgtttcaagcaaaattcttggctgaggctttctcagactagtctgttatatgaattctactgaaagcttagcttgtggttcctgttctcagaggaaacattttggctcccactcagcatcaaggtttaaggcaggcaattttcttcacacatccttgagagaagacagggcatgtttatttttatttcatccttacactagagaggtagcctactggggtctgttggggtctcagcttttatgtagaggaggttttctaacagactgatctgccctaggcttgactcctgtccccatatctcttgaggtcgtaacaatcagagttcaaggtcacctgcattgggcaaatactctcaaagcaaaagtctgctttagaacccaactttctctgagtttttggcctcttatgaatctttagttcctgctttctcactgaggtatttaaaggattgcttaaatgttttatccattatttaaaattgttttaagtgggagagtcagctaagttatctagcctcccatatagccagaaacaataagctgcataaatagttctaaaattttcatgttattagtatctactctttctgaaatggtggataaatgtgattactcagttttgaggaaagaaaataaattggtccagttaaatccaaggctttctaacccaatgcatttcagtaagtattcaccaaagacatcctagtcccccatactacaggcccacttagaattagaagtcacaaccccaggcaaccccagccccaactgtgggtgaataatagctaacaatgatggctaatatagagcctactcagaaggtgggccagtgctatgctaagctttttaatatgcatttaatccatacaactgccataggaggtagatagaactatcaccactattttagatgtgagaaaaccaaagcacagaagtttaaataacttgttcaaagtaatataaccagtacattggatcatactcagaatgtctggctgtataattttgaaaaactacactgaatagttagagaacacagaaggagacaactctcaactcaatgagatcatatgagtaataagagtaggataaagtcccaatgtaatggtggctggaaatgttatagaaagccaacttttaggtagaatggagtttggcttcttttcactgtatgagcgatgattttcttgtccttttatatagtgtgccatattatgtggtcattgtacacttacgatgcctgccccaagctggaaagactcatcttgctcctctcctcctttagggagggaggttagagtttccatgcagaccctgttaatccaactttcttactattacttagaacatgtttctaataaacctcctgggattcatataagttctttcatagcagtcaagcaattgggaatgaaccatcctaaagacaacgggcgagccactcaaagcaaccaacaataccaccagctttgtttgcctgggtcttgcctctgtttacgatacttgggggaacagcaagtgtgggagggaggataaatcacaagatagcttttataaaatgactaataaagaaataatgggaacccaataacgaccaattacagaggcaagagaaataataaaaataataaagcagaaaatgtacaaagcaaacaattaagactattttatcaaaacaatactgcgactcagaaagcattaattctcactgcacaagggcagtaactgtttatcatctgaattttgtacattaagaaaatgacaccaagggagttaataagttcctccaagctctagaacacttcggagcccggattaaaagttagccatgctcatgctccgctgagatgtcatctctcattaaagtctaaatcagctcagagaacacaccacatttattattttttataaaatcgtgtgattctggaggagccaacagtatctttgggataaacacactgattaaaaacatacttttaaaatgtctctttttctaacccagtggaccaaatatataaattagagctattctggtctactgagtactgtaaatgtatatttagatgtaacaaaatatcagttggaaatatctttggaaagtaattactctgcaatatacgcggaatgtcttaaatgcttaaagcaattgcctcattttaaagacataacttacatagagaggcacaaatattaattaccaagcttgaaccttgcttgtaaatttactgcctagagtgaatatttatagattaaggcacaaatatcaaaaaataagatagaatgatggaagatttaactgcctaaagcaaggacccacttctagacaccagcatcattagagacattcaaggagggctgaggaggtaaagggttgcttcagcctttactctaattttccccaccttccctcctgccctccactttcctctctcccccatctccttactgacatctgactctactggtccataattaacaagttctataccttagtacaaaacagggattgaaaactcaaatgtctatggaggccacacaagtaatttaaggagcatgggtcttctggaatttctacttggtcatatttattctacagaactgtatctaacacacttagtctcgctatgaggaatgcactagggagtggtgaggactgtggaaaagcaggagagcatgtattcccttcagagacacggctgctctcacccaagcctgttgctgccatgaggtcatgtgggcccagggttatcaaagcattttgctttccaagatcatctgtatatttggatatttgaatctgttggtaaaatgcccttattttcaaacgatggcaactcattcatattgaaatatttttatgtttacaaaaaacctctgcaggccaagatggtataaatcaaaatatggctgcaggctgaatctggcccacgagccaccagtttgagacctgtcatatgaaacaaatatggaacagaaatcgggctcaagggtcttaggagaaacctgtcttacttttcttatgaagaggcagacaggcttggtgagtttccaggtaggagatgatgtggctcaacgaaagttcagctgttctttcaggacccaacgtgactttgggggtattcataaagaaacaggggatgaagccctaacagtgggtgttctaagaattagcagcagataggagagatatatgtgtgcaagtcttttctggacacttgcacatggtagaagagccacagaattctcaactgtagggttcagggcaagcgacctctgggtaaagtctcctggtcctgcggttccctgtgctccaactgcagcggctacttagtctcttgccatcaggtctctgggcctggaaaacgtaactctccctctgacctccagggggcgcgggagagagggtgagtcccgcggtacccggaacccacagtctgtatcaagagggaggaagcctaggcttgtccaagactaatagcctggaccagcatcttcccctcttttccgaggcatggcagcatcttctcagtgtcttgtctcggacgtttcttttccatttccctctgtcctccacatgttcccctcccatcaagcacagctatggatgcgcctgctcttcctaagcttttcaaggactgtccatttagaagtgaccttgcagacttgccttagagctgagagtcctcaggacaagggtcctagcaaagctacagtagcaagacacagggacatcccaccacaaaggaatgaatatttaggtacagtgaggtcaataaataagtcaccaacttactgaaacgcccagcaaaccaaatcacaaatcctttcaaagctgtgtcttctcatttctaaaacagaatatcacactatctggctacattggactattgtgagtgttaaaataagtgaacttagcatagcatatggcatatggtggaggctttaataacaacagttgtcatcatgtgccccctcccatataatctccgatcccctaaggcaggaaaacaaaacacttagaaataacttaaacgaaagtcaaaacatagaacttaactagaaaactcagttagccaggacccccatcactaggatatggcggctaagtctctgggatatgttggacactgtgccaccctacagagaagggagaacctggactcaggggtgggaggcaaggaaaggaagcaagaaaaacaacccagagagccctgagaactaagagcactggcttagagccccaaatccctcctctgctactcactagccccctgggacctcaggcacgtcactgtacctgttcaagcctacctcatctatacaaataaggggtgaccctgtggggcctttgatctggagttggatcatttggatgattccatgaatggtagagactagaagcaagcccgaccttgcaaggagggaatggtcaccgccatgcccagcattcaggcaggctgcttggtggacagagtgcagtcgtgaagactggctacgcagctgacctttgggaaatccagacagagagcctggggagatgggggggaggtgcctggaccacagtggtgggcacatctagtgctctctcaagtcatctacatgggcctctgctgcgggtagcatgtttctcgctatatttcaaatgtctctgatccatgacactcgcgtcctaatggatcctgctgtcagcaatggatgagcattgagctaatagatgtcaaacagcatttacatttctgaaatggcttcatctgctccctctcccaggactctccaaagtgaaatttgaaatgtggacagacgggtcagctctggacagctccacttccagaattctcgtgggcaagaaacaattatttattttttcctaaacagacagacagtgctgagcttattcaacaacaacaagctgcttttcaaccttgtcttcttggaaaggcatgcaatttcctaagaggcacatggaaatatctgtcaccttgtagtttaaatagcattcattcattcattcaaagcacactcacaatgaattatcttgttcattagaaattctgcagaagaccagtgagaggtttggattggagagagcatgggggagtttagcatctgcgatgcggtacgagaatcaaaccgcgctgctagattcacccaagcaccctctgcatattgacggcagggtcagaatggtattctcagtctgggtttcagtagcagggacatctgtagctatcagaaaatgctgcagaatcatctgtctagggaccatctgtatttgggggttattccaatgtagcacctgacacatgataatgaatggatttttctggctctctctggctctattttaaactgtcatcattttaaaccatgaaatatgtcaagtgataattaaacctcaccacagacaggtactgtgaaaatgattaacttttaccatttcctccatacacattttgaatattttgaataccccaggtatgggatcattacattgacagatgagagaagtcatctttacaataatttatttttaaaagaaccaaaacaggactgaaaattctgtgttttcccattgggtcttaatttgaaaacttctgccataaactcttattttcagaggaagccttggtgggagtaatacagaactggacgctataatctccaactctgcctcaattagctgtgtgacccggggcaagtcccttgccatctctgagtatcagtctcctcctctgtcaaataccaatgaccatatcttcactcttcccaactcacaggctttcttgagcatattaaatgagaggacaaatgggaaagctctttgagagcaaaaggcacaccggttacactatttgaatgtaaggtattattttaaattccgtataaaggggaaaaaagtaatatgccagcacagctttacaggcctactgtttttaaaaaataaacacacacacacaaaacagaaacctcaactcattttattttccgctgaagtttctgagcaggagattagatctgaccctatcaaatcaacgtcccctctgagccacaggactcccattttgtgtccaaacatgcaggggctcacacaaatgataaaaattcaaatgaagcagccaagcagctggatgggaatgttgcttccagcaaaaagggagagcaaataactgctaaaattagtaaagcgaatagactgaaatatatttttaccccccacaacgcattgcccagacccgtgggttttttacaggcctatttcttctgaagttggggttctctactcccctttggtagcagcagcaagacacagctccccgagatgggaggttgggggaggtcccaggacctctgactctgcaggcatgctgactgtagaacaatgaatccacatttttgaatacgaatatttcaatcagaattacacaaacattatcagattcccacagaatgtatcttcctgaatgacctcagtgaagcccattttaattctttgatcaatttcctacagagtacaaaaggtcctcattttttaaatttacaaaataagattgcaatgcctatctcagaggttgtttatgaagattaaataagaagttgaatgtgaaaatgtttccatttccaatctacagaatttatagtaaaggactaaaacttttgcctctaaattgtcttgaatgtgtggacacataggaaattacttactaaaaagtggctcctggcggggtgcggtggctcatacctgtaatcccaacactttgggaggctgaggcaggtggatcaccagaggtcaggagttcgagaccagcctggccaacttggtgaaaccccgtctctaccaaaaaatacaaaaattatctgggcgtggtggtgcatgcctgtaatctcagttactctggaggctgaggaaagagaatcgcttgaacccaggaggcagaggttgcaaaaagttcagggctcctgaacagcagccctggttataggtgaggtccatcccccatcctgtgttcctgtctgccaccccatgcccatttagaagcagccagcccagcgagcctccaccaaccccttcccaagaaagagggtgatctcttaggaaaagtggaaaataaaagcttctgacaaacatcatcaaggaaaggactgaagccactgccaggtgaggggcttgctcattcacttttctctctattttgggtgatttcatcatttgatgttcatttgcttttcatccttatgtgctttggctaaagtgctaaagaaaggatgtcatgtttggggtaaaacccctctcaagtttcggctggtgaatgcttgatgcacctccccaggtacctcctgcagctaccctaggggacagggcaaaagaacaaggtgaaagaacccaatcgctggaggcagctgtgatttgaaacaacaaaaaagtgccctttatttgtcatcagggacttgagttcaaactcacactctgttagaagcttctgtgaccttgggtcaactgcttaatctcttagccttggattccttctgaagacagaagagagcacctcccccctgaaacgctaggtgaatgtttgctgattcttagcctgcttttcaggcactcagaatccttttaggggtggagagtgagagacacccagatgtgaaatcattaagtagacgttaatatgcttagagaatttccttttaccttcctgcttctgtgtcccttattcagacccaattgccatttggggatccaccttcctcccactctcacttcatgatatcctgaccagcggtatggctggtgacttcaggaaacccaacagcacacagcattaattaagtgcatgaatcacatgacctgagtctgtccaatcccagtgagctttagcacttttgtgggatacactggactagaggccatctgtcttccactggacctggagctgtgaggaggggaggctggcactcaccatgaaggggaacccccagagaggggcaaaatggagggagaagccaggtccttacactccatatcaagtatatctgaagcccagcactcctcaccttccaccctcactggactatccaattacataagccataagtcctctttttgtttgagctagttgggttggggtttgttatttgcaacaaaaacgtcaccactggtacagtgtgcccttaaaagtcaaaggggaccctctgctgagacagccatgctttggaaaaaagatcctgaaacttcacctccaccagaacattcagagagttgttctcccagattccaacatcaattacactgaacaaatgctctctctatgttgcggacccaactgagaggtggctggccatggtgcaggtacaccaggtagacatctgtctgcaggacgcttgggcatcttctcaactgactcatctataagggcagggactatgccgggtcatctctgcacaccaaactccaatcagcccaaggaaacttctataagcaaccaataaaacctcaacaaactctgagaatcgtattcacctttccagaggagtcatttctccaatgcaagtagtagttatcaaactagagtcccagatattgtttttgaggcactgatgaggtgagagagccattgaggggcagagaatggagctgagaagctggagccccgaagaacagggtaggggcaatcactggcttgcagtacatgggagaaccagctctgtgcaccatccaactgcactgactgcgctcagaccccggcccaggtctccccactattggctgcactcttatcccggaaggctgtgggtcactgtctccatggagccagtgcccatcctacctgctcatttctgggacacacgctccctgacttcctggagagttcaaagcaacattcaacattttgtgaaaaggtttttgtttttttttttctttttaatgcaggccctgacgcatttcttggaacccaatggcaaccttggccaagaaatataacccaaataagagcatgtagagaccagtggggtgcgttagaatgcacaggattttccaaccctggttgcctgatctgccaagacactgtggcttattcaccaagcccaacttgtacaccttggaagccctcaccacagccacaggagagaaatgggccaaatgcagagtgagtgaggccaatcaggagagagagtgttggcaggtcttgctgatttagaggagaggtctccccttacagattatttccagtcctggctctgctccagctgaagcagagagattaaagatttgttaaaaaaacaacacaatcttaaaataatgaaaagacaggtttgttgttttttacaaaagagctttaaaagatgaactcattttgatgaaaagaatagaattagaacataatggtcagttgcatcctgtacttcgtttcctaataaagaaagattgccaagcagcaatgagataaaagagacagaaacaaatgattttaactcacagataattaaccccagaggctggtggatagcacattaatatgctggggcaaatagcttaatgaggtttgaaaagggcttcagtgtttatatgaagaagataatttcaagggttcctgaaaagcaaagaaatgcctctggcttggggactggtcaagtaacgaagatgacaaatgtcaagcttaacttctgctgggatctgagagatgagggtgagtctcctgggtagggtggggacctcagcaggtatacagggagcaccatcatctctctccacttgtcctggaggggcaggatcagcgtgcttcaggctggctgacaccatcctgtcttttggtccttaggaatgtgcagtggttcataccctttaggggtcatgacctcttcgacaatgtgactcttccccacaaattccagatagtgacctatgcccaaatattgcaatgcaacctctaaggagaccgctaggcaagcacgagtgattaggggttcattatcctgcccacaccgacctatagcttgcccgtcataaccacagaggtttagctcatgtgcatgaacacagtttaagctccttctagcagagggacccacaagttgttagaaagggcagaggagctctctgaggatggtagttaaggaaagtgagcattcccagggactggtgggaagagcaagctcagcaaataggaccaggtatcctggagctatggggttcacagtcaaacaacctggaaggccctgtatctgtgatctgacctttgtgagaaacggagagatgacataaagccaagtcagccctgggacatgccaggcatctaacactttttcagtgcccactctgtgtcagggacaggggaccctgggaggcagacatctgacccctgcgtttccaaaacttgtgcctgcacagcagcatgagagctgtcccagggcaaaggctacaggtaccaggtgagtggcgctgtggctcttggggaggatttacatacctcaggttcggatagcatcactggcagatccatcgtgagccctgagctatccaccacaaggtcctgctgcctccaatccctggagagagctgagctcagccagaggatgggatggtttatatctgtaatgcttaaggatgatttctgacaccagtgctcagaaagcccctgatcttgggagagaagtttatgtttgtctttaagtctcactctatctcccaggttggagtgcagtggtgtgatctcggctcactgcaacctctgcctcctgggttcaagtgattctcctgcctcctgagtagctgggactacaggcatgcaccaacatgcttggctaattttttgtatttttagtagagacggggttttcaccatgctggccaggttggtcttgaactcctaaccttgcaatctggccacctcggcctcccaaagtgctgggattacaggcgtgagccaccgtgcccggtcgtttgtctttaagttcttaaaggcaccatcttaaaggcttagttcttctgattgtagaaagagagaattagagcataaagttaaagaaagactctgacagaggaaagggaccagaataggctaagtttaagataattcttcggccaggagtggtggctcacacctgtaatcccagcactttgggaggctgaggcgggcagatcacgaggtcaggagatagagaccatcctggctaacacagtgaaaccctgtctctactaaaaaaatacaaaaactttagccgggcatggtggtgggcacatgtagtcccagctactcgggaggctgaggcaggagaatggcgtgaacccgtgaggctgagcttgcagtgagccgagatcgcaccactgcactccagcctgggtgactgagtgacactcggactcaaaataataataataataataataataataataataataataataataataattcttcatggaaaagtcaataggccacaacatccagagtctcatgaacacatcttggagacagaagaatgaactggcttacttgagaaaggcctctatgtctatggccaggcctgtaagagctctagtaaaaattacccatgcactgagcactgccaacattgcctgtcctgtgccaaggcgtctgcacacacagtcacccctcccaatatgtccacgaggctgtgtggacaccgaacacatccctgcacagaatcttcctttgaggaccaaaccattgcctgtggtctggatgaggatgattttgcaaaccctgaggggatttttctggtgtcattctgggggaaaagtttcaccctctgagacggtgagcaggcaggactctgagctgcagctgcttgtggccatcctggaaggctacctggaagaggccaatgtgccaggagaaggaaggacaggatgagtgtgagaatccttttatcagctgttcttgaagccagatccacccttagattctgcagcttcataggcctttcaggcttcagccagcacaagttgggtttctacaactcagaattgggactgatggtttgtactattactatccgcatcctttttcaggtaaggttgagtaacttacctgaagtcacactgtgagtaagctgcctaccaattggtcatgatcaaaactgggcaccaaatcactacttaagcaggacacatcggctaggtgcaccatgcacttcccattcaacttcaggcaactaagcacaatatagtttcccagcagctgaaacaaggcaacgcaacccagaaagagccaatttctgtgaggttgggagacaggagatagatgtcactctcaacttctttgagcccagtgactgtagaagaacactcagtgcctcactgcatgtgagagagggtggcatgggggaaggaaaagccatctctttccccagatggcagtcttgaattgaaaaagacccacggctccaggcactgtcaaatctggatggctcccttttaaattccctacatctgcagctattaaagaagttaccccaaaataacctaggagtttattaatctgtttcattgaagacagtcagccacttcacattataccaagatagattaggcagggaactgagagatccagaaaacatctgctacacaaaatcaaaattaatggtaaacagaatgcagttcttgatagctgaagttcacccagatgcagagaactataaaggggctattggaggcagctgccaattagggaccgattccacgggttttcagaaagtgaggctctagtttcacactcgggactggcaggtcatgtttgcttaggagatctgcactgcaaaggagccagagccatgctgagtgtgcacgtgatggtcacccccttttttccttttccctgaagacagcagcagccctcctctcccgggttccctcacagccttgctagaagccaggccaggctggacagggctggaacatgtgcgggagccagcgctgggaggtgggcaatgcaacatgacattggtgctcatccccaaactcgcagcccctaatcacagcacaatcacggacatctggaatagcttacagatcgtcctatgctcctcagagatggctgacaagggctgaattatcccagccatttgctcagcttactcaagtgttcgctcatggctgtaattcaacatgatgggaacagtcagagaaaagtaccggtttgagtagatgaattttggcagtcgcaatcagcattggccctcacagtggacacgggagtatcttagaaaggtaagggtggcaccttttgctgaagcttcagaaaagggtgaaattaaattttagatgtctggagggagttataaaaatacctgcactggaaagcacagagagatgcagccatcactctttcccatgcagctcatatagggaggtcccaggcatgaatatccagggtcatacggaactgtcctgaaggaggaatggctctgtctcccttggggaggcatgcacccttcccagaggacaccctatcagtctcgtagtcctgccacaatctttgctactgtgtctaccttcaagtcccacaaatctaacttggaaacaaagcacccccagcaagtccctctcagctctctgggcttggcagccaacataaggtacaaacacccttggatgtgatgaagcaagatcaagtcacttaagcaaccaccacccactaaagagaggttcagggcatcagagaggcaccagcccagaagcattcctcatccctactaaaaattaacatgaaaaggaaggagtctcatgtatgcagtgctatctgctctgtgtcacaggttactcaagggaaagggaggtaaagaacgtgaacattctctgaaaacatcagaacaaccaagaagatattcttattattgctgtcacactgttctgtacatgcacagcccatggagcacagtctggtgcctgggcactctgaggaagctctgcctcttcctgggctctctagggcagggtttgcaaaaggcactgcatggaatgcctgccctgagatggttaaaaacaacacaattaattttgttaaatcccacagaaaaccaagtttggaaaatgctgcatattacattccctgttgagagtgacattttgtctatgaaaaatcatgagagattctccagtcaaaatatcatcatcatcaacaacaatgaaaactaaagtttactgagtccaacattttccaagtgtattactgtcctagggccaccataataaaccacaaactaagtgacttaaaaccagagaaatggattttctcccagttctggaggctgggagtacaaaattaaggggctggcagggctatgctctctctgaaggttctagggatggagggtcccttgcaacttgccagctcatggtgtttgccagcaattctctgcttccatcatcacacgatgttctccttgtgtgtctgtgtccaattctcccttttcttgtaaggacctcactattggattagggcccaccctaatccattatgacttcatctttatatctgccaaaaccctatttccaaataaggttccattcacaggttctggtttaggactttgacatgtctttttggggaacaaaattcaacccataatactaagcttacttgaattttcttcagtgcatcagccaggaaaatctaatgatagccatagaacatttctttaaaggtgcctttccagaaccaaagggcccagtgcctcacttgtatattactgggaagggccagaatgaaaaggcaacacccacaaagcaaatgtgtagcttgcacttactttaagaaacaattgttgattaactactggccctgggctagagctgtgaggaatgtggggatgaagaaggcaggagggtctctgatctcaggaaattaacctgataggagcccttccctctccaattagatagggtaagctaaacacttcaagaaagagagttggaaaggatgaaggggaggtggatttgacaaggatgagggacaaggcatgcaggaatagtctaaggccagaggcaagaaagctagacagcatgacatctacggctggaggggaagagggggaaatagggcagaggacaggtttaaggcacacaatgcattcactttgcccctactgtcgctagttcccactatgatttggcttggactcgatttccactgctaacattagcccctctcacttctcaacacacatacttagtcaagagtttccaaaagtcacataatgtgaagttgcagttggttagccatttgtggccctaaaccttcaatggaggggatgctcctgagtcaggtacagtattgaaataaggcaaaccaaaacaggaaacctcctcaggttctgtgactggaagcttcctctctagacctgaagactttctagactctcctgggccttgtaagctgtgcagaaaaatcagctattactcatctgttcctctttcagtccggggtcgagtcagagctgggaaccaacccaggtgttcattgctagacaatatcttacttttctttgacagaaaaatagtttactgaagcaccatagtgcttctattctttttatacttgtacactgttctggagaagattaacaaccccacaacccaagtcagtgagtcagtgaattcccagacctaaaaatacttagaaccagccggcaaggtcccactccttttcttcctgccaggttgtaagcattgacgttacagcactgggctatttcaggaactctcaaacattcaactttgacagaaacaagcaagaaagacatcagtgcacaataggaagaaaaaagtttctgtgatgttagaacaaatttgctagtacaaacccacagtgtatgttcctaagtcaaccatttgcgaaggctgacacttccagcggtggagaggttacagatgaatggagtgcagcctgactacaccttcactcctcctctggacactctcattcttctgggagtttgaagtcataagttcactcagacctttttcatgcatttgaatagaaatacatggctcttttataaccccagccttattagagacattttcaacacaaggacagtaagattccaaaaaggttaagtttatatgtgattttacaatgcaaatcaattccaaacattcacagtcgggattctggcataaacagaatattattcaaagccaaagttcatgtcaaattctcctctccttatggctatttctttccaacttacatggtcacagtacccattgtgaacactactttccataagaaacctccttcccagctccatcaaccttcatccatttggttttgatattcaaacaatgcagtttgctttacatattgtcctatagttcagaggacatcgagtccgaagccgaagataatggcaaatgggaatgtaagccagaaagttcatcttagagtcagattatccagatcctatgaccctagggatccagcaccatggacagcagcacactaccagctggactcaatatagtgtgaaaagtttgtgttaccaaggtcccaggcatgaatatccatgtatcaaagcatgttgataacatagccattctatgtcttttgctgtgttgcataacacaagaactaatcaggaggcaaagcaatgttagatttagtagtcaatatagaatttgctaatttcttttagattgtctccctctttggagacagtaccacagagaaggatgtggtgaagggtaaaaccaaagccacattctagaccaggaactcattttcgtttctgatctcatcattctatccatgtaataaaaagatgattgttaatgattccacaaatcatacaaaaggcatcccttattagagactaggtattactgaaaatgaataagggaaacttcaatttccactaaaagatttctgaaagtaacacccatatatgtttacctcagagaccataaaacaaatgtgctacaggaactctggcaggggaaacagaacatcatggaactgttttcaaaaggaaaattaattagttatttctatttcagcttagctgaagctgtaagaaatctattcagaaatatttttcacagtggcatctcttcccagatattgaaataccacaaaccataggccattttttgtgttgttcacgttgctttgctgggtaaaactaataattattccaaacttcactcaagaatgaggcttctcttaagagaccaaaaacatgattgcgaatgagccagttcttcaagtatcccacctctggtacttgaaggtagaagtcatagttttcacaagcaaacctggccttcagtccatgcagtccctacagacaagtgctaagcagtcagcacccagaaaaggccgcatgaaatttcaaagaatgagctgcccacagtctgaagttcatcttagtttcagcaaactacttcaaaaatgtcaacactgaaaataaaatgggtatgagtgcatttttcctaccttctcttcttgtgacttcaaagcttctgggctcctgcaagaaaagaaagactttgtgttttctgaagaataattcatatgtacagatacttgcaaatatctcctctcttgttagtcacacatttatgaaaaggtgaacaatctacgaagaacatgacactgagcaatgttggtctactaaactctcaacatgtacatctataaatgtaaacaacttgttgctttgagggcttaggcaaaaaaaatcctgttaatcacaaagtttttaatgagcacagctcattctcagggccttccttatttggagtatgggctggtaccaagtgttaaggaagaccctcttccaggttgatgacccaccctctgcctgaactgtaggtgcttttagggactgaagaaaacataagcagatgggctaaaattatctggccagcagcaggttctgttttgtggtgctatggtgaagaccaccactgctactggatatgtcactgacatcacctgataatagattaaacacaatttatagtttccaaagggtgagatcctatgaacaatttggatagccagttcatgccactggactaaattaagcccttgggttttcttaattcaatcctatctttattgatgcttactatgcgcagggcaataagcaaagtgtttcagaagttacccaggtaaaactgagtacctgcattgatattcacagttgattagggggccacagaacaaacacaaattactgagaaatgaaagggtgatttgtcttgtaaataccagcatttcacattccagttggaaacataaggaaaagtgtttttaaaagaacctttgaaaatagcactgaagaacaggcagattttcagacaaaaatgggggagggagggtggaccaggaagagagaatagcataggaaaatgttgggtggtatgaaaattcagggtagctctagaagaatgaaaagtcctggtgagaactaatggggggaaagactagaaatgcatattgcagtttcataactaatataaagtatctccaattcatcataaacgacatgttttggataaaaagcctaaggttaaaaataagctgaaagtccatactagcaactaaagaagagaagagaaaacaccaaactgggactaccacctcaacaccgcagccaagaaggtaattcagcaacagtgctttttaaggtaatagcattgtctttcacaccttagcattcttgtctagcatcctcttgtcagaagggggaggcaatattagagatgaaactaagagggcactgggaaggttgtcctacccaaattacattccctgactgctacctttctactgagcaaaaagccctggtggagatcagtggaagatccatgtcacatgccaacagcccatcacacaaaccaaactctggttcctgaaggagtactcatcaggtaagggttcagaggaggcggcatagagatgacaggttaaatgcaggaaacataagccacagagcgtattttgcacaaaacaaacccagctcctcccaaactgttcctcagtaacctgctccaaggcctggcacctctgtttcttgaaacaactagtattcatggaacaggagatattcataatcagctccagaaaaaaactatgaaatttttgttgtggttacataaaatttataaattaatttagggaaagctgacatctatataatgttgcatgttcttatctaataacacaggattttaataattgtttgagtctacttttgcttctttcaagagtattttatagttttccttgtgcgtattttgaatatttcttttttgtatgtcttttgttatcataaatgggatgttctcttattatttcttccagctgatttttgtttgtatatttgatggcaatttaaaaatattttttatatttattttataaccagcttcttggttaaattttactgtttgtaatagtttttccattgattcttttggggtttccatttgagtatttatgtaatttgcaaacagcaattatcttatctcttctttccaattcctatacttccaggtgttttctcttgccttagagctttaaccaattctcaacccatgttaggcgttgtgttcatactgcgcacccttgtcttggcttttgctttcagaagaaaacctttagcatttccccattaagtgacaggctggcttttagcctgagatatgtttattatattaatgaaaccaatatacattttactgagttttaaaaataaatgtatgtgctagttgaaaaacagcttgttcctttactcatttgtttattgactgtttccctctagtggaatgtgggttgggatggcgccagtatctttttcactcttgcatcatcagtgctgtagcagaacagatgctcaatacatatttgttgaataaaaaataaaataaaataaatgtgttggattttatcaagtacttttctctggcatttaaggagataatcatatgatttttctccttagttctattaataggatgacttacatagtagatctcataatattccactacccctgtatttctaaaacaagcttttcttagtcataatatacttttaaaaatatgctgctggattctgtttattattttaaatatgttttacatttattggtctataattttttgtactgatattcataaatgagattggtctaccaatctcatatttttcttatcagatttagaaattgcccgggcgcggtggctctcacctgtaatcccagcactttgggaggctgaggcgggcggatcatgaggtcaggagattgagaccatcctggctaacacggtgaaaccccatctctactaaaaatacaaaaaattagccgggcgtggtggtgggcgcctgtagtcccagctactcgggagtctgaggctggagaatggactgaacccgggaggtggagcttgcagtgagccgagatcgcgccactgcactccagcctgggagacagcgagactccgtctcaaaaaaaaaacaaaaaacaagaaattaaaatgaaaccaactttatgtaatgaatttggaagttttccttttattatactctgaaataatttaaataaaaataggattatcttattttaaaatttttttattcttgagacagagtctcacactgtggccccggctggagtgcagtggcacgatctcgactcactgcaacctctgcctcccaggttcaagtgattctcctgccttagcctcccagttcttccacttcatttctcagagactgactgaaagggaggagaggttaaacttgtccaaggtctcatattttggtcggtggccagctaagatttaaatcccaaagtctgattccaatgcctatgcacacagcattccaactttaaaaatagtcatgatagttaattcctagggacattgtgaaaattttatgagataaacttcttctttgtgccataaaaaagtagcttgtatgagactaatccttctgctatcaacaattataaaagtggaattaaaaaaaagtttttgaaggcatccaacagcaacaaaagcagccagaatttaaaggaaagttatgagagaaaagtccattgagatgagccccatattcactgccacatttcccctttgcgacatttgctgttttgcatagaagccaaacagaatataatattctagaacttagagaagtctctctgagatgggaaataaacatcagagtgcaaggctaccaaagaagccagaaaatgagggtcagaaaccctggaaaaggaaaccagaaagaagtgagctcaacattttcggcttccccttgagttatatgattatgcctgagctacacacataaagggcaaaaggctgagaaacaagttaaaaagtagccttgaacaagaaaaaaaaaagcctcaaataataaaatctaagtatagattttgaaagtacatggtactaaagagacaaaaattaggctttccaagaaatagtcgccctgacaaatgcagcagacttactgctaagaccatatattctcaaattattcctattcttgagtagataaagatgatattccaggactctatctgtctaacaaggaaaaataaatcctctgtggaaatctataaagtgatccacaggctttacaatttttcatatataatctccagcatccagtctaaaattaccaggcatagcacgaaatgggatcgaatggctaaaatccaagaaaacagaccacagaaacagagccacatgttatccagatcttagaattcttaggcacaagctttagaataactatggctaatatgtttaggaaaataggagaaaagatgctgaatttcattataaaactagaatcgaataaaagactacacattgggtacactgtaaaatgctcaggtgatggatgcaccaaaatctccgaaatcaccactaaaaacctgtaaccaaacaccacctgttctccaaaaacctattgaaacaaaaataaacaaaaaataatcaaacaaaaatttcataactgaaaatgaaataactgaaaaattcaataggtggatttaacaacagattaaacacaactgaagaaaggaatagtaagatggaagctagatcagtaaaaattaaccacacagaagatctgaaaggaaaaaagataaagaatgaaaaatacagaaaaagtatgagacactgtaacatcatgaagagttctaacaagcatgtaattaaattttcagagtgaaaattcagagaaaatgggcagaatcaatactgaaagagacgcttgttgatacttttccaaaactaatgaaagacatcaagccagaaatttgggaatctccacaagccccaagcaagataaatacaaacacaaccatacctaagtactcagtaaaatagttgaatattcaaagacaaatagaaaatctttaaaacagccaaagggtgggtggtagagatggggagaacattgcctataagggagcaacagtaagtgggatagctgatttttcagtaggaaataatggaaccagaagacaatggaatgccatctttagtttttaatttttttaacttttatttgaagttcaggggtatatgtgcacatttgctatacaggtaaactgcatgtcttggggatttggtgtaaagctcacccaggtaataagcatagtacccaccatctttaaaatttgaaaaaaacattagaatccaatgaaaatatgggtattcataaggtaaaataaatgaaggtaaaatacagatatttagacaaaaaaaccctgagagaatacattgccaacaaattaacactaagagcaatactttatagcgaacttttaaggcaaaaacgcagaaaattattcagatgaatgtatagctatgcaagaagaaataatgagcaccaacaagcattaaaaaaaccataaaaatacatttcggctacttaacacaacaataatgcactgtaagataaaaatatttgtagaactaaaatacatagtaatatgatttttttaaaaaagatcaggaggtcaaatgagattaaagtgttataatgtcctagtactgtcccaaaaatggcaaaattagtgctatgacaccaaaggaatgaagtaaccaaaactgtctcatccaaaagaagacatgaaaggcagaagagaaaaggaatatagaacagagaaaacatgggtttatatttaaacctatttaactataaattggctgaataatcccattaaaacacaaggattgggctgggcgaggtgactcatgcatgtaatcccagcactttgggaggctgaggcaggtggatcacgaggtcaggagatcgagaccatcctggctaacacagtgtaaccctatctctactaaaaatacaaaaaattagacaggcatggtggtgggcacctgcagtcctagctacttgggaggctgaggcagaagaatggcgtgaacccgggaggcagagcttgtagtaagcccagattgcgccactgcactccagcctgggagacagagtaaggctctgtctcaaaaaaaaacaaaaacaaaacaaaacaaaaaaaataaataaaaaataaaacacacaaggattggcataatagagaaaacaatatccaactatatgctgcctacaagagacatatcataaatatatgtttacaaaaaggctgaatgtaaagaatttaaatgataaaccatattaacttcaaccaagaaaacatggctatagataaagtaggcaagaattattatcagtgataaaaagggatggttcataattagaaaaggaacaacttaacaggaatatatagcaattctaaacttgtacatacctagtagcatagtctaaatatatgcaaagccagaactcaaagaactaagaggagaatttttttaacccacaataatggttggaaaatttaaaaaatctctgtctttaactgatagaacaagtagaggaaaaaagcatcagtaaggatatagaagagttgaacactataattttaaaacttgacctaattgacagacatcaaacactgtaccaaatagcacttcatttcaagtgtccattcgagatttataaaaattggccgtatgctgagccataagcaagtttaaacacatcatggcaacctcatggaaaaaatgttggacgtatcttagaacatacataaaaatcatttcctgatggattgtagaactacatgtgaaaagtaatgcaactaagtctctataagatatcaagagtatcttcatgactttaaatacataggtgaaaatttcttaaagaggatgtgaaaagcaaaccaaaagaatatctcagactttattaaaattaggacttctgtttattaaaagataggatcaagacaatgaaaagggaagccattaaggaaatatatttgcaatccatatatcttacgaatgacttattgagaatatataaaatacttttgcaaatcaataagaaaaatacaaataacctaattgaagaatgagtaaaacatttgaataggcacttcacaagttgaaaccacagtgggatactgctataaaccacatataatagatgacattaaaaaactgttaatagtaaatgtttacaaggatatgaaggaactataatttttataccctcagaggaaccagcaccagcaaaactttcctcattggtctgagtcccagtatggagaggctcctcccctggagacagtagtgataaaggtattccttcctgcaggtactgctcttaactattgcagtgtttccttttccaccttcttaatcctttaatatctgtttaaccaatttcctgtaattaaattatgttaaaataactattgtgacatctatgttcctgacccaacaatttaactcctaagtaaatgtccaacagaagtacattcatgtgagcaccaaaatgcatgtataagaaggctgaatgcagcatgatatgtaatgcaaatgtccaccaatggtggaacagataaactgtggcatatccatacaatggaaaacttcactgcagtgcaaaagaaaaaactctgcaacatgtgataatgtagctgaatctcattgtcatagcgctgagggaaagaaagcagaaacaaatagtacagtttataagattttatttttataaatctcagaaacaagcaaaaccaatctctgatgacagatgagtagtaacctttgcgaggataatgaccgggggacacagaatggtttgtgggatgctggaaatgttctatattatcatcttggtggtggtcacatagatatgttcacttacaaaatattaaccaagtgctacactcagaatatgtgtctttactatatatttgatatgctccagtaaaaatttttaaaataagacaaattacccaggagtaatcagaagtttgttaaatagagggaacaaaccccacttttaatttacagatgaagaaagatgtactgagggaaagactgcaacttgctgaatttcacatgagaagtggccacatcaggactagactcaaacctctgaggtcctaccactatactctacttcctccaaggaaatgctcaacacacattcgtgaaaaatatgacagggattaagagtgggggccagctgtgcctctgtcacctttgttgaattatttaacatttccttagtctctgtttgttgatctgtaaaggcagaaatagcacattccacatagagtagttgtgatgatcaaatgaaataataagcttgtcccatgcttagcatggtgtccagcacacaggcagtcctccaacatgtgccaccatcatcaacaacattaccattcatgaaaagagctaagagagggagacgatcagattatttttgggaggtaaatgagttcaacggcttcctcaattattgaggctaaataagaatccatctttccagtgcttaaaaaagcaacccctcaaaagctgtagcagaaatgtaaggagtgaaattcattgacataatgacaccaaggccctggatgcattgtctaaggaagaaattattttctgcagaagcttcaaaccagatggttataaatgagacttagtgcatgggcattacttaatgactaaatttctttaactaaaaatctaattttattatagtataaatcacactttcttgaagcagggaattaattttagatttttcattcactgctcataacctttctacgagtttgacagccaaatcatttaaaatgtcatttaaccaatacaatacaacagctttattcctcattgtgcccttcctgaatccgttatctctcactataatgtagaagaacttaaataaaaaattaccattctataaagctgtattttactatgcagttaaactacacaatccttatttttgaatcaatataatatgagtgctgagcaatatttttcataatccaaaagccgattacagtttctcagctaccaaaaaacagtttgaaggctgctgaaagagtataaatgagcactctcaaattctacccctaggtccatcccatgtccatcttgggcacagggggtgaggctctggaaaaggatggtgaggccctgccccagatcatagtcacgcctctccatctgtgctctcagaggtctttggttagggagtaagcctcagtctgtcacccagaatattatgggattcactgggaaaatattggctatgtgggttacgaaagtgggggatcaaaagcaaccacactgagaagagaatgcaacgaaaaagtaaatggagtggagctccatgtgaccagatcttcgtagacaaagcagaatggagtggagctcaacgtggccagatcttcatagacaaagcagaaaggagtccgctgtacaaggggcccggcctgaggaggtccctgtgccagtgtcctgaagatgggcccctgactggcagcacctccatccagcagcagaggggctgaggaagctcctggcttcagagttcctcaggcctcaacttcctgaagacacacaaaaggaagcccacgtgtccaatttatgaaccaattagtacagatgagatggaagctttgccatgggattcatcgctactgaaattctgacatctaagttctaagtttttcatatctgagatgttcttaaaatgaatgcttctttaacaatctttcttacaatttttcatttattcacttgaattttaaaaacttgactctaagcaggttcatttttgctagcaagacactattctgcaattaaaatcttcacttggactgacaaaatacagctaaataaagtggcgccttatgtagcatgtattccactgctggctcccacttactgtgcacacagtaagagttttgcacactttatctcatttatatggctgagttaaaggcagaaggaaaactattgagttgttggatttctcagcacaccatgtctgggtcttcaaagccagagaaggtgagagaattaaccctaaacccggggctagtttgaaagccaagctgaataatccagcaaagaacaggatattctgggggagggtctaaacaccccctgcttcctccagttatgcagagcttgctgcaagtgctcatgaaaaacaccgaaggggtgctggctcttgagaaatgccacttaatcgaggggtcagtgttcccctcctgcaccacagagaacagtgtcagatggctctggggttagagagaggtgtgtgtagccctggtagatgggcttactgccttaaagaacagtcaaaggtgggggaggcacagctgccaacactaaacctttaggggcttagatagctgagggagtttgataaaggccaggggtccctgcacctttcagccagccctgcctaggagttgcccaatcagcagaggctgagcttgcctttctcatcttcccagaagaccagatgtgaaggggagagggctgggcatggccatataggcaaagaatgtgcaagtctcctttgagcccacgagttcgagaccagcctgggcaacatagtgaaacccccctctctacaaaaaaatatgaaaattagctgggcatggtggtgcctacctgtagtcccagatacttgtgaggctgaggtgggaggatcacctgagcccagggaggtagaggctgcaatggagcgccactgcactccaacctgggtgatagcgtaagactctgtctcaaaacaaacaaacaaacaaacaaaacagtgcaagtctccagcactttggggctgaaacagagatagcacagcaagcaagctcgatgtcccctctattgcctatcttacaataaatgacaataaatggatcaatgtaaggaaaccagtattacatgaggctgggaagtctaaaataactaagccagagagtttaaagggaggtttatcaagacaaaaggaagagatcatgtcacatgactttttaaaaataccaaggaaatgtctttactattaaggtactcttttactttactaatttaaaaaagaatcaacatgataaacccatcaatagcttcttgtgggcagacctgggaataccaactttattatgcccatgagggcaaagcctccagtagatctgaatcacctgattgtttcagtagctgctccaccagctgcaggcctgaggaagccacccggatacttcccactccagtttgcccatctgtaaaacgggcagacccgacagcccagccaggacaattgaggcgatatctcagaaacatgggcagaatcccacagagagttctgtccagggctttctgacaggaagcaaagggtggtcagtgaaggagaaagctgtgatactctaaaaagaaatggaattaatggtgattaccagacactagacagaaaagaaagcaaaaggataggtgcccatcttcagaaattaagatgatttggaaatattatatgaggatttagtgattttaaattctagatatcatttaaagctttatgctaaaggttattcatttacaatttaaaaagaaaagttagccctgaatttaagacagtctttggtagcaaatccaccaatatgagtaaacattcagttacatttgatgaaataaatgtcaataactgattgatcactgctccttgttaaacataatcgcctgcacacagccagattaagggaccaagaaggcaagaggggaattttccagttgtatctctcagacaacccaacaaattaaaaactaattaactttttgatttggaaagtaatccacatctctcagaatgagcaatcaccacgtccaagaccatcacaacagttagcagcatggggctctaactcagcaccctgaggaacaacctcattaacatgtcattgctatttccactgacactagcagggctcagcctaacacaggcattatctgcagagctgcttaaccccaaaagcaatggtcatactggactttaactacaagaggggtgtccatctcccccagggtccacgtctccttcatgtcttactgcagcacagcgcctggcgtagcgtaggccctaaacacattctattgctagaatgaaatcagattatcccaagatctcctggtaagaatatggaggtgagtgcagtttcccagctggctcacggaacatactgactgtcactgaagcctgacgtgctctatttttccttttgtaggtaaagtttctacagaaacacagggacagcctgtgatgcgttcctcattctgagacgcttcatgtctaccagctgtcgatcgaacaagcttctttcctgcactgacttcattccagcagtccatgatccataagaaaatcatgacagtcttgtaggtgtctgggggaggagagaggacagcaaggacaagtggctcttgagaggaaagggggaaggagttcatgtttaaattatttattacaccctccaggaaccatccaataaatgatacaacttaacatccacctgtttaacatgatattccaatctgctacttttctttctgccaactgcaagcccaagatgaggtttagaataacctgtgcctagaaaattaaaagacaaaaaaggaagaaagtgtgccctccagtacagtcctcatgtctgagtctatttttcattctttgttttgcacagaattagggagtcacagatacagacggtctgacataaagatgcaaaatgtgccagagtcatggtggggccagcggtgattgatcaggctggagcctctgagaaggtgagcaagctgggaaagggccggctgggagcaggactgggtgcaagtggcgtctgattgggataagctgaaaacacccaaagtggccagtgcttaaggtcaggcacaccctcttctccaaagggacacttgaagatcccttaatccaagacttccaaccagaaactgtcatctgacacagcaataggtcccctccccttggatcttcctgctagctagtgttccctctgtcctcctgagcatctcctctggcccctcttcacttccactcccatccctcacagcctctgtggctcagctttgtggatgccttcccatcaggtcctagcttgcaattcccacctccttgaccctccccaagaccctcagccccatcacccaggtctctcagcagagctcttgacgggcctcctgagcaattcatttcatcatcccttcgtttgttcatgtgttcactcattcagtagatatttattgtcctggagatgtagcagtgccaaggcagccccagccccagtccttatgaagcttaggatctcactggaagaaacgggcaacaaacaaacacacaaacaaaggaaatgtagagaatatctcatgctaagaagtgccacggtgcaaaatgaaacaaggaagggggatagactgccacaggggaaaggatttgctgtgtgacatcaggcggtcaggccgtgcccctcctgggggctggcactggagtaggtctctacttcaatacccaatctgagcacgtttgtctgctcaggactgttcaatccttcctgcccaccaggggagcctctctcttcactgtcatctccctactttgtagctgtggcaccagcagtaagaactagcaggggaagcagcggaggtcctagggatggcagtagcatcccagtagcagcttccatttactaagcaattacccacgccaggctccatgctaagccctctccacacccgcctccttcaatctgcacagcccccagaggaacttccgactcctacccacactcatgaacctccaccatgtgtgcctcactcagggtctggtgattttggattgctgtctgaataaatcattggtttgggctcccacaggctttttgtacagggaggtaaatccccatacacactttgattagaaggcactttcattgtaccactataacacttatattaaaaatggaacttaaagtagtttaaattaaatgagttatatttaattaaaaaggctttaaggcacaataagaccgtttttcaattttcttttacaacagagtcaaaaggaagaaaggcccccagtggtcagcagagctagattggtgtttacttaggacctggcccatctgagaatcccaaggaaaatccagttttattccctgtcctctttctgttcctcacgtaggatgcaccatgaacttcagtttcctcgtctgaagaggagattgaaaggtgctacctataagattgtcgtgagaaaggaatgagggagcatgcagacggcatgcaatgtcactcctcaagtagagaaatacctgccccacacgtgccacatcaggaatcacgccagccttagccacccacacctcccaggaggggccttgtgcctgggcaaaggcacagggaagctttgtcccctgcagcctgaatcagttatttcccttgaggagtaggtgctgagaaagacaatgaggacagaagtgggcattttgcccacacttctctcataggctaacccagcagttctcaaatggggacatttaaataatccagagtataggccataccctaaaccaattaaatcacaatctctgggggtgggacacaggcatcagcattttttgaagccaccccagtggttctaatgtatggacaagtttgggaaccactgggttaatcatgcatcttaacaccttacaaactcttgccccagtgggcctggccagtgctctgcaccatggtgcccagctgcctcagacaaacctctgcaggtgccagtgggctggcagggttctccaatgagggtgccctgttactcccacatatggggaagggtgtcccttcgtaacagagggtatcagctgggtgtcacaggcacagaaactaatgtaaacagtggtgccagtttctcttcccagcaagtcagtggagccagaggatggcttgggcaggcccacactcgccttccatgaggaccgatgccagctcagtatccagaactcactggatgcaggtgggaagagtaggctcaagcagccaggactgagaagcctcctggtgacatggagaatggggccactgggcttgcagtgcacgagacacaaaggggctcacctgcaccccagacccccggcactgggtcaccatatacatggcattaacctccaggagcttcagtttcctcatctgcaaaatgaggtagggtagtgtctatgagactgcagtgagagctgagagaggagggcaaagagcactcagtatctggtagctgctgtccacttgccaatttccacccacaaacagcatcctggttgtgcccccagcaatcagcatagcacccagcctgaaagaagtgctcatcattgtttctgagactctggagtggggaggggtccactagttctactgtggtcagtaggcaacagctgggagacacaggttgggggaaaggcatctgttggtacagtgtcaacccatgggccatggccaacccctgtcaacactgctccctcacacctcttcttccttccatgctaggctcttacccatgactttctctcagcctttggggctgcccattggctcatttgttccaacccacttgaatgccaggatgccttccacttggtcttctgcaggtatagatacctcatctgtcctgggccctgtatgtccctgggctatccctgtcctgccctttgagatgccctcctctcctcactcatgggcagctctgaccactcactagccatggccatcccatagcgcaggggtgctcatccacctagatgaaaggggcatactctgaaggagccaccacagctcaaccaatctttagtactcagtgtgcctgggggtgcctgacacttccacctctaaggaggaggctgtccctccatggcagcacctccagcagaagtacatgagcttgcctctggcctcatctcagcagcagccctgctgctgtctccagcggccagtggaagagtcagcaaacaccagcacattcccactgggtttcctgaccctccaaaagcccttcacagtaaccacagttggtatcacagtaaccaacttggctgccaatgctgggaatcttacctcctccttaagatcaaggccccaggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgcgcaccgtgcgcgagccgaagcagggcgaggcattgcctcacctgggaagcgcaaggggccagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaatgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatggaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacctggaaaggaacaaccagtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaacatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagtaaacacattcaaaagctagcagaaggcaagacataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacacaaataaactagaaaatctagaagaaatggatacattcctcgacacatacactctcccaagactaaaccaggaagaagttgaatctctgaatagaccaataacaggatctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccgaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaacacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagacaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaatccaagatggattaaagatttaaacgttagacctaaaaccataaaaaccctagaagaaaacctaggcattacctttcaggacataggcgtgggcaaggacttcatgtccaaaacaccaaaagcaatggcaacaaaagccaaaattgacaaatgggatctaattaaactaaagagcttctgcacagcaaaagaaactaccatgagagtgaacaggcaacctacaacatgggagaaaattttcgcaacctacgcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatacagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaagatcaaggccccagaaccttgcttctgaaagggagactgctgtggtcaacccttaggaacttcccaaggccaattcttaaaagcagaaacagagaccaccaaatatcacacacttagtcctccacccacagacactgccctcactgtcccatgtgagggcagtagctgccaagtccccagtggaatcctggaagaagtgcaaggaaatagccaaaggaatgttaatatgttaattctcagaggttcagtggctgcctgatggtgaaagaagagaaattgttggggaggagggggaataggggcagaactcatctctccccacagaaggtcaagaggccacccaccgcccagccccagaagaccacctcaaactctgctgccctccaggaggaggggatgcctcctctgatgtgacgttgtctgctttggccttccaaagctcaatgtcatcaaatgtcctttccctagattcaaaaatatgtccttggggataagagcacaatactgtggttaggaatacatgctagatagtcagaaagccagatgcaaaccctggctccaccacttactatatgggagatctcaaacagctcacttatcttgaagcctcaatttctacatgtgtaaaataaacaaattaataatacctcatagactctctttgagaagtcaatgaattaatctacttagtgctttggcaaaatgaaagctgtttattaattctatcatatcaatagctatggaattaagaaattcatattaggaatgagaattcctattgggaatctcctctttatttatttatttatttatttatttatttgagacacagtcttgctctgtcgctctgtcaccaggctagagtgcagtggcatgatcttcctctttattcttataagagaaggataagaggagccattcagacttccagcccagagctccagatgacactgccccctttcatcctcaccctagagatgtccctggttccctagccctctctaactcttggctacacagaaagagatatcacaacaaaaaccaaatttttaatgcaataagactttgtatctagctgggagcaaagctgagattcagaactggggaggtggggagtgcatctatctcatcttgtcttccatgatgacaggccaaattatcccacagcagctcaactattttgcttgctggatttggcagggtggtggaccttctaagaagaggcatctggtcaagccatgactcccctcccatgtaacccctctttctttccaagaatgattccagctaaacctcaaagcagctgcactaaggagctccctacagccacaggatatgtatctctggagtcacagggccacaactgagcaccaaagcctgctcccctttagtgagtttgatgggtcaggcgtggacacaggctgccttagtccattttgtgctgctataacagaatacctgagactgggtactttataatgaacagaaatgtattggctcacagttctggagtctgggaagtccaagattgaggggctggcattttgcaaaggcctccttgctgcatactcccatggtgaaaggtcaaagacagagagcaagagatccaattcccagtctcaagcccttctgtaatcggcattcctgaggatggagcatggagccttcgttacctaaacacccccattaggcaccatcacccaacttgtggcactggggattaagtttccaacacatgctttttggggaacacattccaaccatagtaccccaggagccaagggcactggcaccaggatggaggggaggaccagggtagtgactggcaaaatgcaagtcggcctgtggaggccaagcctgttttacagcctgtctgcagggacatcctaggaatggataagttgggcttctgagctgcccagccacagacaggccgggttggtgaggtagggtatggcgagggtgctgacaagacagggagaggaaggcaggcaaacaaagcaggggagcaaagatttaacagcacaaggcaggccttactgccagggccaacccctgctctgaagatccaaaaatgcaactccataaaatgccccatgtttatacaaacttggctcacgtttctctgtgtgcttgctgagaggtttgaggctggctctgcagcctcaccaactgtcctccacccacaataacctcctgccactccttcacaagagccacccagcgctgcacccacatcctcccctcagagcccctggagggcccctcacccactgggacctgcctcctggccacaggcaaatggatctgggaagatatttccccaagctgagccaataaggctctgccccttgagaacctgaggatacagacagaactcaaatgagacagtctggggcccagagctgcagcaagggctacactcagagctctctggaaagaccagtctctggagagaacaggcagaggagggagaaatggagaagggagacagtgtggctcagaagggagttgggagacagacttccaatgcctctaagcctgagcccatgaaggcatcctgccattggctttgggagaaggtctggggcctcatgacaacccttctttgtacatgagcatgttagcaggcgattctgctcctggccaccaaagcgtccctgatgaatcccctggctcacagacccagatacccaccttaaccaatctgttccgttttcccctcctgacagatatggccctattccaccctacacctagactctgagggttactcctccttaaatactctaatactctgcccacccagatcctggtcttcctctccaagtacctctgcctccaagaggtccttcccaatcccaccttccacccagcgcatttctgtgctaaattctcacgtcacccacggtttggcctgtgctgctaactaaatatgctttgtgctgcattcgccgctcaccattgtgctcaccacattcttaaagctgtttgtgatgattctttcttctttctcataatcccacggtgagatatcagataagaatttcttgtacagtgcagttcatgatcatctttacttgtaacacaagaacagtcattttgaataaattcagatttaaattatatataccattctcatctggaatggataacgaatcacagataattttgttctagtcagcatggtcataaaagtgtttctgttcctaagaattactggacaactggtgctatggtttggatgtttgtcccccgccaaacctaatgccaaaatttgaccctcagtgttgggggtgaggcctaatggaggtgtctgagtcatggagttggatcccttaggagtggcttggtgccatccttgcagcaatgagtgagtcctaccctactagttcccaagagagctggcttttaaatagagcctggaacctctcactctcaccttgcttgctctgttaccgtgtgatctctacacacacccattccctttcaccttctaccaggagtggaagcttcctgaggtctcaccagaagcagattctggggccatgcttcttgtacagcctgcagagccatgagtcaaataaacttactttctttataaattaccagactcagctattcctttatagcaacactaaatgggctaagacaattggccacaatcaattggaccaggaaggatacctggaccaaggtgcaactctacagcaaggaataagacctccaataggacagttttggccaccggggtggtagtgtcacatgctgcagtaccctaagcaagatgaaggacgacagaggaagctgggagtctctaagtgtcacccacataggatagacacagtgctgaatgtggctgccctgtgggtgtccagaacctcaacagcccctttcttcaccctctttcaacaccacccctggccctgaaacttgtccaccactaataatgagcacccacatcctctacactgccagcccaagtcctctgaggagagcttaggtgtcactgagccaacaagaacacagccatatcaggtggaaccacttcaggggagaggtcccagagcagtacaggctctggtggataagttttgggagggagtgttgaaggacggtaaaggagggggctggtggaggttctggacaccagagggctgctgcattcagcactatgtccatcctatgcaggtgacacctagagacttccggcttcctccagcccccaacccgcactcttaaggactttagaacagctgagccaggggccaggacaaacctgtgataccagatctgctatcagccacatgcacctggacagggaatgtctggactatgagcacaagtgtcctgggaccaggcgtggggaatccgggaggcagatggacttctttctttattaagatgtacttctttctaataaagatgtacttccttctttattacttaataaatatgcccacttttctttaggctaaagttgagatcttaatttcgacattatatacagactagaaaaagatcattaactaatgtaggtgattccttctgctaacttggaatccattctgaagcagctgattgctcctacctcccacccccaccccaatggccctcaagcctcaaggatagaatcacaaatcccatttctcttcaaccacttagccagccttagtacagggccaggcacacagctaggtgctcagtgggtgtctgttgattactaagatttaagtcaaccagatgtcccgattggccaagccagcccagggctcagagaccctctaggtagggataagagaaagtcaaatgggaatttctgcttcaggacacaaagatatgatcctaagccatactgccaggcatgaacactcaagcatgaagcagagaagcctactttgtttttattgagacagtctcactctgttgcccaggctggagtgcagtggtatgatcttggctcactgcaacctccgcctcctgggtttaagcgattctcctgcctcagcctcccaagtagctgggattacaggtgtgtgccaccatgcccagctaatatttttgtatttttggtagagactgggtttcgccatgttggccaggctggtctcggactcctgacctcaggtgatctgaccgccttggcctcccaaagtgttgggattacaggcatgagctactgcacccggccagaagcctgctcttcactcttcaaatgctaatatgagaacagcagtaacaaccaaacagaaaatagcagaggaagaagaggaggcaccatggggcatattttagagccactctaattagagtatctgcctggcaggcctctcccgtttgacacctcccagcatccccacatgaaagcctacttacctggaatggacattcaaaatgtggcatcagcagaaccaacagaaatttgacatcttttctatagagaccaaagttttcaaggacgtttaaatgcaaggccagaaagagaaataaatggaaaaagagttctgttctctttacttagagagcaagctttaaatgatagcagagctcaaacaagctttcagttcaattgtcctaagactggcattaaggaaagccatcaggagtcttatacctacttaatgacattttaaaagagtagttctgctcctttctgccctctgtgaggatggctggcaaccacctaccccggagccacagactatttctactgaccctgaaaattctaagcacaaacaaagcatcctgcatttgtttgactttacatttcactctctggattcatggttttggcaagggtctggctgcctgccagtgatgctggcctctgcagaggaaacagtcagagccaagcaggccctcaaagccattctaggaaggggatggcaactgagtcagggtcccacctgttcctacacacatcccatacgattctctgaagcctctcctggttcaagaagaaagttaagaagatttgaaactgatgggattctatcagatgtggaagcccaagggagtccagtgactatctcctgggatttcttatgtaaggagtcccaaaactcaagacaccttgtccaaaccccatacgatgacaaaaggaatagtaaaagatggctgactcgttcacttattcaacaaatatctgaacatcctgctgtgtgccaggctttctggacactgaggatatggggcccagtcccaagatatttaccactccactggaaagaggaccctcccactctgagggctgccttgctacgtgatatgtggccatggccagcagtgacaagaactgcagcagctgaagttgacacatcagactgtggctcaggaagggcgcacagtcttcttgacagccactgactgaggttctgggatgacaaacacaaaaccacagctctgtctgttgtgttctgtggaggcaatctgtgccgggcacctcatgtaccatcttagtgctcatgacaaccctgaaaatggtattgttatattgcctgtatttcactcgtggcaaacctaaaggctggagagggcgattcccttagctccaaagctggctagggaacaaacagattttagcctccggggccctctgagttgagggtgcacttgaagcaaaggcagggccggggatgccttaggcggcagcacaggcaagaggcaaagtgatttagccccaacaggaaaaaccaattgtggggttttaaaacaacaaacatcctggaggagaaagtggcaacatgaaacacacaaggtgagagttaacagggttctatggtgggggaggaggacagcagccatttctcccaggagcctagagagccgtgcacatcagcctgcctataccagcagctagccctgccaccagccaagcaggccaccagaagcactgaggactttcagcctgagcaggggaagagacgtcctctgaaaaagcaggccatgcttcaggggcccaggcccctggctggggctgaagcgtgggttgtgctggaggcgtctgtcacctctgaggctaggccaactccctcacaggtggggaggcgcttctgtcagctgcatcacagactcactggtggtctcactgattctctggaaagggcttttgcaagaaatagaatatgacttccattctcaactcttaaaaagaaaaatacacacagttttcaatctagatcccaaataacacaaaaccttaaccttcaaagtattttaacaaaagcaacaatggcagcttccgtctccagctaagccctccagaagggtttcgatttgcacccaaggccctcttggaacaaaggaagaaaagccaagggctcagtgtctagacacaacatcaagcaggtagacaggtgctaccttagcccggtcccaccgaccaagggaagacaatgctctcagagtctcctaaccaaagcaagcaccagcaccagctctcccaaccccaacccctgtgcaagatcaaactgaaactcaccctgtgattgagggaagacctcagccccgcaggccactcacactcattcttcacctctgccaagagcacacactcctggcaggagtaaaacaaggctgatttttattaggaggaaagacattgggtttctcttgttccagaccttcctgactgaagggaatgccccaaaggatggctacccatcaagagagaggcgaggctggtggacagatggcttctcagccacctggccacacttcctccccccaacaccaatgtgccagcacccaccacagtgttctcggtgtcgcctgctcagagcactgggcccatatcctcccacatcctccatgtctagttccagtatgctccacctcccaggtggctggtgacaagacaaagcccaggagccagtggcagagaccacagccatggaggcagaaggacaatggctctggcttggcaggcctgaagagtagagcccactcattgggccttgttagagcctgcctgacacaaggacgacatttacttccatccaaatgggaagcaaaagcaacaacccacagggtgtaggggataaatcaagcagatgattgggacttggcagatctgtgctgccaactccccgaaaaatagaaattggagccccatttacaatgcacagcctgatgtcttcattacaagggtgggaagtttcctacaggagtatagataatttagcaacagaggaataaataaagtagttagacaagtaaatgctaaattaagaggaagaaaaataatgggtttctgtgaactcataaatgctcattttcctgggtcacagaacttttcagggccaattaaaattgtcaactatgatctcaaaataccaaagaggcacacagtgcactaactggtacagtgtggaagggctggctgggagcagtggagaggacacaaagaacaaagacagtgactttccctgttcaaggataaagagaaaaacaagactccaaaacagctcaccaatgcagcaatgctcatccccaaaacaggctggctgggcctagggacagagatgggataggacaccagaaggggagccacggtggtaagcaagaagtgagtgcgctgttggtccttggagcagggggtgtgggctaagcctcagcatttaaaatcacctctttcagaatttaaaaccacctacagacaagccagggaggagccacgggttccaagagtgagagttacctgtccagctgcttgaaaacaggtgcaaatgaccctagaaccaaggttgtttaagttcatctttcccatcacctacctgcccactaagctagtctcatcaagctattttccagcatgactgcagcctgcccatttctctcctttccctgactgcagtcagcatcatgtcagcaagaactaaaaaaaggccagagtcaatccaactgggattctccttgtgtgtgtgcatgcgaggaggcagggggctcctctaaggcttttcttcccagtgtcccccaggatctgaagtatcagcatcacctggagctcagaatcttgggacccacctcagatttgctgcattagaatctgcattttaacaagatcccagaccgttcacaagcacattgcatctcaagaggtgctggcacaggttacagcacaccccattctgcaattgggaatgggttaatcccaatgcccctgagaccttgggaggttctgccaccatcatttgccttgaaaattataaatgtactgataacgtctataggtgggaggttgtgccctcccagttgtacctgaaaaacgaatatccacatcctctgactcagaataatcagcagaaagccctggctaagtgttaggggcccagagaagtggcccccacatcaaccagcaccgcacctgcagaggaagttctggatccttttgaaaggagtacgtggttcggttatcccagggtccacggccctggggagaccattctcgcctcttgctgagagaccttgcccagggtctcatcttctttgaaagcaagtcaagtactagaatttgcaatggtgagtatcacaagggtgatgtggcagaaaagccatgagagatgcacacgtactgtaggtgaggcttaagaaaatgcgaacgtccagcttggacccccgttggttcaccgggaagagggagttccttttatttatgcccacaaaccagctgagggccagggtgagtacaaacaccaacgggcagatctcaagccctacagacgaccagctgttcttccccagtaatcagtcaaagagcacagtcagggttatgggtggtggggagaattttatcagaaagggtggttgggggtgagggacactagcgttaagacaatgaatacataagaacagtgaaagtgtttttgtaaaaatcagtgctcagtcttagcagcccaagtactactgaatgcccagccaaggcggaacgaagccacggagcatctaagggactctgcaatttgaggttgccatgcctcgcggggacaggagtgtcatgcctgccatcaacacttgtagcaaggggaaggggccggtcagtcagggtaggatcaatgctgtcttaggctgacccctgaggttagggaggcggggaatcatgtttaagttagctgacaccactccacatatttcttctgcaaagactttactttgagagaatttgcaaatactgaaaacccatggtgtctgagctcaaaacctatctctggtctataagcactgaggcacatgaggtgacaatttaagaaagaatcaatattaacatgtacaggtatgtagtacgtgactatgtatatgccatgggtaagagtcgtttagaaaaagttcagtaaaatgcatgaaagacgtataagaccatgtaacgcccaccattcaatctcagagcccagcaaatgggtgagatgctggtgctggaacacgacacccaggccccaaaagtgggaggctcccaccatagcacccaggccccaaaaatggggtggctccaatggcagcaccctagccccaaaaggggaggctcccgccacagcacccaggctgcaaaagtgggggggcggccactgcagcacccaggccccaaaagtggggggctcccacaaatgcctatttctcaaaagcaggtatgctctctggaggctgctaccatatcacttctcaccccttcctggttccttggttccccctcaaatacagaattctatcaatattgattttactactatatttatcttgaccagtgtacagacagtccctgacttaggtttggtttgacttaggatttttcaacatgagcatagtatgaaaatgatacacattcagtagaaatcgtacttttaagtgcccatacatcccttctgtttgtcactttcagtacagtattcaataaattacataagatattcaatattttattataaaataggctttgtgttagatgattttgccctaagtgtaggctaatgtcagtgttctgagcatgctgaaggcaggtcagactaggctacgatgtttggtaggataggtgtatgaaatacattttcgacctatgatattttcaacttacagtgggtttatttggatgtaatcccgtcataagtcaaaatgcatctgtgtaggataaaggggggggggatataacaacatttcattatttcaataaattgtacctctcagaattgtttcctctgaattcagaattccattagtattctagggcacgttctgccactccactcttatgaaagaggcactccacccagctgtatttctttttatctatgtctgtaaaatggtaaactccttgaaactatttccactgcagtctttgtacataaaacaataatttaacacttgctataattgctttaaaaatatgtgcacacacacgcgttggtcatttaattcttatttacccttaggtcaatcaagtaattggtataataactttaaaggtaaatcaaatcttattaacgctttctaagtactttaaaaatcttaagtcaatgagtatttgtgtgaagtactactactgggaagaaatgcagaaacattttaatatctggttcctgaaaaaggtttttcacttatttagagtctcaggaaactctgctggttttgattcttccaggaaataagactgtctgcagaaactgctagaggagtttaatatggtttggactgtgagttatcgatacattaatagctacagttcaaataataaactacccagaaactataacacgcaaggactatcttggatattaggatgcaagcctgtccggcctgcaggctgctcacagatttgctggggaaaaccatccacgtccccactgggaatgaacctgctgtgcagggaggtatgccctgcgctgaaatacctgatggtctggtctgaattttggaagcaccagagtgactttatgaccaggaccaaaggtcacataaatatcgattggcttaaaaatgcatcaaacctctattttgcttataaaattattaggcactgtaaggaagaaaagataaataagacaggctccatccatatgctaacgtaaaaataaaagagtaagaaaacaaaaagagaaaggaaggactaagaattcagaaaaagagaccaggtgtgaccaagagtggtcaaagaaggttctaaagaaaaagtaagaaccagagctgggccctgaaggaggaggagagtcaggtgtagaaagcaaagacatagaaaggagagacagcacgctctgcacgaggcccctggtgggcaggggcatgggggtgcatggagggatgaacagagtgtgagcaagggctgcaaacaaaccgattaaaataaatgttctgctctctgttttcttttttttccttcgagttttttctttttctttctttcttttttttttttctcagacatggtctcactctgtcacccaggctagagagcagtggcacaatcatggcttgttgcagccttgacttccccaggctcaggtggtactgccacctcagcctctcgagtagctgggactacaggagtgcaccaccacacccagctcacttttgtatttttagtggagacagggttttgctatgttgcccaggctggtcttgaactcctgggctcaagtgatctgcccacctcggcctctcaaactgcttggattattaggtgtgagccaccgtacctggaagtgttctgttctctgcagctaaacctttaacctaggccatcctaagccctaggcccattcccattattatcatctcatttaatcactgatagaaacagtttcaatgattagaagttataatactgcaaaaacaaaagctatagcaaaaaactatatatatgatcaatagggcaatagttcttgtggtgcagaatctacacagtcatcacctccctttcctgaagcagcaacattcctggacttggaagacaaaagctaccctggagcaggggttgcaggggagcaagataacaacccccaaaaagcgttacttcctcccaatgaccagcatctgctccttcttgttggcacacaaagaattagggtgttaacagctaagataaagaggccctgggttgatattaacttaccttcaatttacctccagctaaatcccaccttaattgacttgatacttttatttgaaataagtggtttaaaacagtgggccgatgagccccaatagtaagaagactaagcttacctgtgtgtttgtctgtttgctttgctattaaatattcaacaatatatgtgtaggatttaagtgatcattttctcttggtatggatatgagtgtactgataaagctgttcccataagggaaatgctgttctcaccagcaagccagcctccagactctttcaaaagagcattaaattgcgtccttcatggatttagacggcagagatagcgtttctgtttaatcatctgctcaccacaaaaggaaggcacactaacttctgcaggaaaagtgtacattaaattacttctgaggctccccaaagattaaggctggtaggtttgggattgcattacaattaagtaataatgaaagagaaatcatgtcttttgatcaaataatgcattaatcctaccctacactgagtaaccttattcactctctgggaatgttgactttttgaggtaatttttatttctcattccgcaggacaggaaacagggacaaagaaaaagagaacggcaggcatcaaggaagacaatgggaggaaaagtgccctggaaagctgcctattaggaattagtattcatcacagcatagagaaaatcccaggtggttttaatggaagggtgaagtcattccttaagagtcagcacacacaaagcattttctgcagaaaaatacattttgcccatgaaccccaaattcatgggacctactaccttggagagggccaggttgcagtttatggatcctctttactacataagaccagggttcactaagcaattagcagaacatccagactctccagggaggtatttgaggacaagtttttcaagcactttagaagcatttatatatacctaacatgccattaatcattcttatctgttcattaaagcactctcccttaggacctccacttgccagttctttctcagcctggtgctttctatctatatacctgaaaagtagtccatttcttttcaaatatattttataattaaaatacttcactaattcacatgggtgtgctccaccaattactctgcattttcagagttttattaaatatacagaaaggccattctcctgagggtctttgtagagactaaccaggcaattcaagcttggtttcggaatacactttcagcatctgagaggttttagagccattactcacatcgtgttatcaacctcttgtctgtatccacacaggttgccttcttctgtccccaccaaaaaggaagtgcaattttaattcactttgtgatctaactgatctaaactaaaggtggaggggaaatcagatactgtaacatcggaaagcaatcagtttgaaatgttatgtccgcagggatttgactatacctctgcctgtgactcccccacacccacatccgggcctctgctggttcctgggtccatccatcccagcgcagccggcagggaggctccgagcagtgtgagatgcagccaaaagcctcctggtttcattttgatgagtctgttgaagaaatgacaaatgctgagaataaaacattatgagatggatataataagtcacagtgagttagtatgtgttccccagaatcagataagcctgggtttaaatcctggcaccaaacttctgttctaccttggagaggttatattacttctgagccttagtttacttatttctaaaatggcaataatatgtacctcgaaaggcttttgtgaggattgaaggagttagtgtcaggcatagagtaagaactctataaatgctgttacgtggaaacccatttgaaatgccacctaccgttacatctataagaacaaaccagggtgaggcaggtgggtcacctctattaggctgccatatagccacgccttagtttcctgagaaagcatttggggctaggcacacaattagtgctcgagaaactatgattatggctgggcgcagtggctcacaacctgtaatcccagcactttggtaggcggaggtagatggatcacttgaggtcaggagtttgagaccagtctggccaacatggtgaaacccggtctctactaaacatacaaaaattagctgggcgtggtagcaggcacctgtaattccagctactcaggaggctggggcaggagaatcgcttgaactcgggaggcggaggttgcagtgagccgagatcatacctctgcactttaacctgggcgacagagtgagactcttgtctcaaaaaaagaaatgatgattaagaattatgttacatctctggcacctcatttgcagccgacacctcagtttataagacagtgagcttcaaaatggcatcataaggtctaatatcttagtttcaagaccaaccattttttgtggcagaatccaagcatccaatgattcagaatttcaataacctttgaggtgtttcctgaggctcacttgataacattactgtatacagtcctaaaagacaagaagtgagcaattcaaggtaatcaaataatcacatggatgaaaaaactaaggatcagctacaacaaatattcaagtccaaatcatgtgctaagcattgtgctgaggaaatgaggatacagactatcttacttgtccaataagctgtacttttttggaaaaagttttccactgtgaacacagtccaaccataatttcagtattctgattatgaaacataaccagatacaactcattatgtagtacttagaacccctactcaaggaaactttaggggttattgatttctgcttgtaccacacaatttagtgcttaatcacatatggtccacactgcatcctgatctaggctggtgagttaaagacaccggagctccttggaggccagcatccagcatgaactggcttagggctggtccagaacagacatccaattcagaaagaagtgggtgcttgagggacctggcagtccatccctgctcactgccataggcaacagctttggagcatccctactttagacaatggggtggaagttgtcacatagtcactagtgctgagtccagggctggcaaacaattacactcctgccacattccaggttttgtttggctgctatccacatccaaatagagctgcctctccacatctgctttatgtctccagctggagacagaaatgcccacagggaggagaagtcagactcaaaattgtgggcctatggcactggcctatgaaaaggcaaggttataaggcatgactgtcttttaagagaaggtgtctgcttgttttaaaaagagtccataagctcccactcttatatctgtttcttcggtcactcatctttgacatctgttgacaaagctgagctaccaggaaaagagtctgggtggtcagtaaatataatctgaaggtcacagtctcaccatcagcacctgccccacactctgaagaaggcagagttgagtggaataatgccgcttcagctgccacccgggagaggactgtgaggactgcggcagtcacggcactccctcccctgccccccaatggcttctgcgctcttgatccagtgatctagctagggtgtgtgaaatcttacagggagaaggagcaggaaaagaaaatcatattcgggactaagaataaaaatgtcttcccctaactgcaacctgtttttattgttttcttgagatggagtttcactcttgtagcctgcgctggagttcaatggtgcgatctcggctcactgcaacctccgcctcctgggttcaagtgattctcctgcctcagcctcccgagtagctgggatgacaggcatgcgccaccatgcccagctaattttgtatttttaatagagacagggtttctccatgttggtcaggctggtctcgaactcccaacctcaggtgatccacctgcttcggcctcccaaagtgctggtattataggaatgagccaccatgcccagctgagctgcaacccatttttctaaaaataaacaaggtaactccctattctccataagtaatcctcttctgaatgcagagccactttccagagactgcagaaaacagcgagtggatttttggaatttttaaaaaccagccatagaaatttaagctagaactagaaagacattgcttcttattctcattaattttgtcctacttatctactatcaaacattgctcacagagtaaacacacagagcaaggtctacttttctccctttccatgtctcctagctcacataaacgaaaaacagcaagataatccaaatctattctagttaatgtacagatgtcaactcttggagttatgaaatacataagccacaaaatctggtatttaacttttaatctgctttgtaatctaagatcaattatgttttatgttttggtactaatgggtagcattaaaataaaatatattcatttcaactgtgattttggcaagcgccaaatcagttcataagaggatgcaccaagactgctggtttctgggttgtgtttcagaaggcccaagatccaagcctggagcttggcctggagttgccactggttttatctggtttgtgtttatatttcctgtaagattgtatctggaaacaggaaaactctggaaacaggaaaacacatgagccaggccaactactgaaatactcctgggcagcttgtttgtaaagtttagctcagtctgtctaccactagctgtgatttcatttgcactgtggatgtgttttagatgtcattttatacttaacggtgattgacaattcattatatctacagcaccaacagcctggaaatttacagctcaagttttatgacagttcagttcataaaaaggaattaatattgggtctaaatcaattttgattatctgtctaataatcaaatagagactatctatttggttaacacttatatagcaattacgatgtgtcaggcactgttctaagcacttcacaggtattaactcataaccctcctttttctactccatgatgggggcaatgattatccctcaatcagatgaaagaggagatggggtcacagagaggttaaggactctgccaaggccatgtggcagacaagtggcaaaactgaaattccaagtcaggcacgtagacccacgacatctattctcttaactcccacctgctgccgcctgtctgttttgttttgtcctgcctgttttgttttgataaacagttgtttttagtataatggggaaaatctagagacagtaagataggaggccctggccccgagactctcctttcctctgaaagctgccacgagctactctcctcctcatggctccaaccaagggcagagagccaagctgctcacccttaattcccacattctaccccgggatgggggcccctgggcagactctcctcagtcctcactgctgctctatttatgggctaagaaaaaatacggtagaaggaaagaagggagggagggagggaggggaaccataaaaagatgcacagaatcccaggccgatgcccctcagctcacggagagcaccagcatcataaggctagtcactctggagaagtaaatctgttaacaaattaattactcctcaaattcaaatagtcctactggccttcagatagaggcaaatgcaagaatctccccattatagaattgggaaggtgccatccataaggtcacaaatccccttttaaacctagagctccttttgagatcaatttagattaataagtttcattcaatccttgctaagccctaagtattaattataaatctacctaggactgtccccatataaagagctgagactaccttttgttccaaacaagtcataaagtacactgacttgatgctttaaccatcttgtttggaagggaggtgtttcattgcttcccctgtggtttcctaccagagcttcaacagacattcccccagtcaggagaacctggtgctaacctggctgccgcatagataggacaccagaagaccagaaggtggacgaatccacccaggttcaaggacaaatcagtggctaggcctaaactggaacccaggcatcctgcccccagggcaactgtttggttccttatattatggcacacttacatctagagtgggagtttggattctttgtttagataggcagattttgcttttctcaatgctgaaggacctccactagattgtctacctccttgtgaaaaccacaggattttcaggtgttctaaaataagctaatatctgtgctattatttatctgtatttagaattacagaggtattacaggttagtatgatgtaacattccaaatactgacttgctttttgaagaaagctgaaaaagcatgaaataggaatgcaaattgttagggagaaataggtattcatatgaaaataccaaaatctgccccacccagagaacgcacacaggcatgtaagctgtctttattgaccaagttcataggccagagagaagcaatcccattaaactggcaatgggtttaatacaaacttctctttctattccaggaaacagccctgttgggaagaatgggaattctggccctcagagtttcggtggcattgttcatccattctctctctcagcctctctcccagaacttggtaactttaccagactagccattaaggattagccatacagaaatggcttctttttgtaatcaacaggaccagaaattacaaagatgatttggcagaaccaagcaatgccacccagccttgaagagaacagtcagatttgtgaccctgaagcatctgcattctcaacctttccaaatgaaaaagtgtctgccctacacacactgtaggtgtgtagcatttcatacatggcatgttggcaatcaacatataaaaatcaactgggattctggaattccaaatactgactgaatacaacgtggaattctcttctgcatgtctgctcaaatttaaagggggaaaaaaagccacatcaaccccagcgtgaaaccaggaggctgtacgggaacctctcaaaggcttacgaccctagttttgatatgtgagtgttttagaaaaaaagaaagtggtacagatttcctaagacagtccctaaaacaccaacccagggaaattaggcatggagatatagcaagctaacgttgcagcaagccctaatgaagttaaattgcatttcctattaattatctactctatatcattagttaattcttccccaacacttgataaattagatggctacattattctatgtgccatgtataaatctctattcctatttactctgacgtttaacacagacacacatgtgacttccaataacctttatccttacaaccttcagctcatacctcttaagaaccacatgctcttgattgcagttctattttattggaaattccatgccttatgttatgcattgagacagaaaatgtaaagaaagatgtgctcttgaaatatctaattgcattaagctaggaagcacacaactaaccgcacataagcaactcaagaaggttgagtttgcagagaaacactcaaacaaggcaaggtaggagttaaggtagttttatgaaacaatgactattcaatgctagtctctgaatatagtgttaagtcaaacaaaagatcataacgtgaaggtcacatttaaaaagtcctacggcccttagtaaaaggaaaaaaagtcctcagtgactgactggtcatggtggaaaaatccaacctcctcttccctcacccacctccagggcacagccgaaaggataaaagttctcctaatacccagaaaaacaagctggccttttccagaagaaaaagagctttcctagaatcaacaaaaattgaggatgatcataaaagtctaagagagaaaaaagcactaggacaactctaacgagcaatttaaatacattacatcaaagtggactattttcttatgtgaactttggctcagtctgaagtctttggagagggtggtgcctttttttcctaggatgggagggaaaaagcgaacatttagcagagtatggcagaaatggtctagtgatgctgcagtgcctccttctcacaacgctaagatgggaagcagacacgtgccctgtagggcatctgctcgtatgtccggcttgagctcctgcctgagagttgctgtggctctggagtctcagaagctgcatcactcacacctccgaccattcccttcccaggtggaccccccgccaaccagacccagagtctgtcctgggggccagaggggcaggcacagaaactggcgcctggctcccaggattaagaagacactattaaaaagcatcgctggtttcccctaaatttggcagtaggaaaataacttaggactttcaagaagagtcctagtcgctcactgatccgtcttttcccctcacagattgtgacacaggcccattcccggtgaacattttggctggcagttacttcaccacctattgaaattctgtttacgtttggcccagagaacctggacggatgtttgtatctcgggggccccatctagtacaattcctggtgcacaggcttgcaacaaatttacgaaggtaacagaccaagctgccggcgctgtttttcactggaggaaagctcggcggaagcgacacctagaggggagcggcgggctgtggccgcgccattcatcagtgtcggcggcccgcggccgcgagcgagggctgctggacagcgccccggcacccgctctcgagccgcgacaccgacctcgccgggcccgccccgctgacccgcgcactcctagtgcacttgccgcgccgcgcggaggctcgccgcgctctggaaaacaagaaaccccactgcctcggcggctttccgctcccgcaagagttgcgggcacaaagtcctcaggtggcaggcctggggttggcgccgctttgtcggctgcagggagccccaaagactagcgtcagctcgtccccaaactcgaggcgacaggcgccgaaagcagagtgctgtgcctgcctcgtccaggtccctcctgaaactcagaactcgtctttgttttgcgggcgcaaagagggcggagatcatccacagtgcaagctctcttaggaccaagcccccagcccgaacgctgaacgcccccaacacactgctccctagacacgttcaagcgggtaccccgggccgctcactctggaccgcggccggctacgcacaagcagcgccgcaggctgcctggagtcgggtcgtgccctgattccttcctccccagcctcacatgcggcggaccccggggaagccagggccaggcgaagcgcagcgggccctttgggctgcagcgaggagacgcaagtttccccgcaaagccgcggggaggaggtgctgagaatgcctgcccggcgccccaacccggagccaagggcaccgggcccgggccgaggggccgcgctcgcctggctccgccggggccgctcggggtcctgaacccaagaacggcgcctgcaggatttcggagccgggcgcgagctgcgggctcggcccgagcgcttctgcgtggcgccccgcgtgccaaccgggtcactccggtccccaccgtagaccccggccacgagcctcggcgtcccagcctctcctcgagtcctggccttggccggggtagccctgccgagccctggcccagcggtcccttccccgcgggcaaacttggctttcccggcgcgggcagtaaggacaagcaagcgcccgcgccgggccctgcagcaagatgcggggccgcgggcgccaggaccccagtggggtgcagcgggaccggctggtggcggcgccagcgacatggcaccctccccgcgcccgctgggagctgcgcccgcgtacctgagacggccggggccgaggggaagaccaggtggccggacttgggcgggagggagggagcaccccgtggcggcggcggcgaccccgccccgcgtccttcggctggtttctcgggctgtcggcgggtcccgggctcgctggaggctgttgaggctccagctccctgagccgccgctgcccgctgctgtgccaccgccgccgcggctgccctatttctgccgccgggaccggagcccgtgacgtcaccctctgggccccgcctgcccaatcgccgccacctgtgcgcgccgcccgcccgccagccggtcagacccgcgcggcggccacggcaggtgcgcggagcaggcgggcgcgcacgcggggcgcgatgactccggagcgctggggccatctagggcccggagggaggagggccagcgtagcgctcctgcctctggctagcgtggagctcggcaagtgacagcccctcttcacctctgctctcctccaggctcctttccgggccaggttccccaaagctgtgctctccaggcgcacagggggtctctgaatccgcggccattgctcgtggagtccaggcgggccggtacaccacagcaggagagctgtccctggggacaaagtgggtgaaatcccccgccgttgagacccaacaacctgggaaacagcaaaggttttctcttttctgaatcttccctcttccaactacagaatcttaagacattcagggcatacaggggcaatcccaagtgacatttgcctacctgacctagctgggcccagagggtcccttctcccttagaacaggatatttccccatcctgatcccatccccaagcctggggctcccaaacttttctgaatccctctttaacatcagcagcttttgagatcagtcttccttcccgaatgaactggaaacacctttgtaacaactaggggcccataaatggtcatacgtagcctcagtctggcaggaaacttaggagggagcccctacccaggccaggctgatggccaggagactttctgagggcctgcctcctgctctggctgcgtgggcaccaggggccttcctggcttaggtgaacagtgttctgtccatgcctctgtaatctctcctggccggggggaggtgacagaggggatttttctgaggatgaagttagttaaatataaggaaaaggggaagaataatggaaggctgacctgaagaaagagatattacgtttgttttttccttccacagattttcctgccgctgaacccctccaatgcagcaggcactgtgctattaatagttgctagagatacagcagtgaatgggccagcgcggtcttggcatcacacagttttggtctggggtccagctctccctctatcactgccaagctatgtaatgcagagccaatcgtatctctactgtaggtatcagtttccccacttgtaaaatgaggggttggacaaaacctggttgacttcccatgtggataccatgatttttactcagaaggataaaggctactacatcctcagtgaccctgggccctagccagtgtgatcctctctcagatttgactatgaatctttgccaaggccaccatgactgaacttctggggctggctaggggccagattctccatggcaggactggggaagggatggcacttttcatcttgggaaacagaaaagagaaaatgagtataaaaggaagcagggaagtttggaaatgtgctgtgcctccctctgaaatgtaattctaagtctgtggtcaggaacgtacaccatggcttagaggctggattcggctctcctctaagacatgaggtatttggaaaagcagatttctattctcagctctgatcacaaagtccctgagtcaacctagtggccttattacataatcaaagcaggactttgtgtattttttgttttttagtaactcaaggtcatatgtaaatcagggtctataggttgaccaagatcagaaatagctctgtttaatgcagtgaacaggcactgaacttctacacgcttcccaaagaaggagaagaaggtagttgctgcaaaccagatgtatggaatattccttagagagaatgctaacatctgaagtgagctgtttaactactgtgcataaaataagagtgaaattaaaagtcacctcggaatgagaaaggtgaagtgtgaatgacaaaataaaacaaggctccagggaagcagcatcagatgccagtaaccttgacacctctttgaattgctctgtgcttttacctctcagtgtaattttttgtttaatagtacaccccaaattggaaaataggctagatttcacactgagaatttcaaaatttgcctgaaaccctgtttcagaacttgcaagcatactgattctcaatagccaactaggattcttaggggaaataatggttaagttttgaacttcatgtaattcaataagcttggaataggggagctaaaaggaaacataaattccagttactgccccccagccccactctgtttttggtgagtggttcagccagagacacacataaaaacattattaatatacttttacaagatcaaaaagtttaagcaacccaaatatttttttacgttgctggtttaaaatcttttttctatttctaatccttaccaaaaacacaacaatataatgaaaaactactgccaaatgatgtgtgtctcttaggacatttcagattacacctgcatatcaggatactcagagatgacacatagccatgggaatcaggaggaagcaaggcactttctccagatccaaccaaaagtatctgcatcactaactgtgggtcagcttacccttgggagtccccactaggctggtcaaacagtgcctagaaatacccattagaagccagactgggaagtcatgtgagaaggtgggaaaaggcaggaaagagtcttccttgtcttgcataatttaacgttctgctgcctgttcaaaaaatgtttttgtaaatcttcaaaccaaaccatgcagtttactgaagagccagccctgtgcttaggagagccctggatgggaggcacaaggatggggtctctctcccgcctcagcctctagggctcagtgagcctgggagagtcacacctttcccagaacttgttttctcttaagtgggaattgggaatgggtacatgggaggcagtcatactaaacgacatgtctaaggccattttcagttctaaaggtctatgcctttattttgcctgtatttatagaagttcagttattctgatctaaacagagctatgatgttgaagttttcctctaagtctaatattaatgcttatttttaagatgataattcattaatcacctagaaattaagggaatgtaggcagtaagttcaagatcctagacttaagattacacatacataattgtttttaactttatttcagggagaaaagtagctagcatggagataaggtattcattcaagggacaactgtgattggggaaatttttcgagacaaagaagaagtggtatagagtaggaattttaatgaagaagttgggataaatgagaagatgcagtgatggaaagggaattgtgaatggtaaaaatggagggagatgaacataaaaccctcaccatggcattgttaccaaggcaaattcccagcaaactcacaggggctggattgatggcacaaggggaccaagaaaggtgctgataacaggaggaaactgaagtctgctactcttaagaatgtattgtttacaagggataattggggatgagatggccaggcctacagccacaaactatcataccctactgagtataggcaaaagggatgaaagagggaacatattaagaggagagtgaaaagaggggccaatttcctttctttgaaagggacaacataatttttatcatgaccctgttttccaactcaccagtatagaatcataaataatgtgaaaatctaaatctatctatctatctatctatctatctatctatctatctatctaattttaaaggtgaactgctaccttagggagcttccattctttcttttcctcttcttttctttttgagacagggtcttactctgtcacccaggctggagtccagtggtgggatcacagctcactgtagcctcaacctccctgggctcaggtgatcctcccaccttagcctcccaatagctgggactacaggcatgcactaccatacccaggtaatttttgtactttttgtagagacggggtctccctatgttgcccaggctggtcttgaactcctgggctcaagtaatttgccccacctcggcctcccaaagagctgggattacaggcatgagctacctggctggctgaagcttccattcttctaaataaacgttcctttcaaatgaatatgcagtattatgatgggtcacctcaagggctatgaagacaactatccaaccttcaggggtataagatggtactggacttagttgataggccaccctagatctgagcagccattctgacctctttgaccctaacctggaccagggctttggacacttacttgtcttgcttcctagcaagagtggccctattaactgttccatgccatctccacagtcttagagccagttcccctctgctgttactgccactacttcagatcaagaagtcctgtctggctgggcatgttggctcatgcctgtaatcccagctctttgggaggccgaggcaggcggatcatgagatcaaggggtcgagaccatcccggccaacatggtgaaactccgtttctactaaaaatataaaaattagctgggcatggtggcacgcgcctatagtctcagctactcaggaggctgaggcaggagaatcacttgaacccgggaggcagaggttgcagtgagccgaggtcgtgccactgcactccagcctgagcaatagagcgagactccatctcaaaaaaaaaaaaaaaaaaaaaaaagtcctgcctgaggcaccaaatgatagcgagaaactggcctccatgcctacgcatttgtcagactcaagacctggggctctggcttccccagagacctcctgaagaggctactcaatacagcacagttaatgccctgagggctggactttgaccagtgggagactgggcacaggaggaagccagcagacaaattcccccttgtttccctggatggtctctacggagatgcagtgccccaagtcttctttgaagatactgtggaggcccagcacacacacagctgcacttgttacaaggctgtggcctgctcagcatttgagctttccccttccctgcacctgcttccctaggattttccttctccttgataaagtgttagcttataaactttgcctccagttctgtattctagagaccccagactgatagaagtaactggaagtaagagtggtgacttttcaagagggcagaggacaaagttctttcacaggggtgcttaggcagagatacgattagatgagggcgtggcatacgagaagatctagctgggagggcatttaggcagaaggcctagcaggcataaagaaggaactggctgatgtagctaagcagagggatccaggcaaagagttgcagaagaaggagagggctaggcaaggaccagatcacacagggtcctgacaaatgcagtagcccttcgttatccacggggatatgttccaagacacttagtggatgcctgaaatcatggatagtactgcacctgtatatactggtttttcccatacatacatacctatgatagtttaatttataaattagatacagtaggagattaacaacaacaataattcataacatataacaatatattataataaaagttatgtgaatatgatatatatatcttcctctcaaaataccttattatatgtaatgtttcagattgcgattgactgcaggtaactaaacctgtggaaagtgaaagtgaaacctcaaataagggggaaccactgaaaggactctagatctgatgttaggtgtaaggaaagccatggaggggaggagggtgagcaaggatctatagtatgtttttaacagatgtctctggctgctgtatgaagaacaaactggatagagaggatagtgaccagatgcaagagtgaaagcaggaaagaccagatgctcagttgtcaagaggtgcaaagtgatgtctaacccattatcgtcatcactaccatccaaccagcacctaaggtttattgattgctaactatgccttggacaccagtcctagccctttatatgtattgtttttcctaatcctcatgacaactctgtaagatccttattgcataaattaagctcaaagaagttacccagtttatctaaggcaatttggctggcaaatggcagagctaggatttgactcagagcctgtcctcataatcactacacaattctgtatcagttacacactgtgtgtgtatatggcagctatcacatatctcaggatttacgtactacaaataggtgcctagagaaccttctcttctgaatctattggtatatttaattagttgtcctcatcatgaacccttgtcacataaaatcaaaaccaaacatgtagtctaagaaattatggtagacattgttgattggatactcaaagtatatttctctcttcttttctgcatatagaatgtcagttccattcaggtgtctcaccttcagcatggtctaagccaatcatgaagctcttttccagtggtgatcagggagcccagtgctggctgaggagaggtgagagagtgtcagctggggagacaaagaggtacacaggaagaggtggtacctcttttccctcttgatactttcattaagtataagacacccctagacccacagccaccaacttgtgaccctgtaaatggctaagttggctcatggaggatggtggaacagggagagaaaaagaacctaggtccttaatgagctgcgcaaataacccattctaaagctgtcctacctcaggatttattttccttcctacttaaatcaattgagttgggtttttctgttactcaaagttgaaaacacatcaaatgaaaaagaagtcgaaatgtaaataaaaacccgatgcattatttgaatggcttcaggcacacagcatgggaggcaaatgctattaatatgggcatcatccccactttccatgtcgagatgcgttttgtacattatttgccaagaaccccaagctggtcagcagttgaagtctcctgactccaacccagtgctgagacatatggtaattttcagttatggagaacatttaattaactaagaccctccatttcctaattgcagtaaataaaaacagtgggcatataacaactgacatgaacaggatgctttaaagctgacaaatgcatgcacatacatcagcattgcctagccatatgtgacctgcaagcctttcactacaaccctcttcaaaacattttaaaatagtcttaccattttggtgtagtatataacaaataagtgatttgaagtttaaacaaattatttcagagtatcatattaaatgttatcttctaaaattggctttaatgcaatcattaataacattcttaaaatacagtcattacagataagttccattttgtatcatttaacaagtatataatatttaatttctatttaattaaatgaaataaagcatcattgtctgacgcatatgctaaaaaatgatgtcatatctagttaggggatagaatgtatacaaaaaagtgttttaggactaaaatccttgacagtgcctcaagtgtaggcaaaaaactgtctttcaagaattggtgcctaaaattctggaatttcatgctttaaaacactgccattttatttatatattttctatgttttgtttataaatggcaggaggggaaagatttcaggccactatttccaagcactctgcaaataacatattgtgggtgtggatacagcctttattctcaacacatgaaaaaccaaactgaatataattgtcactctatttttctctttttaacactgtttttgaagtatgaaagacagcttgatagtctatatataaggatttttatcagatgaatgcaatttacagattggtgaaggtaattttgaagcaaaattgtagacttaacattttttgctcttaattagcttgtatttcatcatcaggttccttatgtttctagtctttaaacacagcctattatgggcacaaatcaaaatatatgactaagaaaaacaccaatttaaaattataacagtctcaagcatcccagcagtcagtgatgttcaaccaagagataaactgagtaaaggaatcatcagtgtcctcatctgccttcctccacctaaccactgtgtgtgcttgcttgttacataccaacaggctttcagtcttttattataaatggaaaaaactgtggtgatcagggaacacttctacactgctggtgggaatgtaaactcgtagagccactatggaaaacagtgcggagattccttaaagaactaaaagtagaactaccatttgatccagctacaggttatctacccagaggaaaataagtcattattcgaaaaagatacttgcatatgcatgtttatagcagcacaattcataattgcaaaatcgtggaaccaacccaaatgctcatcaatcaaagagtggataaagaaactgtcgtatatatacacgacagaatactactaagccataaaaacgaatgaattaagagcatttggccgggcttggtggctcatgcctgtaatcccagcactttgggaggccgaggtgggcggatcacgaggtcaggagatcaataccatcctggctaatacggtgaaaccctgtctctactaaaaatacaaaaaatgagctgggcgtgttggcatgtgcctgtagtcccagctactcgggaggctgaggcaggagaatggcgtgaacccgggaggtggagcttgcagtgagccgagatcatgcccctgcactccagcctaggcaacagagcgagactccgtctcaaaaaaacacaaaaaacaaaaaacaaaaacaacaaaaaaagagcatttgcagtgacctggatgagattagagactgttattctaagtgaagtaactcaggaatggaaaaccaaacatcgtatgttctcactgatatgtgggagctaagctataaggacacaaaggcatgagaatgatacaatggactttggggacttgggggaaagagttgggagcgggtgagggataaaagactacaaatatggtgcaatgtatactgctcgggtgaagggtacaccaaaacctcacaaatcaccactaaagaacttacttatgtaaccacataccacctgtatcccaacaacttatggaaaaataaaataataaaaataaaaataaaaacaaatggaagaaaaccaatatatcacttagtgatttttttatttttttaattttgaaataattctagattcacatacatttgtaagaaataatacagagagatcttgtgtactctttacccagtttcctccaatggtaacaacttgaaaaaccatagtacaatatcacaaccaggtaactgacatgtataaaatgaagatacatggcagtcccatcacaagaatcctttctgtggcttttttatgcccatcccacctcccttctctctctccctccccccttatccctaatctctggcaacctccatttttttttctcaattttataactgtgtcattttaagaatgctatgtaaagggaatcatacaacatgtaacctttggtagattggctttctttgctcagcataactaccttgagaatcatacaagttgtttcatgtgtcaatagttttgctcctttgtatgactgagtagtattccatggtatggaagtgccacatttgtttaaccacctggctttttctattttttggtgattacaaataaagttgctataaatatttgtgtacaggttattgtgtgaacataaattttcattttttgggatctatgcccatgagtacaattgttggcttgtatgatagttacatgtttacttctttaaaaaagtggccaatttcgaataaaaatgttacacgaaaaagccaaaaaataaaagaaccagcaaaattatttttcagaatagctgaa

SEQ ID NO: 345 - DNA, 46846 bp, Homo sapiens
aaagtacagattcaatggacagcttgctgagcaatgagcacaaatctctgtctttttatttttttctccaactgaggagagagcacaactatctttgttctaatttccttctttttttttttttgacggagtctcactctgtcccccagactggagtgcagtgtcacaatctcagttcactgcaacctctgtttcttgggctcaagcgattctcctgcctcagcctcccaagtagctgaggctataggcgtgtgctaccatgcctggctaatttttttatatttttggtagagacatggtttcaccgtattgcccaggctggtcttgaactcctgacctcaagtgatccactcaccttggcctcctgaagtgctgggattacaggcgtgagccaccacgcccggcctgtgttctcatttcctcctattgtccaaatgccacaccctctgtgaagccttcctgatttccataatcaattaattctcctttctctacaatatgtacctcactagatttttttattaagtgaggtagggaataaaataataagagcttgcctttaacaagtacttaccatagaataggcattttgataagtgcttgacaagcataatctcattttacctcataacactgaggtagatgctattattatcccccttttacagatagatgaatggaagcccaaaaagattaagtaatttgcccaagttcacatatacagtttgtaagtggtaggaccatgatttatttatttaattaatttattttttgaggcagagtctcgctctgtcacccaggctggagtgcagtggtgcgatcttgactcactgcaactctgcctcctgagttcaagcgattctcctgcctcagcctcccgagtagctgggattacaggcatgcgccaccacatctagctaatttttgtatttttagtagtttcaccacgttggccaggatggtgtcgaacccctgacctcgggtgatctgcctgcctcggcctcccaaagagcttggtttacaggcatgaaccactgcgcctggcctagaaccatgattaaatccatgtatgtgtaaatccataaaccataatcccaatttctttattaaggtaccccagtacatattacacactcagttatggaacatcttatttatttttaagacacagcctcactctgtcacccaggctggagtgcagtggtgtgatcacgtctcactgcagcctcgacctcctgggctcaggagatcctcccacttcagtgaccccagcagctgggcctacaggtgcttgccaccacacgaggctatttaaaaaaaattttttttttttggacaaagtctcactcttgtcccccaggctggagtgcagtggcacgatctcggctcactgcaacctccacctcccgggttcaagcgattctccttcctcagcctcctgagtagctgggattacaggcggctgctgccacgcccggctaatttttgcatttttagtagagatggggtttcaccatgttggccaggctggacttgaactcctgacctcaggtgatccgcccgcctcggcctcccaaagtacagggattacaggtgtgagccaccgcacctggtcaaaatttttttgtagaggtcttggaatcttgggctcaagtgatcctcccaccttggcctcccaaattgctgggattacaggtgtgagccactgggcctggccagacatcttattcttattagctttgtattattctgtcctttgaattttgaatgtcctttcctcttgtctatcaatttttcacactgcttttcagtttacaatgctcttttgtgtatattactctatataactcttccccaagtcccctaaagttgctattagtactcatgttttttcaaatgaagaagttggtgagtgctccgagacattgtataataaaggctaaagttagagatatcaggtcatttgtttaaagtactggtggccagtctgggcaacatggggaaacctcgtctctacaaaaaacaaaaacaaaaacaaacaaagaaacaaaaaattacccgggcgtgctagcgcacgtctgtaatcccagctacttgggaggctatggcaggaaaatcccttgaacccgggaggcggaggttgcagtgagatcgagccactgcactccagcctgggcaacagagcaaaactctgtctcaaatagttaaataaagtagtggttgacctgaaataaggacaaggtaagaaattttaaaaagaaaataagaaagtagtggtggagctaggacttaaattctggtgtgctaactccaaagcccaccctttcttcaccatgtttcagggctcctcccctagtgcccagcctctcctgaatcagaatacacggttcggtctttgcactcccccttcagggcttgcacctaaggcgcttatttaattatgggcacatgcatactcgctgcttacatgtgcacctcaccctctaatacgagcctcctgaagggagggacataagtcgggtggtttgggattcctacgaaccccagcatggggcctgtacacaactgatgtgaatgaaatgtaaggaaagctacaagtccttagccctgcatctcgcctcctggacgctgtatcgacaggccaagatccagatcatcgctatatcccttacagccttctgcacacagtaggaggtcaacatcattaaacttcagttcccccacttttcttggaacataaagcataagggggagggactggcacgcaattcctcacctgagggctcagcagggtcctcaggtgcttcaagtgcatgacgcacacctgtctttcagatgctcctagacagcgacaactcccgtggttacctggacaacccgccacgcagccgcagcgacaggcactgacgcttatgcgaccggagcgcaacacgcgtcgcaaggtcacacgtaactttgcggcgaagcaaacagaacgtgcgcaagcgcggtgagatctagggcgggcccttgagagggcttcatgaatgttctccttgaccaatcccgtcgccgcatgcaaactcaagaccaagccccgcccacaagccttcagccagccccaggtcctacgtcatagcggtccgtctcgctcttcgatgtacctgactttctgagtgcactctcttaatcctcacaactctggagggaagcagggcggtttccatgataggccttctgcagttgacggaattgtacccaaataggttacatgatttgcacgggatcgcaaggctaataacgatagctaacgatgaatactcagtatgtgtctgccaggtactgtgtaaagtattgtacgtgcatttatatcatttaatcccaaaaccaccttttgaaggggatagcgttattattagtctcattttacataacaggagactcagggcacttgctcaaactaacacagccagcgaaggacttggaactggagttcaacccagagttagtagctttaaacagcttttatgttccttctcaactcctagctcgctctctccatgccacgatactataacctgtcacattcccatcccaataaatgacatttattctcagaatctggaagatgagtgttttggaactagctgccaaagaaacgtaaggtaccctacttcctaattgggtaatggtgggttaaagactgctgtttacattggaatgtttttatggttcagtttgttgttgttgttgttttgagacagagtttcactcttgttgcccaggctggactgcaatggcgcgatcttggctcactgcaacctctgcctcccgggttcaagagattctcctgcctcagcctcccaagtagctgggattacaggcatgtgccaccacgcccgaccaattttgtatttttagtagagacagggtttctccatgttggtcaggctggtctcaaactcccgacctcaggtgatttgcccgccttggcctcccaaaatgctgggattacaggcgtgagccaccgttctcggcctgtggttcagttttgagggcagacctgacttggctcacccgataggttgtcttgtgatacctggggttagagattggttaagtagaaaagagactgacttgttgatctttggagtcccgttcagaatttttggcctatcttctaacataccagagagattgaaatgcagaaaggagttattcataagcctgctctgaaatgatccaaagttgggaagatctgtaactctccaggaagtgtaacatatgctctccagacagactgtgggtccagaagccttcccccacagtggtttgcaagtgtcaacaggtgtttgtctcatggccaccaaccaccccttagaaaataggaaagagcagaggacagcccctattttcacaggaaacaagtaggcctcagagctcaaatgagaattattttgacaggggagtcccaacccctcagttttattttcagaatcctcctctggatatggtggcagagcatgaatataaactcatttatgaattacagttattactgactttgactgactaaacagagacagagatgaaagggaatgcaaaagagggaagaacagacacaggaacacataggataggagcatgtggcaccaaggaatccatgagtgtagctgtcctttcattagtccccaagacactgcttagtccttttctgaccattagcccagggttgatggaggagtcagaagagtaagtggtgaggagctgtgctgtcgatgcaagcagtgaagataaaaaggctactaccctctcatatgatatgtattagtattcagtggtgcaggaacttatatctttctcttctctttttccccttctcacccaacaaagcaaaagaatctggggttagttttctatacctcttcttcctggccctatcctagggtggggtattatcacaccttgcaatgctcctgtcaagtaggtgatggtgtaaggggcccttggagggtcaggagagagacaaggtgaggaaatgtcttcagcatactatacagtcagctccagtttgtccaagaacctttattggaaaaatgtccaacaagtgatatcactagcagctgaaggggctgccaggtgagagggggagcacctgaggctccatggaagacattggagtagtgcagtgcagcatctgcctctagggtcagacaattccttttatttgctggggtaagaggagtacccacagaaacacccctctctgagggccagaggcaagatgtggggcagctggggatgctcagagtcctgatacaggtgaaatggggcccccatttgggacctaatggagtagggtacaactagtgactctcccctggaccggggaatggaaggagatatcccatctgatatccactccccaggtccaggggcacagactctgaacagacctaccttctggctctgctcacagtggaaagaggatgggtaccaggcctgagattgtgggagtggcattaccctctgggagtctcgggcagatcaccatcttgggctccccctgaccccatccctatccccagttgttagtgcatctctcttctgggtgtgtttcttcactcaaacgtcgatggtgttgatagatggtgactttttctgtgaaagaaaatggcctgagtctcaacttcaggaaggtaataggtgccaccctttctctccagcctcccccatcccagatcttccattctccatctttttctgcccctctttgaccttcttcctttccctggctgcccctcaggggcagaatcaccctttccgccctcactggcccccacatcacctgtcttgtccccactggccttccctgaggactctgttccggcccctttcccttctccttgggattgttgttggagtcattgtccttgatgatgtcatactgacggcagaacagcccaattacagctgaaacacaatacagtctgagccttcatctccacttcccccctcatagggagatacctacgtagcttctagaaaatccatgaagaacatcctgaattcctggtgcccatgcagtcctcctctctgggctctcaacagcctcctctccctctcttcaaagttcaaatcatccctcctgaactaagtatctccccactccactctatttctcttactttttttttttttttttttttgagacagagtctcgttctgttgcccaggctggagtgcagtggcatgatctcggctcgctcactgcaacttccacctcctgagttcaagcaattcttctgcctcagcctcctgagtagctggggttacaggcgccctccaccacactctgctaatttttgtatttttagtagagacgggtttcaccatgttggccaggctggtctcaaactcctgacctcaggtgatctgcctgccttggcctcccaaagtgctgggattacaggcgtgagccactgtatctctcacttctttttctcctgacaacctttgccacctcacacctttactgagtccctggtcccctgtctagctgcttactcaccagcccacatgagcaacaccaccacaatgatgaccacttccccagtctgcagtggccgctctccatccagaccttccactgtgatgtcacctgagaagggagaaggcagaaggcagactccaggttactggggtccatactgcagacatgcaggatggagatgctggggattagaaagggtggacccatcataatgttgcccttggagtgtagggtagcccctccctgggaggaagccgttggtggacaggtggttagcgaccaaaaagcgggatggctgcaggttaattactcactcatgcaggctgcagctgatgtgaagttgggtaacaggaagcttaaaaggccttcccccaaacaactcaataccagcctgtctatacccaatccccttcccacctgcttttctttcctttcctggcagtacaatgaattaaatcatcctattcaactcagctagtctgttgcttgtcttggggaagtaagtaagaggctgcaagccaggtaagcagccagagaatccaatagcacagatcctcacctgggcttgaactgtttgaaggtagccggtcagaacccttgagagttcggaagtgcacccggggccctgggggactctctccccgaaggccgatgctcctgacctgcactgtgtagtcactgtcttcagccaggccccagagggcacaggcccgggtggtggtgttcacctcccgaatcacacgctgcccggggccattctgccgctgcagggagatgaggggagaggaggacagcctcaccccagtgccaggccacaaggctcaaccagagactcttcaacatccaagcactccgggggagtagcgtgaaaagggcagcctgagccaggatacgccagcttccagatcccccccacttaagtgaagaaatgtgccgaaatccaaggacacaggttgggggagcagaagggtgattcatacttgctgggaaatggagtagccaatgacgatgttgccttctgggacgtcccaggacacagtggccgagttggctctgaggtgagtgaccgtcacattcacaggagagggaggccggtctgcgggagccagggtgtttaacaggtttcacccattgactagctgtggttgaccctcagccccgttcccctttacttacctgctcgcacgaagcccaggtcacagctgaccagcaggaggaccgtggggcttagatatggggaaaggggcaccagcgaagccatgtccccacggagtccgctggggggggaactgtggcatccgcttggcatccgcttgacatccaggcggggctcctggagatggcaggagttgtggggggtcaaggactgcccagaacgcacggaggtcggggggcagcagctctcctgggctccccacagctcacaacagccctattttctctacgccctcccgcccccgcattgcccgggcggccccagagtgcggtccgccctgcccacacccacctccgccggtcctcgcggttggtcaggcctcggggggctgctcggtgcccagagggcggcccatcgcccgactcggtggcgctgcccctaccccatcccggcgcgggcccggcgacgcgggcagcgcggggccgagctgcgggcggagcgggcgcgggtctgcggagcccccagggctcgagcgggccacggagtctgtccgggagcagggggcgttgcccggacgctggcctgggtccccggtgcgggaggcagtgcggcggcctccgcccgcccctgcagcgggatgtgaccgtcccggagagccagccgccgccttctgcagcgctggccccgctcgctccgccgcagcccggccgggacgcgcgggcccgccccgcccagccggggttctcgccgccgtcattcccctcccgccccctcactcccgtcctctcggggctcctcccacgaccctcccaatggcgcctccggagcccccatcccttatcccttctctctcccagctgaagcggacgagtcggcgggggcgtggggggtgagacgcgggtgctagggtctccggcacctgggagatccccttcctccccgcgtggaagagccaagttgggaagaggaattccacctccagtgcccgaggggctaacaggagaggggagagagtgagggagataataattgctttaacaatcccttacttgtagactgcgtcagcttttaagtctcttttccattcataatctcatttaattccgttcgctttctcattcattctttcatttattcaccaaatatttattgagcatctcctatgtgtctggcattatattaaaacctggagatacagtgattgttaagagtgttgggcttctcgggagaatcaaagcgcaaagacctatggcttttttaaaaaaattattattcctttcttttctttttttgtttttctaaagctctaccacttacggtgtggttttggagaaactggtttatctgtgcttcaggtttcccacctgtaaagcaaagcgtgtgaaatctcacagggttgttgtgaggctcaaatgagacgggaaagatctttataaatctcacaacactatgtgactggatgatggagattaatttgcaccaatctgttagttacttctttgttcaataacatgtaagcccttacattatatcatgctttggttgagcttgaaatctgaattgagaacctgggtgtgagtcccaatttgtccagctgtgtgatcttaagcaaccaactaaactactctgagcctgtttcatcatctgaaaaatgagggtgtcaatattgaccaacatcttagtgttggtgtatccaatgagatactgtctgtgaaaagtgtgttgttcagtgtaaataaatgttggctaacattgtatttagggcagattctttggtttctaattctcaatgcagtatttctgtttctgtgggatttttcccgctgtaatatccagtacagtgtgtgcacacttggggctcagaagcttctactgccttcctttctgagaggagaggataaaatgggaccagtgggactgactgtgtgtgctgagcatgtgatcaagccatgggccaggtcctctgacttgtgctgacttggtgaccctgatctctggcctcggaggacacttgcccagggattctcactgccgtgggtgttgtcctgcactcccaggctccaggtcctctgtagaagagggcattgtcccggtagggcaagagtcccgagcctcaggtcttcctcttcaggggccaaagcagaggctggcgagtcagggtgcttgcaaagaggaagcccaggagtttccctggggttaccagagggctgggggcctagtgaccaggaaagggtggtgctctgagagcccagggtgcttgggttaatcatcactggggctcagataaggccctgccaactggaagcagagtcattgtgaccagaggggtttgtgtggctgaagaggcaggaggaacagtgtatccacagcgtgggaccatgccaggcacaaaacggtttcaacatgtcattgagaccccggagcctggcaagtgggaggtgagaccccttcttcatgttggctttctgtgctgattcctagaattatttttcatccagtcttccctccccgctggtttctgctcacctcttcttccttcctgatgttctttccctaatatgcccagagcaccaagtgcaggctgagtttctggtgtggtatgtgtgtgcgtgtgtgtaagtccaaactctgtgcctgctgccactcccacctccagctcagcaggcatgaatgaggctttggcttcctgctccatccttgtcccctcttccttctagttgtctgggtacgaggcagctgtgccaatcacggagaagtcaaacccactgacccaggatctagacaaagcagatgctgagaacattgttcgactgctagggcaatgtgatgctgagatcttccaggaggaggggcaagccctgtccacataccaggtaaccaagacccaagacctggaccctggaaataaacatgccaaccccaaccccacctctgctctccctcaccatggctcctaatatcggaaaccctgagaccccctcccccattcatcgtcctccttttcttggcttctcattcctgcatattccctacagagactctacagcgaatccattctgaccaccatggtacaggtggctgggaaagttcaggaagtgctgaaggtactaaccttccttctgttccctgcctaaacttttctgtttccctctttctctttttactgtctctatttctcactttgatagatctcattctcctttctcccttttggagatcctcccttttggatccttattttcatcttattaataaataataatgataacttctctgcttaatactttataattgacaatctactttcacacctattaccctcacaaaagcctgtgaagttgatatgacttctgtttgttttcctcagatgaaaaaacaaagatttagaaaggataatcactgtagcttgctcaaatacactgagctaataattgctggataatgctgcttttattatttacttttatttagatgacaaagctgctttcagttctttctgggagaagtaaggatttgaacaagtagtggagcaagacatgggagtcaaactggtttctctaatccaatgttctttttgctacactacattgcatgtatttgttcaattttgtgatgagaggagggataaggagtctttccaattcctcttgcattactgacaaagaaaagaatattcttctcccaacctgagccaggccctggtaatatatgcctctttccttcttcaggagccagatggggggctggttgtgctgagtggagggggcacctctggccggatggcattcctcatgtcggtgagcaccctggtctccagttttcttccccctccacttctggaggtgaccctcaggaccataaagatcatcataactaagctcccaggtggccccctcactagacctggactccaagcctggctctttctctcttccaaaagctagatgtcaccatgaagtcccatttcttctgagcccatctgagtcccgccagtatgttgccaatgtctctacatcccatgcaccaccgactaatcatctccaagtagcagctttaagtgcgagattccatgtaggactgggttaagcactggtctaagagaatcattatatagtctctgccctctaggagttgaaaatccaagataattgtttcttctctgtcattacctctttacatcctctccctgcttgacaggtgtcctttaatcagctgatgaaaggtctgggacagaaacctctttacacctacctcattgcaggtggtgacaggtaagccaagttagcctatgaatattttgtttgacctaaatagtatttcttagaaattgagttggaatacctttagacagagattgtgtctggcttgtcttagtcctcaccattccttattccctcacacttggcccacttcacatacttatgtcgcctgactggctgttgtaggtatttgagtttttcaactctatggagtgtctatcatgcaccaacaaactgtgggtgctcattcaatgatagttttccctttatgcgcatctcttaatgtagcctgccctaatacgccataggcttctgctttccagccactgccactgaccttgagtctgtcctcttaggtctgtggtggcctctagggaggggacagaagatagtgccttgcacgggattgaggaactgaagaaggtctgtgcttttcactgacattgaccagagacctctatctgttccttctcatggggacataaaagccccagcattcagccaaagcctatttcctccctcccctgttcctggccctgatatcctcacacagtagatttgtgccctggaatcctcccagttacactaccttgtccatcctcctctcctaggtggctgccgggaagaagagagtgattgtcattggcatttctgtgggactctctgtgagtaaaaagatgggttgagtggatcaattttagagagaggaagtgagtgggaatggaatagcatggaagatagatcaatgagatcggtgctagaaggcaggaagtttgctcaaggaattttggttttagtttcactaacttggatcaagttgtgtgaatgtgggaagatggggaagggattctatttcagaataactgtgtatcaatcaatcaacaaccaagataggtggactagtccaggggtaagcaaaatatactggctggccaatgcagccagctgcctgtttttaaagttttttgttgttgttgtttgtttgtttttgagatggagtctcgctctgtcacccaggctggagtgcaatggcatgatttcggctcactgtaaactccacctcccaggttcaagcgattctcctgcctcagcctcccgaaaagctgggatcacaagcgcccaccacaatgcccggctaatttttgcatttttagtagagacagagtttcaccatgttggccaggctggtctcgaactcctgacatcaggtgctccacctgcctcgctcagcctctcaaagtgctgggattacaggagtgagccactgcacctggccctaaaataaaggttagtttttgtttttgttttggttgtcgttgttgtttttgagagtctccctctgtctcccaggctggagtgcagtggcataatcttggctaactgcagcctcctcctcccaggttcaagcgattctcctgcctcagcctcccgagtaactggaattataggcacatgccaccatgcctggctgattttgtattttcagtagagacagggtttctactaaaaaagaaaactggggaccaggatgctcaccgacatgaggaatgccatgttggccaggctagtcttgaactcctgacctcaagtgatctgcccaccttggcctcccaaattgctgggattacaggcatgagtcaccatgtccagcccctaaaataaagttattggaacacagccatttttgtttacatatggtctaaggcctcttttatgctatagccatagggttgagtagttggacagagaccatagggcccacaaaccctaaagtatttagtatctggccttttacagaaaaatatggcccctggactagtctcttgctacttaaaatgtggtgcctgcaccagcaacatcagtgtcacctgggacttgttagaaatgcaaaatctcaggccccactctggacctactgagcattttaacaagatttccaggtagtttgagaagcactgagccagatgactccaagtttcctctcaattctgcagctctctggctctaagaattcacttcgcagaaactagatcccaccagtgttatatatggaaggaagcacacaaagagaagaggatattgacttcaaagagtttacgattttagttcagtagtattccaactttaccgtgcagaagatttccttggagaacttgttaaaaatgtagtgcccttgaggtacttgttaaaaacgtgctcccccttcaaatttggatccagtagattgtaactgtacctgggaatctgcattttgaacaagcattctgaagggttctgatgcacttgagccttgggcaccactcagagtaatgaccccctcatcatgcccttctctctcttcaccatcaggctccctttgtggcaggccagatggactgctgcatgaacaacacagctgtcttcttgccagtcctggttggcttcaatccagtgagcatggccaggtgagccttctggaatgactgggcagccctggggcaggctggaggggaacatgtcaaagtctacagtacaaccacaagggagagaacagatagtcttgttcaccaaatctcagaatattaaagtaaatatggggtgcccctaagcttataaggttttttgtttgttggttggttgaattattctcttcttgtttcagaaagcattaaaggcagcttataaaggatgcataaaatataagatagcatacattcaaaacagggattgaagaggcaagagaaacaaggaataaaatggaggataaaatggggtcaggaagatgcataccataaagatttgtgctttcatatgggggtgagccccaagcaccttttcaaagtagtagtagtgggtgccagatggcctcctactcctctttgtccagttcccttatttagtgcccattctctctcatcattccaggcacccctttcctcccccgaggatcctcagatctctcactgtcttcccttccctgagagcccctcattaccaaatcacctccctcttattctctatgtcagtggtcactcttatttcagaataaatcaacatattaaaccagtagtgctcagatgtggttctgtgcatgagctgcctggggaatgttacaaaaaaataaagaagattcttagttccttgtgtaagaggtctgattttgtaggtttggagtaaggccctgaaatatctattttttgaaagcaaccctggagattctgatgcacagccaggtttggggaactctgctaaataaaccattggagtgggccacctgacaaagctgagggcttcctgacaccagagggatgcggcaaaggcttgttgattattttagagcagctttttgtatttagcggtggtcttgggaagggggacaagtgggtttttccaaggtgctttttcaccttccagattctaggcggtagtataatttatgcgaaggtgtaaatgaatctgaaatactcctaaccctgatccttttcatggagggctctccttcaccaaaaatgtatctgctgcagtggatgctaatttcaggccctatgactaagtgaaatgaagaatttcaaacaacgtaggcgtggagatcttccagttgttccttaaatcagtggctcccaaacttggctgattttcagagtcatctgggaagcttttttaaaatacagatttttgggctccactccagaactactgaatctgaatcttagggtggacttggtacccagaaatgggtagttattaaaaaacaaaactccccagatgatttggatgcccagctgtgtttaggaatctcgacgttaaaccatacgatatgaaccctctctgctttagtctcctctttcttaggactctaggaagtttcagaaatagtttgaggaagaatgacaggagacattttatacaacgggcatgaaatatgtgaaacttgtctgccctagaagtaatacagaagaaaaaaaatacaaaaatagttcaagaagggagggaacctttgcaggatgggatgataaggtgaaattaggggtgccatgtacagaagtaactaactctttgaggtcctgccacagtgggcgattcacaaattatcccctagcaaagccattagaaatcaactaaagaagatcgtcattctttgagattccgtgatttgtaactaagcagataacaagtctgtagctctcttgcctcatgaacacatttatttgttcccaattaatttactcaaggaatgttcaacaactgtgaggtgctaccttgaagcttggttccctcactgttatccctccctctggtactgagggttcactctttggagggatttccagaatgtattcccacaaatgggaagggcttctgatggaccctaagatggaaaataaggtgacaattttgacatttgaataacaggccttccctaaaggacctgcagagagtgacattagtatagccatggcattggggcttatgcaaggagcaggacacaagatagtttgggtctcaggctgggactttaaacttgagtgttggctttgctctgggcttgaggtgctgcatgttttattaacccctgtccttggggttcggggacacagtgcctctaaaagttccaaagcatatgtctgtatgaagttgttgacctctgacctcaatcccaatgcagtctttgatcatgactcccagctgaggcccttctttgagatcctcatagacaatctccccaccttgtgtctctctggacctcagaaatgaccccattgaagactggagttcaacattccgacaagtagcagagcggatgcagaaaatgcaggagaaacagaaagcttttgtgctcaatcctgccatcggggtagggcctctcctttttctatgttctccacccctccaacacctgggaactgcttgccacttccttggggcctctgattttaggttctattatatcttgtttaaattcctgaggtattgtgagtcagctaaaatgttataaaccaaatcctattttcccatttacattttcaccttaagatatttcgtcttcattccaaccctctctctcaaattggtaagccttaaacacttcagcggtctgggacagtttctatttaaagaagctctttgccatctatgtatagagagcgttgaatagccattgttatgtttcagtctgtctctctcacatatttacattttaaatatgggctttaaaaaatggggtgcagttttgtttcattcttctgcctttctaaatcctctccaaaattgggtggcccttcttaggttgaaagctgttttctcttgttcctttttttctcatctggattgcagatacatttcactagcaccatttctccttacttgggccttacgagggccttagccaaattccagcccgtgcctccctctaccagtggtgggcacaccatctgcgacattctcctccatcttccttttgtgagataagaaggtagaattccatatgacataagaattccacggctttcacctcctaaatgctcatctgtctttcctcctccctgcaaatgttgactttcaatggctttcaatcttcttttctcagtcactacttttttttttttttttgagacgaaatcttgctcttgtcacccaggctggaatgcaatggcctgatcttggctcactgcaacctctgctcccctagttcaagcgattttcctgcctcagtctgcggagtagctgggattacaggtgcctgccaccacatctggctaatttttgtatttttaatagacagcctgttggccaggctggtctcgaactcctgacctcaggtgatccgcccgcctcggcctcccaaagtgctgggattacaggcgtgagccaccgcacccagcctcagtcactactgttatcattctgtttgctgtagcctctttgtctgtctggtgtgctgtgtgccacatctggactgctgcaatcacttcttcattggtctgtccaaagcatatgacatgtggtatttggattgataaactaccacagaaaatggtggaagtgggggagaaatttcttggaaagaaacacactctctggtctgggtgtagtggctcacgcctgtaatcccagcatttgggaggccaaggcgggcagatgacttgaggtcaggagttcaagaccagcttggctaacatggtgaaaccacgtctctaccaaaaatacaaaaattagccgggcgtggtggcaggtgcctgtaatcccagctacttgggaggctgaggcaggagaatcgcttgaatttgggaggtagaggttgcagtgatccaagatcgtgccactgcactccagcctgggtggcagagtgagactccatctcaaaaaaaaaaaaaaaaaaaaaagcactttgggaggccgaggtgggcgaatcacgaggtcaggagatcgagaccatcctggctaacacggtgaaaccccatctctactaaagatacaaaaaattagccgggcatggtggcgggcgcctgtagtcccagctatttgggaggctgaggcaggagaatggcgtgaacccaggaggcagagcttgcagtgagccgagatcctgccactgcactccagcctgggtgacagggtgacagagcaagactccatctcaaaaaaaaaaaaaaaagaaaaaaaaagaaaacaaagaaaagaaaagcactctgaaaaacccttgacccagctgacaagagacccaatcactctgacttcctctccagaaagtcctgagtatacctaggagtgatcagaggaggcccttcccctctttctaatcttcctctcggtcaagcccaccccagcacccttcctcacaagcacactgggggccactggtactatcacatgcatgcccgggggttactaacaagtggtctacggggtcttcatcctctcccaattcctcttgggtgtcttcacctcttcagcccgagggtctcagcggctcctcccggatgaaaggtggaagtgccaccaagattctgctggaaaccctgttattagcagcccataagactgtggaccagggcattgcagcatctcaaaggtagggaggatctggataagagagagctcagagtcaggcgagtgtgagatggtgtggatggagattggcaggtctagatccaaggactgggctggtggcagtaagactgcagcccaccacgcctcccctgggaagggagctgggtagtacatgctgttgctcccacctcatagttgcagagtccgaattgtttccagtggatcctggattcctcaggcccagacctaatccctgagcctgcctggggcctccaaagctagcctggctccctagggtcctttgatttgggggtggtccaggccatgcaggtagagcttatcctactctggacctgcctccctctccagggtctctagcctcactcctaggctgctcatgccccttcccagtggctctcagatcctgctcctcctggtgctttcctgctgcactcgtccctctttctgctcttttgttttctgcccattgaagaagcccttgctgccccttcggaacgcagtctgggcctactctctgcacctctccagggaccagcagaatttagttctaagggagctgtgccttcacctccccgctcagggaggcacctaagctttctgagggggaattgggcccttcttgagagctggtggcttttctcccagatgcctcctggaaatcttgcggacatttgagcgagctcatcaggtgacctacagccaaagccccaagattgccaccctgatgaagagtgtcagcaccaggtgtgtggatatgtgtttagaggtgaggatgtggcccggatggagaatactgagagcagggagactctgtgagacatgttaacacggtatgggcgataggattgcatgttgaagggtcatggtttgttgactcctgtgttcttctgtggacatctctggcctctttgcacggtgatctctcatgtcctgacctctgacccattctcagtctggagaagaaaggccacgtgtacctggttggctggcagaccctgggcatcattgccatcatggatggagtagagtgcatccacacctttggtgctggtgggaccccagtccagatgttcttcctgcttcctcctgatcccaaccattcgggctgctctccaaacactgtcctactcccaacccatgggtgttcctcagtgtcccaccttccctatctaaataggcacttcagtcaaattcttcttccttagaaccccaactcagtccttgatcccttctcagctcccacccctgtgcttaactatggcctcccacaagggctactcctcactctacgccccacttgccacttttcctcccagtcccattttctccccctgaagcctagaaccttcctttcctatatagccaatcactcctctctccttgttcttaaacttcccagatttccgagatgtccgtggctttctcattggtgatcacagtgacatgtttaaccagaaggctgagctcaccaaccaggtcggagaagaacaggacttggggaagctggggagaccactagtgtgctgagggtggaagaaaaggggaaggcggagctaggtgggaagttcattggaatagacggtccagagaagagaatatgggtcagaagtcatgaggctttggcttagcatgggcagtgtggaaagctctagatccagtccccaaacttggccctagtccactgacttgttacataatcttgggcaaaacactgtaccttttgaacttcagctctttcacctgtgcacaaaagtgttagatctcctccacggccccctttagtcctcaagtctgtgctttagagtgttttcatgggagggaccctcccatcttcttctgccccagggtccccagttcaccttctcccaggaggacttcctgacttccatccttccctctctcacggaaatcgatactgtggtcttcattttcaccctggatggtgagagggaagatgggagtggtgaggggtggggagggggaaatagaatggttcagaggagctgttgtttttctgggtcttagggtacctgctcagagggagggacggggtgaatatcctgactggaccccagccaggggagcaggaggaacagctgcacagccagcctttcgactctgatgccctccccttctcctagacaacctcacggaggtgcagactatagtggagcaggtgaaagagaagaccaaccacatccaggccctggcacacagcaccgtgggtcagaccttgctggtgagagtccagccgtgacaaagggacccaggtggcagttgcagccaggccttcctggagatgcctctcctgctcctctttctctctctccagatccctctgaagaagctctttccctccatcatcagcatcacatggccactgcttttctttgaatatgaagggaacttcatccaggtatggggaatgagaaggtcctatctgcagtaaggggctcagagggtgagggattccaagaatcaaaaaacccaaggctgtagggcagaaagtttggagacctctctgaccctcacaaagccagctgggcaaggtcatgggttaccaggttactagtcagaattcccaaggcaatgaactactgggctcagctgtctctaggaatatgcaaaaagttgcgggataggcctccagtcacctgacagatgttcatttgtcctttgggacaggttaattatttttactttgagacagagtctcactctgtcgcccaggctggagtgcagtggtgcaatcttggctcactgcaacctctgcctcttgggttcaagtgattctcgtgcctcaagtagctgggactacaggtgtgcaccaccatgcccggctactgtttgtatttttagtagagatagggtttcctcatgttggccaggctggtctcgaactcctgacctcaagtgatctgcctgcctcgacctcccaaagtactgggattacaggtgtaagccgctgcgcctggctgggacaggttaattcttgataccaaagtcatcatcattatccaaaagcttttaccacaccttttttttttttgcaagtttactatgctgaattcattgcagataactttatgtgcatatagtccctgcttgccaatgaattataatccagcacaaatactgataataattacagaaataataatcagtgtgtgtgctctttgcaatttagagctttgtgtgggcattgggagctctggatgccggtctagctctacagtgtggcccaagaaagcaagcaattttacatctctggttctcagttttctcatacaccacctgcccaccctccatgggcagaatcagggccctgaagggttgctctggagagatgtggtctcttattcgttattcaaaccatgtctgtcagaagtttcctggcttgaccagacacagctgaaacactgacttacctggactcagaactcgtatagaagcggaagtttctctgcccctgaacagggaatccactctccttccaatgtctttcattctttttattttttaaagacaaagtctcactctgtggcccagactaaagtgcagtggtgccatctcagctcactgcaacctccgcctcccctgctcaactgatcctcccacctcagcttctcaagtaggtaggaccacaggcactcaccaccatgactggctaatttttgtattttttttgtagagatcgggtttctccacattgcccaggctgtttgccaactcctagactcaagtgatccacccgccttagcctcccaaagtgctgagattgcaggcgtgagccactacgcctagccaaaacactgtatttttaaagaaaaatgttcattttaacagccatacattttttatagatacattttttatagtaaagacgttacaaattacagaaatgcaaaaaagaaaaaatcactccaaatctaccatcttcaaaaaaaaaaaaaaaacactctaacaaattttggagaatgtccttttaaatttctattatatgcatatataaatatatttgtacaaaagtaagaccatacttgatatgctgttttaaagttgctttatgaacatctttctgtactaatagatcaccatcattttcaaaaattattattattattatttatttttatcatgccgggacatgttctcatctgatagatcactactatcattttttttttttttaagatggagtctcgctctgtcacccagactggagtgcagtggcgcgatctccgctcactgcaagctctgtctcccaggttcacgccattctcctgcctcagcctcctgagcagctgggactacaggtgcccgccaccacgcctggctaattttttgtattttttagtagagacggggtttcaccgtgttagccaggatggtctcgatcttctgaacttgtgatccacccgcctcagcctcccaaagtgctgcgattacaggcgtgagccaccacgcccggccactactatcatttttagtgtcaatgtaatattccactgtatagatgtaccataaattgtttaactccgattatcagacacagagacaacttcaatattatggtttttattaaagtgctgcactgaacatccttataaacacatcttttaggcatttgacttgtttcaccaggataaaccccaaaagcgaaatcactgggtcaaaggggatgtaaaattttgaagctttttgatacatacagccaaactgccctccaaagaggtttataaataaagcgtgaagttgcttgttcccttacacccttatacatactggatagcatccttataaaaaaatctttgctaatcagtaaagcaacaaaagggcattttagtgttattttaatttatatttctttaattattgtgtaggtggactacttaaaaatatatattggccatttgatactttttttttgtctttcatgtactgcttcttgtcttttgggtctatttacccattctttctttggggggtatttttttttcttatttgtaagaaggggtgtgtatagcaaaaacagtagccctttttttcttttctatatttttcccagcttaatattttcttttgtttttacgttttttatgtagagacattttatttaaaatgttacatagtcaaatctatcaatcttttcctttgtgttttttgccttttggttgatgttggttttatttatttgtttatttatttgtgagacagagtctcgctctgtggcccaggctggagtacagtggtgtgatcttggctcattgcaacctctgcctcccgggttcgagcgattctcctgcctcagcctcctgagtagctgggattacaggcacacgcctctatgccctgctacttttttcattttttgtagagacagggtttcaccatgttggccgggctggtctcgaacttcggacctcaggtaatacacctgccttggcctctcgaagtgctgggattacaggagtgagccactgcactcagcctggttttatctttctaaatgaattggaattgtttgaaataaagaggctttgtttgggctggtcaatctttagctatagaaatatttttgacagacgccgtggctcacgcctgtaatcccagcactttgggatgccaaggcgggcaggtcacctgaggtcaagagttcgagaccaccctggccaacatggtgaaaccctgtctctactaaaaatacaaaaaaattacctgagcatggtagtgggtgcctgtaatcccagctagtcgggaggctgaggcaggagaagccgaggttgcagtaagctgagaacgcaccattgcactccagccagggcaacaagagtgaaactctgtctcaaaaaaaaataataataaaaattaaaaataaaaaaaagaaatattttctatgtaaactgttcctacacttttattttgttttgttttgttttcttttttgccttccgaagtgacagtggatacacttttattttgataaaaatcaaacctacagaaaaatacgaaaatggtgcaaggaacacccatatacttttccctagattcatcaattattaacattttgccatatttgcttcatctctttcttttcccctgaattatatgaaagataattggagccaggtacggtggctcatgcctgtaatcccagcactttgggaggccaaggcaggcagatcacaaggtcaggagttcgagaccagcctgatcaacatggtgaaacctgatctctactaaaaatacaaaaattagccaggcgtggtggcttggacctgtaatcacaactactcaggaggctgaggcagaagaatcgcttgaacctgggaggcagaggttgcagtgagctgagatcataccactgcactgcagcctgggcgacacaagactccatctcaaaaaaaaaaaaaaaaaaaaagccgggcgtggtggctcacgcctacaatcccagtactttgggaggctgaggtgggtggatcacaaggtcaagagttcaagaccagcctggccaacatggtgaaacccatctctactaaaaatacaaaaattagccgggcatggtggcacatgctcatagtcccagctactcgggaggctgaggcaggaggatcacttgaacctgggaggtggaggttgcagtgaaccgagatcatgccactgcactccagcctgggtgacagagtgagactccatctcaaaaaaaaaaaaaaaagaagataattggagatgcctgatatgttatactaattactttggtatgtgtcctctaagaacaagggcattcacctacataattacaatatacttttccactcaggaaaatgacaattaatatactattatctattatctagaccatattcaaatttccccaaatattcctgtattgtttttatttcccagatccaggatccaatcaaggataatgcactgcattcagttatcaggtcttttgggttttcctttactccagatgagtttctcagttgttctttatctctttgatgacattgatatcttagaagtaagtccaggtcagttgttttccagaatatgcctcactttggatttgcctgattgtttcgtcatgatattcaggttaaattttttggcaggagtactgcataggggaagttgtgcccttatcagtgtatcacatcgggaggtacctgatgtcagtttgcccctttattggtgatgctacattccatcgtttagctaggatggtgtctgttagatttctctgtatcctattcctcagcaatctttcacccaatggttttagcatccactgatgattcttggttgaattaattattactatggtagtttttcaatggtgattttctatttctatcccttccatctatattcagtagttggcattcttctgtaaagaaaatctctctcatccaggtgcggtggctcacatctgtaatcccagcactttgggaggctgaggcaggtggatcacttgaggccagcagtttgagaccagcctggccagcatagcaaaaccccatctctactaaaatacaaaaattagccgggtgtggtggtgtgcacctgtagtcccagatactcaggaggctgagtcggagaattgtttgaaccaggaggtagaggttgcagtgagctgagatcgtgccattgcactccagcctgggtgatagagcgagactccgtcacaaaaaaaaaaaaaagaaagaaagaaaatctttttcttctctccccgtcctatctaccctatctatctttgtttttttagtgtcaatatggactcatgaattttttgttgttgttaaatgtgttttaatccattcttattattcattatttattttaatgctcaaaatgagagttcattcaagctggttcctgtgtccttgtgacatatccacatcagtatttgaacactctttgttgtgtttctttttgtaaaataataataaccttcttatgcaaaaggtagcatcttttttatatcttgcattttttgcttaagatattctgaaaatcactgcagtgcagtttatagatctcttcctcattattacttattatttgcatttgtgtgtgtgtgtgtgtgtgtgtgtgtgtgtgtgtgtgtaacaatagtttgccctgtcaatctcctatgcaggaacacaaaaccactgacccaggctcacctatactttccctgatccagccctggagtcagtcatttttctgaggagacctgatcttgttagtgggttctagtatttagaaacccaaatgctaggtatgttcactgctactggtgtgtctttgcctctaagccctatcagtagaaagaataagggtgtgtgtatgtgtgtgtttatgtatatatacatgcatacatacatatacatatgtatgtttgtttacatacagatgaatgtgtctgcgtatatatatatatacacacacatacatctatatatacatctatataaatactgtatatatattcccactcttcttcctctttcccttagtgataatgttgatttccaacatcatcaatatatctgccgtctcattccatttccattcatgcctgtagggaattagtttaattagttactggcttatcctcctatgtttctttttggagaaaagtgtgtgtgtacatataagtttgcacttcctatacaaaaggcagtctactatactcttttgtgctttaagaagatattctgaaaatcactccatattggatcatagagctcttcctcattaatttttacctttgtgtgtttccacatatgtaatagtttactcaggcaatctcctatgtaggacatataggtttcccatattttgctatgatcaatcatgatgtaatgaatgtacatgtatttttataatgtcagaagagtatctttgggataaattcctagaagtattagagctgggtcaaacggtacatacatatgccattttgttagatattgcaaaatttccttccatagggtttactattttgctttccataccagcaatatacaagaatgctgctctcctacagcctcttggagagttttgtgaagtttttggattttgtcaacctgatagattagaaatgccacttctgtgtagttttcatttatttattattattttattactattattattattgttttttgagatggagtcttgctctgtcacccaggctggagtgcagtgatgtgatctcagctcactgcaacctctgcctcccaggttcaagcaattcttctgcctcagcctcccaagtagctgggattacaggtgcccagcaccatgcacagttaatttttgcatttatagtggagacagggtttcaccatgttggccaggctggtctcgaactcctgacctcaggtgatctgcccatgtcggcctcccaaagtgctgattacaggcgtgagccaccacgcccagccttattttattatttttttgagacagggtctcattctgtcacctaggctggagtgctgtggtgtgatcatggctcactgcagcctcaacttcctgggctctggtgatcatcccacctcagcctcccgagtgactgggactacaggcgcttgccaccatgcctagctaattttgtttcaccatgttggccaggggtgtcaccatgttggccaggctggtcttaaactcctgacctcaagtgatccactcgcctctgcctcccaaagcactgggattataggcgtggtccagaaagctttttctaacatctaaattgtaaaggaattccatccatgttttctgctagtagagatggtttctttttttcttttttaaacacttagatctttaatttattgggagtttattcttgtgtatggggtaaggcatgaatccaattatttatttttccaagtgattatccaattgttcgtatatatatatatatatatattttttttttttttttgagacagaatctcactctgtcacccacgctggtgtgcagtgatgtgatcagatttcactgcaacctcaaactcctgggctgaagcaatcatcccacctcagcctcccaagtagctgggactacaggcacatgccaccatgcctggctaattaaacaaaatttttttttttttttttgtagagacaggttcttgctatgttgcacacgctggtctcaaatccctggcctcaagcaatcctcctgtcccagcctcccaaagagctggggttactggggtgagccaccgtgcctggctccaatataatttttttaagttcatcttttcctgagtgatttaggatgctatctgtgtcacatactcaatttctatgtgcattggtctatttatggactttctattctgttccactggtttgtctattgatgtgctggtaccatatgttttaattatggaggcgttatggtatgtttggtatccaatagggtttgttcttcattcttgtttttttttttttttttttttttttgagatggagtctcattctgttgcccaagttggagttcaatggtatgatctcggctcactgcaacctccgccccccaggttcaagtgattctcttgcctcagcctcccaagtagctgggattacaggcacgcgccactacaccaggcaaattttcttttgtatttttagtagagatcaggtttcaccctgttggccaggctggtctcaaactcctgacttcaagtgatccactcacctcagcctcccaaagtgctgggattataggcgtgagccactgtgcccagcctattcttctttttaaggattttcctggctatatccaggccgatttttccatgtgtactttaaaatgaatgtgtcgcactccaaattttgtaaaatttaaaatatttttgtgttaatggtgttaatgttaatggtatcaatggttagtggtataacctagatctaattgacctctctcccaaagtgcagtctgacacgcaccctatagcatcagtactgcatacttactggccagtttcatgctgaaatttcatgctgttcttatatttagtgtcgtggacattcacttattaaaatgttttcaatataccctcttccagggttttgtgtgaacagctatttctagagttccagaataaagaggtaaaagtagcagtagcctgtttcctcagcctggctaggaccacgtgtattagtaccttttttttttttttttttaatatggagtctcattctgtcgccaggctggagtgcagtggcgtgatctaggctcactgcaacctctgcctcctgggttcaagtgattctcctgcctcagcctcctaagtagctctgacttacaggtgcttgctaccatgcctggctaatttttgtatttttagtagagacggggtttcaccatgttagccaggatggtctcaatctcctgacctcatgatccgcccaccttggccagtacattttcatactgctctaaagaactgcccgagactgggtgatttataaaggaaagaggtttaattgacccacagttcagcatggctggggaggcctcaggaaacttacaatcatggtggaaggtgaaggggaagtaaggcatcttcttcccaaggtggcagaaaggagaagtgccaagtgaagggggaacagcccccttataaaaccatcagatctcatgagaactcactatcccaagaacagcatgggggaacgccccctgccccccatgattcaattacctccacctggtctctctcttgacacatggggattatggggattacaattcaagatgagatttgggtgaggacacaaagcctaaccatatcaccagttaattaatcccctcaacacctttactgggccccagtttccctgctaatgtgccaataggtgttataagtgccccaaggtggacaagatataagggccaaaaacaaggggcagttttatactcgcgataccacatgtttgaacaattttttagttttcaacatgcctttacataggttctctcattcatccaggagatatttgtggcaaagtaggaaatgccctcatcattgaatcagaagaccgggatttaggtcctcattctccatctcgttatcatatgagcttctccaagttaatttacttctgacctctagtttcctcatatgtagaaatgaggataggtaaacttattctgtagggctgttagaaaaattaaatagaattcatttttcaacaaacatttttttttcccctgagacatagtctcactctgttgcccaggctggagtgcagtggcacaatctaggctcactgcaacctccacctcccgggttcaagtgattcttgtgcctcagccccccgagtagctgggattacaggtgtatgccaccactcctagctaatttttgtgtatttagtagagacagcatttcatcatgttggctaggcttgttgagaactcctgacctcaggtgatcccccaaccttggcctcccaaagtggtgggattacaggagtgagccactgtgcccggcctcaacaaatgtattgatcagcaaatatgtgtcagtcatggtctaaaaaactggggccctggagcagaataagtcaccatctctgccctttcaagaagcctgtggtttagtggaatgaatcccactcctcctgtctgatacccggggagaaaaaggaacaattcagcaggatcaaaattctaatatggaaggactcagagaacatgtctgtctacctaggggtcaaaaacacaaatgggtgaagctaccaggtttgcctgagacaatcctggtttacatctattgccctaacatttaaacgctgggctgctcaaacaaatcatgtttgcattttggtccctggttcttgacagttggtttcctgtctgataacagggccctgttcactctgctgcttttctgtcctctaatttttgacacccccatgtgtctgcccttttcagaagttccagcgtgagctaagcaccaaatgggtgctgaatacagtgagtacaggtgctcatgtgcttcttggtaagatcctacaaaaccacatgttggaccttcggattagcaactccaagctcttctggcgggcgctggccatgctgcaggtagggatatgatggggcagggttgggtgggacctggcctcaatgcttaggctgccagaggagggcattttgtagagatatggaaatgtgcaagggtacaggctgccttttctgtgtgcttctgctcctcctattaggtgcatcttccccttaaggagtgtgtgtgcacacatgggtgtgtttgtgaaattgtaattattaggcaagactctttcagttacaaacgtgatggaaaacgagtttatactggtttaagctaaacaaagaaaatggtggctgatataactgaacaatcttagggcagctgaatctaatgtgttccagaactttccacccttaactctgttttcccctgtgttgctctcattctttttttttttttgagatggggtcttgctctatcgcccaggctggagtatagcggtgctatttcagctcagtgcaacctccgcctctgaggttccattgattctcctgcctcagcctcccgagtagctgggattacaggcaccccccaccatgcccagctaattttatattttttagcagagacagggttttgccatgttggccaggctggtctcgaactcctgacctcaggtgatccacctgcctcagcctcctaaagtgctgggattacaggcgtgagtcactgcacccggccgttgctctcattcttaggcaagttttttccattaggtggcaaactggccaccagtagtgccagcctgacaatttacgtagcaacactagtgggcaaagagcttgcctgtcctgtggttcttgcaaatgcctggttgggggctcttgcttgggacacatgcatgtccctgaagcaatcactgttctccagagcaagggatgctctgcccagtctggatcatgtgctttcccttcaggatggtggtggaagaagggctgggaggtgagcctcaatccaacctcattacctgagcatggggaagcgatagatcctcagaggaaaaccaaggtgctgataccagaaggagtggatgttgagcagacggcacaacagatggtcatgaaaatggggtcgccagattcggcaaataaaaatacaggacgcccagttaaatttgaatttcagataaatatggaataatttttccatcaagtatgccctatgcaatatttgagatatttttgatttttttcattatatatttggatgtcctgtatttttattcacaaaatctggcaaccctatgtgaaaggaatcaatcaatgaacatttagtgagcacccaccaggtccccaaaataaactatggtccttactgaagtccagtggaggtataaagaaggtgggggtcagaatgcattatagcaaaaagaaggcctcatggaaggggtggtattttgagctaggcctggtggttatggcttggataggtggacagaagagcattcctgttaggtcattcaccaagtcccagaagggggactgggcatgatatgtgagggacacaggtctaaccagagtggcaagtcactttagagcgcagtgagggattgtgaagaagtaggaaggggagggatgtgggaggttaaagccaggcaggaatttggactttgccaaatgcagctagacctgcgctgtccaaaacattggccaccagccacatgtggctattgagcacttgaaatgtggctaatgtgactgaggaactgaatttttaattttatgtaaaaaccaaagctgtatactttttaaattaaatgtaactttaatattttggtaggactacatttctctttttagcattgcaaatctagcacccaaattgaggtgggctggctgggcacggtggctcacgcctgtaatcccagcattctgggaggccgaagcaggcagatcacttgaggtcaggagttcgagaccagcctggccaacatggtgaaaccccgtctctactaaaaataaaaaaaataaaaaaatagccgggcatgttggcacaggcctatagtcctgtctactagggaggctgaggcaggagaatagcttgaatctgggaggtggaggtttcagtgagccaagatagtgccactgcactccagcctaggtgacagagtgagactatctctcaaaaaataaaattaaaattaaaaaaagccacaaaaaaacaaattgaggtgtgctctagttgcaaaatacacactggatttcaaaatacaaaatccgaatatagaaaaatattgcaaaatatctgactaataatgtttaatattgtttacattgggttatatattgggttaaataaaatatattattaaaattgatttcaggccaggtgtggtggcttacacctgtaatcccagcactttgggaggccaaagcgggcagatcacaaggtcaggagaaataggtgaaatcacattttttttttttttgagatggagtctcactctgtcacccaggctggagtgcagtggcatgatctcggctcactgcaacctccacctcctgggttcaagtgatcctcctgcctcagcctcctgagtagctgggattacaggcatgcgccaccacacccagctaatttttttttttttttttgtatttttagtagagacgggatttcaccatattggccaggctggtctccaactcctgaccttgtgatccacctgcctcagcctctcaaagtgctgggattacaggtgtgagctgctgtgcctggccaatttcacctatttctttttttaatgcagctactgaaaacttaaacttacatatgtggtttgcattatatttttttctttatttttattttttttagagacagggtctcacgctgttacccaggctggagggcagtgcattggcaccatccggctcactacagcctcaaactcctgagctcaggcaatcctcccacctcagcctcctgagtagctgggacgataggcaggtgccaccatgcccagctaatttgttttattttttgtagagatggggtcttgctgtgttgcctaggctggtctcgaactcctgggctcaagtaatcctcctgttttgacctcccaaagtgctgggattacaggtgtgacccactgtgcccagccttgcattatatttctactggacaatgctgagctagacagagaggagggtagtgacaaaatggaagcagtgtttgcagatgaacagtcttacattagtgtgcaagatggatttggttacagaggaaactagagagagggagtccagattaccaacctacaggattggtgggacacacatgcaaatttgagcaatttgccattaatcctccagtttaacccagccagtcaagcccaccaccaacccctttaacctagtttttctttacacctgggaattacaatttaggattgccaacatggacaaatcatctacagcctctatagccaggcctcgggatcccagcctctcactctcatagtttattcttctcccttgactccattcttagttcctctggcctttagcctgacactgatcttaccacttcttccttagcggttctctggacagtccaaggctcgatgcatcgagagcctcctccgagcgatccactttccccagccactgtcagatgatattcgggctgctcccatctcctgccatgtccaggttgcacatgagaaggaacaggtatcctgcccactgctggtcattcaacaaatactttttgagtactttcagtgtgtcaggaagtttgttcggcactgggtttacaaagctcagtggcactctgctcacaaggacctccacattcatggggtctttggactgggttttgaaggatgaataggagttttcctggtcaaagtgaaggtttctttctgctcttaatccaccttgttaccaccttctaatcttaataacatcctatttgcatctaacctagtggctcctgattcctgtatcaaatgctttaactcctccagggttctgttttttttttttttttgagagagagtcttgctctgtcacccaggctgctggagtgcagtggcgcgatctcggctcactgcaacctctgcccccgggttcaagagattctcttgcttcagcctcccaaatagctgggattacaggtgccagccaccaatgcctggctaatttttgtatttttagtagagatggggtttcgccatattggccaggcttgtctcaaactcctgaacttaagtgatctgcccacctcggcctcccaaagtgctgggattacaggcgtgagccactgcgcccgaccttcctccggggttctttctctgatgacctcattccctcaggcttcagtgcccactgcctcttccccacaggtgatacccatcgccttgctgagcctcctattccggtgctcgatcactgaggctcaggcacacctggctgcagctccttctgtctgtgaggctgtcaggagtgctcttgctgggccaggtcagaagcgcactgcggaccccctcgagatcctagagcctgacgttcagtgaacccatgtttctgggtgggtgaaaggggcccaaccctgcccacttcagcccagcccgcccaaggggacttgtgccagcagaacatgtgggaggaagaagccccgtttccagggcatccgcagcccagggtagggagaaatattctctccactttgggggagagttcttgctctcgacctagtggtttctactctcaccgacttattctgatttcagaaataaaatgaaatgtcttattttggaaagttaacctttcaaagtcagtaaatcaaacagtagatcagaggtgggataggatgggtggcatgggttggtcttaacagcagatttgtttctttaattctgtccccaactccatttcattggtccctaacacaagccttatactggcatccctatattttcattaccaacatgcagccacgtgtgcatgcgtgcacacacactccaatcccacacagacacacaatgagaggtgggaacttttagataattccaggggaagagggaagaagttgtgtacctaacataggaaacccagaaaaagggcagtcttaatcagacatgacaagatctagaatgactgctacatccacgcattagaccatgaaatgagggtcacatcccctgccccgtgtttgtaagaggaacataaggaactctggaggtgctgaaagcccttggtggtgggacccaacaaacactagaaaccccgggctgtacattttagacatcagctaccccatgttttgacaaatcaaagacacccttgttcatcctagattcatgccagctctttagggcctgtgatatatggccctgacagtagagagctggttcctccttgtgcctgagaaatatccaggtaatagatactcaggaacattcctctggggatgaaactctctggaaaggtccctggaacttttaggcaggagggtgactgcaaaggagccagattttggttttatgaggatagagtaatcaacctttttaaggtggccataggcccctctgtgcatctgagggcctgcagcctctatgtgagctctgttttcctgttccacatcttcacactgatgccttggatgatcagtaatccccctttccccagccactactctcacgatgcttcctgagtaccacccctttcatcttccacaaacacctctcccaaattcaagatggctaaagttaggaaaggctcctgcaaagtccctctgcttctcttcacccacaactctctaccacgttctttcatcgggtcagttcatctctcagcatggtgtcatgaacagtgtcaagtctgagaagatacctagcattctgggaccccaaagggcagagcaccccttgatcctgttgatgatgccaactgtacagtagctcccctcccacatttggaggggatagggcacagggttagatttctccagggctggatgcagaagaactctagaagccctgagttcttttagttgccaagtacgtggatggcatgaagacatcaagtgaattcaattcttatgtagttggacacaatattcaggtattatgaatattgtgggacattattgtgggacattatgaatattgtgggatagccttgggggacattagaagctagacacactctggcattgtggcagagatgaagatgactaagatctgatgcctaccccctagaaactcacaagcacatagcaattagaatacaagacagagttgaagtggattaaacagcgggataagtacagagagctgctgaaattacagggtaggccaagagtcaaggaaagttttggaagaaaggaggctggggtggggtaaaggaacagccaaagaaaacgcaagaaggtttgaagattcacactgggatatggatctgatagcagagaatctggtcattgtcaatgggatttgtgctccaggcagagctaaagaagttcaaagatttttttagaactatccagacacaaatgatagggtgacaacttttgcagttatttggagaaagtaaacatctgagggcaaaaacagcaagagaataatccattattaatacaaggcagtaattatgtagaaaggactaaagggcctgggcctgaagactggattagattgtggaagatgaagaaaacaatttcccagcacatatatttgctggatcaaaagcaaaagggggctaggtgtgccatcctagctacttgagaggctgagatgggaggatcacttgagtccaggagttcaaggccaggctgggccacattacaagaccctggctctaaaacagaaaaaaaaaacaagagggggtgggacaaaatatatttggatatcgcacatactctaagcctgacgttatacacacacacacacacacacacacacacacacacacacacacacatatatatggaatatataatatatatccatatatatatatggaactcatgaactcgtctccaaaatctagctagctattcttttcataatttagatggtctctctctctttttttttttttttaaggaaagtgtctcactatgttgtccaggctgcagtgcagtggtgcggtcatagctcactgcagcctcgaactccttggctcaagcaatcttcctgcctcagcctcccgagtagctaggactacaaatgtgcaccaccacacctggctcatttttaattttttttttgtagagatggggccctgctatgttgctcaggctggtcttgattcctggcctccagtgatcttactgctttagccacccaaagtgctgggatcgtgtgtgtgaaccaccacacctggccaacattcgtccggtctaacattcagattgttttgaatgttacacagcctggagccagctcttgaatattagataagctataacgttgaaagaggatgttgggaccaggtaggagacagaggggtctccatctggttccagggatgggctctacaaatacagcaaaatgcctaagatccaatggaaacttagggttggacccaattggacaggtgagtcaaatcctagggttgagaggacaggtactatatctaggtgatgcaaaatgctcccatcctgggagagagaagtgggtcatttttaagctagtaactggggtgctgtggaaaagacaaggaaaaagacaggaagaggatccctggagcatcttgtagtcacagaaagtaaagaattgctcaaaacctccacaaggatgacaatatgtcaaagggatacaagagccaatgtgaaagagctcctagtgcctaaagtgggaacaatttgagcaacaaaataagtaacaagctggtcatggtggtaggcgacagcagtcccagctacttgggaagcgaggtgggaggatcgatttcttaagcccaggaggttgaggctgcagtgagctgtcatcatgccactgcactccagcctgggtgacagaatgagaccctgtctcaaataaataaataaaattaaaaaaaacacttggtttaaaaaaatacatgagtacgcgtgaattcgtaccgttataagcaaatgattgaataaataaagtgggggaaagtaccaatttttcctaaagaagaattctaaataaacacacacgcgcgcgcacacacacacacacacacacacacacactcctttaggaaatggagcttaatcatcccacaccacctctcctccaatgtgggttagatttaggggctcacttacaaaaaaacagagtatgggaaagggaatgggttttacggtggagaaaccaggcaagcactaccctaatcaagtaatcaagatgggcatcaccagcaggtatcacgcacctcctgatatgatatcatgagaaaggcatgtcacctctgtggtattcttcccccaaacacataacctcagtctaagcataaagaaaacatcacagtaacccagctttagggacatattataaaatacctgctcatattacaaaatacctgaaaattttcagtcatggaaaacaagaaaagactgagaaactgtcatagaccagaagagactcaggaagcatgactcacctacagggtgctaccctcggttggatcctggaaagataaaggactttagtggcaaaactggtgaaactgcatgaaatctggagtttagttaatagtaaatataccaatgttaatctcatagttttgacaaacgtaccaaacttatgtaagatgttaatgttaggtgaaactaggtgaaatatatatgggaatttgctgtactatctttgtaacttttctgtaaacctgaaatttttcaaaaataaaaagtttattcaaaaaataaatttaaactgaaagcctttcctcttagatctggaacgtgacaaagatccccactttcaccactgatattcaacacagtactggaagtcctagctagagcaatcggacaagacaaagaaataaagggcatccaaactggaaaggaagaagtcaaattatccttatttgaaggagatgtgatttttttttttttttgagacagagtcttgctctgttgcccaggctggagtgcagtggtgtgatctcggctcactgtaacctccgcctcccgggtccagtcgtttcttctgcctcagcctcctgagtagctgggattataggtgcacaccaccatgcctggctaattttttgtttttttgtttttttgtttttttttttagtagagacggggtttcaccatgttggtcaggctggtcttgaactcctgaccttgtgatccacctgcctcagcctcccaaagtgttgggattacaggcttgagccactgcacctgtcaagatctctacaatgaaagctataaaacactgatgagagaaattgaagatggcacagaaaaatggaaagatattctataatcatggattggaagaatcaatgttaaaatgtccgtagtacccaaagcaatctacagcttcaatgcaatctctatcaaaatatcaatgacattcttcacagagatagcaaaaacatcctaaaatttatatggaaccacaaaagacctagaataaccaaagctatcctgagcaaaaagaacaaaactagaggaatccattacctaacttcaaattacattacagagttatagtaacgaaaacagcatggtactggcataaaaacagatacatagaccaatgtaaccgaatagagaactcaaaaacaaattcacacacctgcagtgaactcgtttttgacaaaggtaccaagaacatacattggggaaaagacagtttctataataaatgatgctgggaaaattggatctctgatatggtttggttctgtgtcgccacccaaatctcatgttgaattataattcccaatgttgtgggaggggccgggtgggaggtgactggatcatgggggtggagttcccccattctgttttcatgatagtgagtgagttctcacaagatcttatggtttaaaagtgtgtggcactctcccctttgtgctctctctctttcctgctgctatgtgaagaagatgttggcttccgcttcaccttccaccatgattgtaggtttcctaaggcctcccagtcatgtttcctgttaagcctgtgaaactgtgagtcaattaaacctcctttattcataaattacccagtctcaggtagtatatccatatgcagaagaatgaaactagacccgtatctcttgccatatacaaaaatcaaatcaaaatggattagagacttaaatctcaaactatgaaactactatcagaaaacactgggagaaactctctaggacattaccctgggcaaaagtttcttgagtaattctctacgagcacaggcaaccaaagcaaaaatggaaaaatgggatcacattaagttaaaaagcttttgcacagcaaaggaaataatcaacaaagtgaagagacaatccacaggataggagaaaatttttacaactacccatatgacaagggattaataactatatatatgtatatatatatatatggagctcagctctataggaagaaatctaataatccaatttaaaaattggcaaaagatgtgaatagccggccaggtgcggtggctcatgcctgtaatcccagcactttgggaggccaaggcgggcgaatcacgaggtcaggagttcgagaccagcctggccaacatggtgaaaccctgtctctactaaaaatacaaaaattagctgggcatggtggcacgtgcctgtaatcccagctactagggaggctaaagcaggagaattgcttgaactgggacccagcaggtggaggttacagagagctgagattgcaccattgcactccagcctgggctacacagcgagactccgtctcaaaaaaaaaaaaaaaagaaaaaaaaagaaaaagaaaaaaaaagatttgaatagacatttctcaaaagaagacatgcaaatggcaaccaatcatatgaaaaagtactcaacatcactgatcatcagagaaatgcaagtcaaaactacaatgagatattatctcactccaattaaaatggcttttatccaaaagacaagcagcaacaaatgctggagagaatgtgtagaaaagggaacacttgtatactgttggaatgtaaattagtacaaccattacggagaacaataccactgctggatataaagacaaaagaaaggaaatcagtatattaaagagatatctgcactcccatgtttgttgcagcactgttcacaatagccaaaatttggaagcaacctaagtgtccatcaacagatgaatggataaagaaaatgtggtacatatacacaatggagtactattcatccataaaaagaataagattctgtcatttgcaacaacatggatagaacttatttcacttattatgttaagtgaaataaaccaggcacagaaagacaaatgttgcatgttctcacttatttgtgggatctaaaaatcaaaacaggctgagcatggtggctcacctgtaatcccagcactttgggaggctgaggcaggtggatcacctgaggttaggagttcaagaccagcctgggcaacatggcaaaaccccttctctactaaaaatacaaaaatcagctgggtgtggtggcaggcacctataatctcagctacttgggaggctgaggcaggagaatggcttgaacctgggaggcagaggttgcagtaagccgatatcgtgccattgcacagcagcctgggtgacagagcaagactccgtctcaaacaaacaaacaaacaaataattgaacttatggagatagagaatagaaggatggttaccagaggctgagaagggtagtggaggggtagtggtggggaggtgggaattgttaatgggtaccaaaaaaaatagaatgaataagggtgggcacagtggcaaatgcatgtaatcccagcacttttggaggctgaggcgggaggataatttgagccaggagttcaagaccagcatggttaacatagcgagagcccatctctacaaaaaataaaagaaaaattagctaagcatggtggtatatgcctgtagtcccagctactaaggaggctgaagcaggaggatcccttcagcctgggaagttgaggctgcagtgagccatgattgcatcactgcactccagcttaggtgacagagcagtatcctgtctcaaaaaaaaaaaaaaaaaaaagaataaggcacagtatttaatagcacaacagggagactaaagtcaataatcagttaattgtacatttaaaaataattaagagtgtaattggattctttgtaacacagaggataaatgcttgaggggatgaatacacaattttccatgatgtgattattctgcactgcatgtgatatggtttggatctgtgtcctcacccaaatctcatgttggattgtaatccccagtgttggggatggggcctggtgggaggtgattggatcatgggggtggagtgctcatgaatggtttagtactataccccttggtatagtgaatgacttctcaaaagagctggttgtttacaagtgtgtgggacctcattctctatttcttctgcttcggctgtgtgaaatgagcctgcttccctttccccttctgccatgagtgtaagtttcctgaggcctccccagcagctgctgtgcttcctgtacagcctgcagaacagtgagccagttaaatttcttttcttcataaattacccagtctcagatatttctttatagcaatgcaagaatggactaatactaatcatagtatcataattgtgttatggaatatgtattatgatctaaaaataaaaacatgtattatggaatacagtatcataatacaaatatctcatgtatttcataatatatattatgtacccacaaacactaaaaattaaattttttaaaaaattaaaaataaatatataaagttaaaattcctaactacaataacatatatttgggaagggataaattgagttaaaatattctaagggccttgatttttccataaagaagataaaagtttttattaatttaaggctttgataagctgtgtgcatattgcattttaaaaggtatctgctaaaaacagggttggcaaactttttctgtagagatagatagtaaatattttagtctttgcaggccctgtggtctcagtcattactgttcaactctgctgttgcaagcttgaaaacagccgtagacaatatgtaaaatgagtgtggctgtgttccaataaatcttcatttgcaaaaacaggcagcatgctggatttggcccacaggccatagtttgccaagccttgcactaaaagaataaaaacagtataatttctaattagtaaagggggaaaatgaagtaattaaaaatagtcatctaattgaaaggcaagaaaagagagaaaaagactgcgccaggtggctcacatgtaatcccagcactttgggaggctgaggcaggtggatcacctgaggtcaggagtttgaaaccagcctggccaagatggcgaaatactgtctctactaaaaatataaaaattagctgggcgtggtagcatacatctgtagacccagctactttggaggctgagaaaggagaatcgcttgaacctgggaggcggaggttgcagtgagccaagatcacaccactgcactccaaagtgggcaacagagtgagactctgtctcaaaaaaaaaaaaaaaaaaaaaaggagagaaaaagaaacttaaaatataggacaaaacaggaagtactaagaggacagatcatggcccaaatactttggtaattacattaaaggtaaatgaaatacatgccccaattaacactttttttgttatagatgtgtctcttgcaaacagcatatatatggattttgtttattttgtagccagtattaaagcaaaggcatatagaaaggttgatagtaaaagaatgggaaaagatatactgtgaaataccaaccaaaagaaaatagctatggcaattgtcatgccagaaccctattgacttcagtagggatagcatcatgttgcagaggctagagaagagacctggagctagcaaagaagacattgggcttattgagggaaattacatacagggcagtccactggtggtgggctaaacaggagaaccaaactgcttataaaaagcatgcagtttatatagtattttcacttagcaccctcctcctagcaacctcctcctggcaactttcatttaactcaaaacaaaaggcttcagtcccctgtatgtcctgcatgtcacaggccatgccgggggttcagatgttcattatacataaggaataaataaatctccagattggccacttctggattccttagcttggaaatccaaacacacattcttcttagaacacagggtcattctcaggctatgcttaagttaagttgatactgtcagatgtatctgccatacagggtcattcttaggggtatgcttaagttatgctatcaggtccatctaccgtacagcaatattaatatcagacaaaataacttaaggccaaaagtattactagaaatgaacagggacttcatagtgttaaaatatttaatttaccaggaatgtattgtgattttaaagaatgattaaaaatatataaagcaaaaatctacagctctcaaaggagatataaacaaatacacaactgtattaataggtgattctacatgcctgtcttagtaattgatggataatcagacaaa

SEQ ID NO: 346 - DNA, 23119 bp, Homo sapiens
aaatctccctgccttagccttctgagtagctaggattacaggtgcctgctaccacgcccagctaatttttgtattttttagtagagatgatgtttcaccatgttggccaggctggtctcaaactcctgacctcaggtgatccgtccgcctcagcctcccaaaatgctgggattacaggcataagccaccatgcccggccccaatccaggctttctaaacctgttgccaaagatgcatctgtaggatcagatacaaaaaaattagctgggtgtggtggtgcatgcctgtaatcccagctacttgggaggctgaggcaggagaatcgcctgaacccaggaggtggagtttgcagtgagccaagatcgtgccattgcactccagcctgggcaacaagagcgaaactccatctcaaaaaaaaataaagaatagcaaggacaccaagcacccccattcccggccctggactttgtccatgtgttaatggtggagggtgtccaggttcttggcatcttgaacgaacaattggacaaaatgcacaaacaaggaaggaatgaagggttttattgaaaatgagccgggcgcggtggctcacgcctgtaatcccagcactttgggaggctgaggcgggccgatcacaagatcaggagattgagaccatcctggctaacacggtgaaaccccatctctactaaaaatacaaaaaaattagccaggcgtggtggtgggcacctgtagtcccagctacttgggagactgaggcagaatggtgtgaacccaggaggtggaggttgcagtgagccaagattgcgccactgcactccagcctgggcgacagagcgagactccatcccaaaaaaaaaaaaaaaaaaaaagacaatgaaagtacactccacagtgtgggagcgagaatgagcataggggctcaaaggccctgttaaaaatgtttgtgagtttaaataccctctacttggggaatgccctatgtaaatgaagaagatgaagtaaagttacaattgcaaagttattaatgatgtatgccctaaggagaggatatttcctgttatagatgaagtgtgaattggccttatgttacctgcctccagaccctattttcctgcctcatctgccccctgagatgtgatccccataaatctttatgggaggcagagggacagatggtcttttttctgtaactgcttcatgctggcttgggggatggtccccacctattagggatcatggaactctcaccctgctctgtctagtggaggcagggtagctttttgatggccaggggtgatgtcttcacctggaactggctggaagctttgttgcatgatcagctgaagcttgatggtctctaggcaagaggaaatgaatttggttaaaacatttaatgggaactgcagggggtggatacctatgctgttagaaatgtttgttatattgaccaggcgcagtggcttacgtctgtaatcccagcactttgggaggccgaggcaggcagatcacgaggtcaggagttcaggatcagcctggccaacatagtgaaaccctgtctctactaaatacaaaaaaattagccgggcggggtggtgcatgcctgtaatcctagctactcaggaggctgaggcaggaatgttgcttgaacctgggaggtggaggttgcaataagctgagattgagccactgcactccagtctgggggcgagggagtgagactccgtctcagaaaaaaaaaaaaagaaaggtttgtcatagagatttgcaggagaaaaaaaacttggtctgttttagaatctatgtgtttccttaaagtcctagcatgagcgactccattttggtttggtttgttgaggcctagtgcatgagcctagtccaaaacaatggccttccataattttgtttaaaaaattaccctttttggttaggctgtcatttaagtgagagtgtgaccaaaccttagggacttagcgccactctcagttaccatcattttgggtttcctatctcagcacatcatttatagcttatagtgtccttatggttgcacatttttttagctcctgttattccagttgaagagagaccatttgacattctagagatggctgcacgcaagcatttaaaacctttgagagaatagagcgcaccagggagactattattatgactatcgggaggatgataccaagagtttggagtatgctccttacccaggttccccataaaccaaaccacctaaaatcacatagatcaaagaatgaactagataaagagtttactcatggccgggcgtggtggctcatgtctgtaatcccagcactttgggaggccgagatgggcagatcacctgaggtcgggagttcaagaccagcctgaccaacatggtgaaaccccgtctctactaaaaacacaaaattagccaggcatggtggtgcatgcctgtagtcccagctactcgggaggctgaggcaggagaatcgcttgaacccgggaggcagaggttgcggtgagccgagatcgtgccattgcactccagcctgggcaacaagagcaaaactccgtctcaaaaaaaaaaaaaagtttactcatttgactaagcagtctctttgttaatcccctaccactatatttctataatcttcatgtgatgtatttctccgtaggccacaagtgccagcagctgcacagatacttctctgtttagccaattctatcttaactttcacaagagaatttaaagtctattgtataactgtagcctttacagtagaatttgctatagaacccatcatgagggatacttttttttttttgagacgaagtttcgcttttgttgcccaggctagagtgcaatggcaccatcttggctcactgcaacctctgcctcccgggttcaagcgattctcatgcctcagcctcccgagtagctgggattacaggtgcaccaccatgcccagctaatttttatgtatatatatatatatatttttttagtagagatggggtttcaccacattggctagactggtctcaacctcctgacttcaggtgatccacctgcctcggcctcccaaagtgctgggattacaggcataagccaccgtgcctggccccattaaagttttttacctgcactgggccttcattttttatctattaaagtataaagttatccatatataaggttggctgcaaactccttcacaaataaaagtacatcccattagtgcacataacagatgccttttccacttttattgttcatagaggcataagcaagaacaaatattgaaagataagagttttatgacagtagaagtcttaatctgtgaatttgggaaaagcttatttacatcaaagatgccatcctcggtcaggcgcagtggctcacgcctgtgatcccagcactttgggaggctgaggcgggcggatcacctgagatcaggagttagaaagcagcttgtccaacatggtgaaaccccgtctctactaaaaatataaaaattagcctgatgtggtggcgagcacctgtatacttgggaggctgaggtaggagaatcgctattataaaaagtagaggttcctcttcaaagactttcctccccatctaattagggataaatagtaacttctcttagaagcaaaatttattcaaagatctgtggtgacattcttaaatatctgcaagtcataataaagaaatcaatgtcctttatgttcttagctcccacaatgtagcctaaatatttgccctggcatgcttatactggtccaaacaaacattaggtcatagcctgttcctcatccttatttgaaggtgtttttacctttctcagcattccacaagttacttccccttcctttgttctcctctgcctttgcctcttttaaaagttctaagttgctagccaatcgggacaaatacaaaatgtgaagtcccattccagccaatggaaaccggacacagcagtagggtggacgcgtcaggttataaatgaccctgtctcctttgttcagtgtactctcatggcaaaactgctgacgagggtaccctttctgcagaaagtaaaaatggccttcctgaggaaattgaatttatgttcaagtgctatttctttacggcactggggaacaagcatttcttttttaattttttttatatttaatattaaacatttaatatattaagtgaatacattcaaatctgcaaacaatacatctaggttgtagaagagttaaaaaaatccctccactcagtttttgccaaaacaccacctgtaagcactgagaagcctactgatgcacgcattatcctttgggccaatagaaacaaacgttttaataaaatgctttcccagtggtcaaattgtcttcctgagtaaagctaaacttgttgtagtgagaacaggtagtgtttatttctagcttcttctgggttccaggttacctaagacccaagggtaatgacaatgggcagctccactttattaaaagccaacatttagcccagacattttattctccaaaaattagcaagcatagctttacattcaagttgggtataatgactttattttcccagtaattccctaaataaaacattattacaaaaaatgactcttcccagtgcaaaatcttaacattttgcttttatgagcaaaagcctgtattttacatattttttttttgagacggagtctcgctgtcgcccaggttggggtgcagcggcgcgatctcggctcaccgcaggctccgtcccccagggttcacaccattctcctgcctcagcctcccaagcagctgggaccacaggcgcccgccaccacgcccggctaattttttgtattctcagtaaagacggggtttcaccgtgttagccaggatggtctcgatctcccgacctcgtgatccgcccacctcggcctcccaaagtgctgggattacaggcgtgagccaccgcgcccggcctacgtatttcttatattgatttttacattttcaggttctcaaaaggacttactcattttacctgtaacacttggacgtctgaatgtaacatgcacttgaaaaaaaaaattctatcaccttggataggatagtgatggaggagaatgttgacattgactatataccctcacctagtattctgtgtaaaatcatgtttccctaaagaggactctgatttgtccagttgcatccttgcaacttggcacaggttggcaggtaaaaatgacctttctgtagaagtagaagcctattcttcacatgtaagttttgattactactattttatcacatcttaaatatataaatctcaggctgggcgtggtggtgcacgcctgcaatcccagcactttgggaggccgaggcaggcagatcacctgaggtcgggagtttgagaccagcctgcccatgaagaaaccacacctctactaaaaatacaaaaccagccaggcatggtggcacatgcctgtaatcccagccacttgggaggctgaggcaggagaaccgcttgaacccaggaggcagaggttgcggtgagccgagatcgtgccattgcactccagccttagcagcagccattgcagtctttttagatgcttgcttagccttttttgcttccttagcagccctgatagcttgttctcgtcgagtctttctaacttcaggtttctgattcctcttggccgttatatcagcaagagatgcaccagtaatggccctctggaatttgactgctcggcgggttcttttcttttgaatttcttccgactgcccctttttgtgcttccttctgtagaggacagtccagtttatctgccgaggattcctcttggaaaggaacgccaactcgcatttcgcattaagaaactggaaaaccttcccgtcggtcctggcgtagcgcctcccgtgtccggggtagatcttgtacccgctaaaactgcacagctcgaccttcatggcgacagctccacagaaagacaaaagatggcgaaaagtcttttttaattttttaaaaaatttatttatttatttttttgagatggagtctcgctctgtcacccaggctggagtgcagtggcgcgatctcggctcagtgcaagctctgcctcccgagttcacaccattctcctgcctcagcctcctgagtagctgggatatcaggcgcgtgccaccacacccagataaatttttttttttgtattcttattagagacggggtttcaccgcgttagccagaatggtctcaatctcctgacctcgtgatctgcccgcttcggcctcccaaagtgttgggattacaggcgtgagccactgtgcccggccaattttttttttgaaacggagtttcattcttgttgcccaggctggagtgcaatggtgtgatctcggttcaccgcaacctccccctcgcaggttcaagcgattctcctgcctcagcctcctgatttgctaggattacaggcaggcgccaccacgcccagctaattttttgcatttttagtagagacggggtttctccatgttggtcaggctggtcttgaactccctacctcaggtgttctgcctacctcgacctcccaaagtgctgggattacaggcatgagccaccgcacccagcctccagggaacaagcatttctggcaacttgaacccaggaggcggaggttgcagtgagccgagatggcaccactcattccagcctgggcgacagagggagactccatctgaaaaaacaaaaactaaaccatatgtaaaacaaacattgttttggtccagaaagatgggacaactggaggtgaggaggcttgggggctttcagatcacaggtgggagacaaagggttgcgttcttttgagtttctgattagtctctccaaaggaagcaatcagatatgcatttatctcaatggaggcaggctctccccaagctctcagcttgaattaacactgacattttaaaatatctagcaaagacaaacataaaatttagacaaaacctatgctgacaaatctgaaggcctttttatttttattcccccaataattttaaagctggctagtttagtaaagttatacttaagtggacttgaaaattgcttagacgtatttacttaattacttaagccctcttttttttttttttttttttttgagacaggagtctcgctctgttgcccaggctggagtgcaatggcacgacctcagctcactgcaacctccacctcctgagttcaagcaattctcctgcctcagtctcccaagtagttgggattacaggtgcccaccaccacgcctggctaatttttgtatttttagtagagacagggtttcgccatgttggtcaggctggtctcgaattcctgagctcatgatccacctcagcctccccaagtattgggattacaggcgtgagccactgcgcctggcggagccctcttttacttataagtcaatttggtagacacaacatatagcagtaagtgtacatataagtaaatacatctagacatgtatatgcacacataaacgatgacctggaacgttagccatgagatggcagtacaagcttgaaggttttactttgccctaatggataatgcagggaaggctgtgaaccaaaattttgggtaaagcagtctccatggcagttttatttttatttatatttatttattttttgagacagagtttctctcttgttgcccaggctggagtgcaatagcgcaatcttggctcatcgcaacctccgcctcccagattcaagcgattctcctgcctcagcctcccaagtagctgggattacaggcatgcaccaccatgcccggctaattttgtatttttagtagagacggggcttctccatgttggtcaggctagtcttgaactctcaacctcagttgatctgcctgcctcagcctcccaaagtgttgggattataggtgtgagccaccgtgcccggccaaagtagtttgattgattgattgatttttgttttgagacggagtcttgctctgtcgcccaggctggagtgcagtggcgcaatcttggctcactgcaacctctgccacccgggttcaagcgattctcctggcttagcctcccaagtagctgggattacaggcacgtgccaccatgcctggctaatttttgtatttttagtagagacagggttttagcatcttggccaggctgatcttgaactcctgaccacgtgatccacctgtcttggcttcctaaagtgctggacagtttgatttttaaaggctaaacctccccaggctccaaggagcactggggccaaacagtaccaaaggagagcatcacccgttaaccaggccccctgcttagaagagtagcacagaccgggcgctgtggctcacacctataatcccagcactttgggaggccgacgccagtggatcacgaggtcaggagtttgagaccagcctgaccaacatggtgaaaccctgcctcttctaaaaatacaaaaattagccgggcgtggtggtgagcgcctgtaataccagctactcaggaggctgaggcaggagaattgcttgaatctgggaggcggagattgcagtgagctgagattgcaccacggcactccagcctggcgacagagcgagactgtgtctcaaaacaaaaacaaaaacaaaaaaaaaccctgcagttgcttccatgtttaggcgctgcccaccaagggtcccaagttggaaaggaaggaggagagaggcagagagagagagagagagagagagagagagagaagcgcgagagcggccctgtaattgagcagaaaggaaagggagaaaaatgaatcccaaactttgggcttacctctttctgctggctggctcgccaaaatatgttaacggtagaggatgtccaggttcttggcatcttgaacaaacaattggacaaaatgcacaaacaaagcaagaaaggaatgaaggattttattgaaaatgaaagtacactccacagtgtgggagcgagcatgagcataggggctcaaaggccctgttacattttgtgagtttaaataccctctacttggggtacaccctatgtaaatgaagaggatgaagtaaagttacagttacaaagttattaatggcgggcatacgccctatggagaggatatttcccgttataactgaagtgtgaattggccttatgttccctgtctctagaccctattctcctgcttcctgtgaaagcagagggttttgtttgttttttgctttttgttttttgagacggagtcttgctctgttgcccaggctggagtgcagtggtgcactcggctcactgcaacttccgccttcccgggttcaagcgattctcctggctcagcctccggagtagctaggactacaggcgcgtgtcaccatgtcccagctaatctttctttatttttagtagagacgtgttagccaggtttcaccgtgttaccgtgttaccgtattccagccgggctccgcccctggattcggtggacagaccagctttacctccagagactccccctgtcttccctgcaccggctgactatacctacacacttcggtggcacaatctttgtttagatatgctgatgccttccttcgctgggaacggtccagtcctgcccgcctggcgctcagctctgcggatctcaggggatggagtggcaatctcattgctcccgcctctcctgacccctctcgccttctcctcgagacccgggttaagtgggcagagggctccgagggtcctctcccgccgtgggattgcacagagggctgggtccgcaggctggctaaaaggacctagcccaggattgcgaggcagcgccctccctgcagctggacagactcgggcgcccggcccaaagcccggcaggggcgtgtccgcgcgctcacctgctattggccaggtggggctgtcggctgccagcagtgcttatgctttaagtgcggagcgggtggctgcggagccaggcgcggcgcaggatggtggacagcgtgtaccggacccgctccctgggggtggcggccgaagggctcccggaccagtacgcggacggggaggcggcgcgcgtgtggcagctgtatatcggagacacccgcagccgcaccgccgagtacaaggcatggctgcttgggctgctgcgccagcacggctgccagcgggtgctcgacgtagcctgtggcactgggtgagcccaggccggggccgggggcgttgcatgagatcggggtctgtctcagcctgtactgcgcggccgcagaaccacagggccgggcacgtcagggcggcctttgccaatcctggaacgggtgggacaccagggccaggagcaggtacctgcccggcagaacaggcactgcgagtgccccgtgaggctaggggtccaggtagcggttcgcagggagaggccccggagaagggagactgagtgtgagtgagggtgtgggcagaaaaagtgagcgtccctgaggctttggagccagagccacggacagattgcaaatattcctcctgtgatggccttgggcagtgttaacagttaacattgctcaacatttgcacctgccaagcccagtgccaggagcttttgatacatcactttttcaaaccctcacaaagccccatgaagttaagcagtgatattctctcatttactactggggaagtaaggcctcagcaaagtaaaattccctcatacatcatccagtgaaaaggagctaacaggcccgggttggttaagatctgtcctgtgctctatttttctctttttttttttttttttttttgagatgaagtcgtgctctgtcgcccaggctggagtgcagtggctccatctcggctcactgcaagctccgcctcctgagttcatgccattctcctgcctcagcctcccgagtagctgggactacaggcgcctgccaccacgcccagctaatattttgtatttttagtagagacggggtttcgccgtgttagccaggatggtctcgatctcctgaccttgtgatctgcccacctcggcctcccaaagtgctgggattacaggcatgagccaccgcgcccggctttgtcctgtgctctaaaccaccatgttctactgccttttgtgcacacgtattttaacttcaaggagcctcagcttgtctgtctctcaaatgggaatgacactatttacctctcaggattgccatgagaattaatgcatatttgtagagtgcctggctctgaagaggtgcttttaaaaaaaagttgccttgtggtgacaggaaacagatttgtgaggtcagtggagagggcctggggagaggaggcagaggaacggactctgagaagtagagacaaaagtgtccagtgcagggtctcctcctggccctcccaggctcccctaactgcctctctctgcctctcctcgctggccgtactcagggtggactccattatgctggtggaagagggcttcagtgtgacgagtgtggatgccagtgacaagatgctgaagtatgcacttaaggagcgctggaaccggcggcacgagcccgccttcgacaagtggggtatgcaggtctagccaggctcccccagcccagtcaccaggaacactgttcattctgcctggggctcctttaagtgggggcgggggtggagtgttgtgttttcctcggggagacagaaaaattactgtcatttctctgaaaagcaagtcttaagctccagaatgagacaccgggtgtgaagagctggttttaactgtgtttgtggcatcttgtccctcccctcaaagaaaaacccataagcacagagccctccttcccaaccagggttccttctcccttgatccctcttttctcctccccctaactgaacggggagcttgtgtgtcttaagaagaaacccaggcaggactgcacttggtggaggtggctgctactggtaccatcgtgcctccctgattcctctttctcttcctgacccctagtcatcgaagaagccaactggatgactctggacaaagatgtgccccagtcagcagagggtggctttgatgctgtcatctgccttggaaacagtttcgctcacttgccagactgcaaaggtaagagagggtgtggccttgggcatggcccccgccttgaggcccccttccacagacatctggcacctgctctcctgccaaagcagactctctgccttggctctggcacccctggggaggggagagatgggagggagactggtgctgggggccctgagcagatggagtctttctgcccgtgcctggagctcaggggaccagagtgagcaccggctggcgctgaaaaacattgcgagcatggtgcgggcagggggcctactggtcattgatcatcgcaactacgaccacatcctcagtacaggctgtgcacccccagggaagaacatctactataaggtggggccctctggggtgggggtgggggtgggggtgggggtggggtggagggagggtccagtggccccaaggtgggttacagaggctaatgccggctgccccaccacctacagagtgacttgaccaaggacgtcacaacatcagtgctgatagtgaacaacaaggcccacatggtgaccctggactatacggtgcaggtgccgggggctggccaggatggctctcctggcttgaggtaccacttggcttagtgggggtgaggcggtagttgggggagctgaggtcaccagtcctcatggttgctggggcctctgttacagtaagttccggctctcctactacccacactgtctggcatccttcacggagctgctccaagcagccttcggaggtaagtgccagcacagcgtcctgggcgacttcaagccttacaagccaggccaaacctacattccctgctacttcatccacgtgctcaagaggacagactgagtgtggcctcagctcccacaagcctctgcccaggcactgctaggctctgtctggaagatggggaccagcagccccacaccagggccagcctctagagcagactacagctggggtgcagggatgtgggttccacagacggaagggtaaacaatatagtctttttcagttcctgcatgcattgtgtttatttatgtcagaaggatcaggctcccatgctgcccacccccccaccctctcccagggcttactcctcccacaaccctgctctttctcactccaacctttcatgccacaacaccagtagggggcgggacatgctttattttcagccacagaactagccctctcagggcccaatccccagaacccaaggccctggccctcttcctgagtagatgggcctttctcttagagccggcctggaaggaggggcaagtaggcaggagatatctcttgagctgttgctgctgtctcaatgccactttgcaccctgggatctcctggagggaggtggcctccaggtgggttggcagcagcctgaggaggagcccttccttcccagatctctctgtgggctatcaaggtacctgcagccatgctgagcggggtcccagaccctggggggctcctagcaggcagcaaacttgcgctggatgcgcttgtaccggagcagctcctgctcactgactgagggttgcagccgggcggcagcctgcagcaagtcctccatggtgagcatcagtgctgagctacctggctccagccctggagatgacaaggtggggaggctgtggtctatgcccaggcaggggagagccctgcgaaggtggcttcctgctcagggtctcctagatgtcaatgatcttccctctggaatccaggactaggtttgtctcccactagttttttttttcccttaaacattttttttagagttggggtctctctgtgttgcccaggctggcctcaaactcctgggctcaagcgatcctcccacctcagcctctcaagtagctgggactcaggtgcacccagctccccactagctttttggttgacctctcagaccggcaagtggctcaccttcctccaggtcatgaaccctgcgtttgagggcagctgtcatagcatcagagcagagagagtagaggtccgcgcccgtcagctggggagggcagcaatctagcacgtttaccaggctcacagatggctctagcttgaatctgttgtgggatacaggaagaaacagagttggcatcacctcctccctcgaaagccagtgctgaccagctcatcctgcatgttgcatgcatcccctaagcatcccaaggcccaagcccttcgcagtcttcctctaacagagcatacttgcgtgtgatggcacttagaacgcgtagctgggaggcccggtcctcatttgcccccacaaacaccagcttgtcaaatctttagggagataggcaggtataagtttcagggagcccagccatgaggggtgaaggaggcacaaaatgagggtggagatgagcagtacaaggggcccacctgccaggccgcagaagggcagggtccaggagatctggtctgttggtggctccaatcacaaacacatcctgagtgctgtgcagcccatctagctcggcaaggagctgagacaccaccctggagagaagggagcaagggcaagagtccttggtgtcccccttagactctgcccctgcctgtggtacctctctttacaggcagtctcaacagggccctccactcagctgtgcccaatgtgccccaccaggtaggcccccattctcctcagtggaccctgcccaatttcatggcccctttcagcttccattatattatctcagaactgaaacagcaggaacttctatctctggactctgaagactgctgtgagctttctcatatccttcccaccctggacccctcagctttcattcccactcagacccctacctgtccatcactcctccagaatctccacttcgcccccggcttggggccaaagagtccagttcatcaaagaagataatgcatggagctgcagccctggccctggcaaacactgaagagagagaggggcccacaggagggcaaagctcggcttgtggggggttgaagttaggtgagagcagggagggaaactggggcctgacaatacagcactggcatcccaggtactagacccagctgggcaggaacctgacttgtagaaaggaggattaggaatgatcatgagtagcctgggagtagggggtggcttgggggccatcggggtttgggaagcatgggacgccctgcccctccctgctcactcaccttcccgcacattctcctcactttggcccacatacatgttaatgagctctggccccttcacgctgagtgagaggatgtgagaaggtgagagccgtcagatgcacatacacacaattgacctcttgggcagcccctcctgctccccagcctgctgcagcccctgatccacccaccatcccttccaggccccctggccacctgaggaaggtaaggctgcactcagtggctactgccttggccagaagggtcttgccggtgccagggggcccatggagcagaaggcctgagcgtctcaggcccaggctcagtagctcagggtgctccagggggagctgaatggtctccaggatctccttcttcacctcctgcagcccacccacatcatgccaggacactgaggggatctaggagatggaaagtgcgtggttgggatatgctcttggaggggctcctgtcccacctccaaggacttggtctccaccttgggggctccaacggcctgggagtgagctgtctgcagttgctccagtgcctgcccaaagtcctcagccaggagaggaaagccggcagcacacagctccccctcatcctcctcagtcaagccacctgccaaactgcaaagaggaacacagggaagcctcctcaccatcagcgtcccattcccttctcccttcctcaccacccacccatctacatccatttcctctttccgcctttccggtgcccacgtcctcttaccctgagttcttgatcctggtgcaggctgcccggctgctgtgggtcagaagggcatagagatcccctaccacaaagccctagggaaccacaggaaaggacacatgagcagggcacagtaggcaggaaccttcagggaccgtcccccagctagagcagaggccctctgttgatgccttaggtttgttgttttttttttttttttttttttgagacggagttttgctcttgttgctcaggctggagtgcaatggcgcgatctcggctcaccgcaacttccacccgggttcaagcgattatctcacctcagcctcccaagtagctgggattacaggcatgtgccaccacacctggctaactttgtatttttagtagagacggggtttctccatgttggccaggctggtctcaaactcccaacctcaggtgatccgcccacctcggcctcccaaagtgctaggattacaggcgtgagccacggcgcccgcgctgggttttctactctcactcacaaggcaacaggactgagttcttgtaacaaaagccagggacctcctagggagggccagtactctcccttgatactcactgcacaccgccgtgctagctgtgccaagttcacctcctggcccaggggaaggtgggcagtgagggcccgcaggatgctgagccgctgcccctctgacagagcaggcacctcgagctcatgaggaaatgctgtctgcacatcagcaggcaggtcctgggcccggcttgtggtggccacaaccatgaggggagggcagctgcagacagaggagtgggcactgagggtgagaacatggctggcagctcctgtggactgccttgtcccaaagtcggcacagaagggcagggaagtgaggtgggtgctaggatggggtagggagatgagcatctaccccagttcctagatgggggaactgtgtttcccccatcacattgagggcagaggctttttctttaaccgagtgttccccaagaaatgctagaccacagactcctccctctggatccctctaaagacacggagctcagggctgtctagagggcagccaaatggatgggagatgactgagaagccactgaggggtgagagaagggaggactgaaaggctgaaaagtaggagggctggcccccccgctcccccttttttttttttttttaagactgagtcttgctcttgtcgcccaggctggagtgcaatggtatgattttggctcactgcaacctccgcctcctgggctcaagtgattctcctgcctcagcctcccaagtagcctggattacaggcacccgccaccacacccagctaatttttgtatttttagtagagacagggtttcaccatgttggccaggctggtcttgaactcctgatcaaggcaggtgatccacctgcctcggcctcccaatgtgctgggattataagtgtgagccaccgcgcccagccggcccccccagctttgagaggcccagctctgtataagtacctgttgagggggtcctcattgaggaggaggtgacgcagcacagccatcacacgggcatcctcacccagcccatcacggtcccggcccagaaggtccacagctgtgagcaacaggactgcaggccggcaacggcgggcccgggagaagatggcctgcagttttgtctccacagccccactactttctgcacagaggctggagcagggcacctggggaggggatcccaatgggtctgtgagcaaggggaaagcatgacaagggcaggagaatcaggggaggaggaggtggaagatgtgggccatctttttctctggagggcagggacagggaaggtaccctggccaagtcctacctcttttttaccctatcccattccctggactgtccaccaatatcttgcaactccctcctccttgaaagtacctctccatagctcagcatcatgggaatatgcctgacccactgggctgaagtgctagggcctgtgagtagacagaggagggaggggagaggaagcagcagagagggagaacatgagctggggaggggaagtagctggggttctactctccagagaccctcaccttcagtaagtggagcccaaggtgactacaggcagcagcaactactgtggtcttcccacagcctggggggccccgtagaaggacactgctagttcctgtcagcagggcacccctgcaaccagagaacagacattcgtctccttcattttgcccaaacattagagtccccagtaacacaagatcccttagatctagaaagcagataccctgtttttctctccttgagcctccctgaccccaggacagggctgtccccatgtagtgaggctgtgtctcccacaccacctgcggtgctctggccggggcatccagcatatccaacagccaaagactaattaattccctttggcattgctgtgctgccaataaaacctcaacgttatgactggtctgaatggtattgagagacattgtggtggcactgaggtggggatctgcgtccacacctgggccactggtatgaggagttgtgtccttcagggccagggcagtaaagtgcaggatggccagtgagctccccaaggggaagggcagtctcagaaacagatgcccctgctggagattcttcctccagagccagccctggaggacagaggttatcccaggaaaggagcctgggaattggcttacagaaaggagtggcctggtggccttgtgtaggacatactggtttgaggaaggtcctcccaatcccactctggccagttcattaggaactacccatctggctgctgctcctccagggatgttctaagcaggcttttctcacaccctggggtgatgacctcactcaccctggctggaggcgaggcttcaggacagcacagagttcagacaccaaggcctccaggcctggaggagacaaactgctccagagagtggattcctctgaagggagccatggaacagggctcagggtagaacccacctgtgaaaggtaataaaaagctttcgtttctaaaaatcgtttctaccccctgcgctggtctacacccatccttggggcctcaccatgtacaaggaggtatgggtggtgtcggccaagtaggcactggctggtccatctggagcttccccaactgttttcttcactttaaaaaacatttcccgccacctgcaggaaaaaggcccaatgaaccccagatccagagtccaaaaacccccctcctcaaggacaaggtttctcaatcacagaggacaaacaaaagcaccacaagagcgtgtcccgagtcatggtggggaaaaggaatgcagatggactttctcatcttcctgacagaccatacacaccttgagggcaagagctatgcctgtccctctgcatcccccatgacagccatgagagctctgagggggtgtgtttctccaggcatgtggcctacccacccacaccaatgggagaagctgctgctgcactaagcagtggatcatctgattacttctactggcttcggtctccccctcaaatacacagccatccaggccccaaaaaccctagggggaagggtcccttggctcttactcaataatccacaaaatctcattgcaggcggagtccttaataatgccatctgatgaataatggttctgtattctggctgcacattggaattatctgtgtaactttaaaaactaaacatttctcacatattatatgattctattcagcagatcagcagttgccattgcctatgagggaagctacagggaatgactgctaatgggtgcagagtttctttttgagatgttgaaaatgttctggaatgaaacagtgatgttggctgtacaaccttatgaataaaaaaattgaattgtatactttaaaagtatggttttatggtgtgtgaattttatgtttttaaaattaacctttctccttcctttgtgaaggaaaaaaagcacaggctccagtctcaccctgattctgccccaatagatctggggtggggcttaggcacctgtattttttgaaagcttccccagcaattctgatgcataaccagggctgcgcagtagttggcgagtgtcatagtgagttagggttattcaacctactaacggggaataggatgggtagcaggaacagctactaacccaattttccagataaagaaatcatgaactacttccctctttaatcctcaggcagcaaggcaatgacagagtcaggctataacctagtcctctttaaggtccaatcaggctgcaaattcctctgctcacactgccccacagtctcaaagctgctctctctagcagcaaaggggtgtgagagtgcagcaaggtggaggggaagcataccaggttagtattatgaaactcttctaagtactacagtaaacctggaacatcaggaagcctgaatctgcctataattaattataaataggtgacagtgggcctctaacctaggatctcgatcaagctcaacagctgagtcatggtgtgtatgactcaccatggaagccctgcataggaatgagatgggggacagcactgtggcatagggagagaccaccttcttcagtggagggtggttggaccacctcagtgaatagaaaggccagagctctggaacctatgtggacactgctaaggaacactgagctgtgctccagccagccagataggtgatagtggagctggctcccatgcagcctggtttggggaagtggagcaccagggacaggatgaagaggctacaccaacagtggaattcctttccagggctcacaggaacttctgcagggcttcccttctcaagcccagtgcagcttaaaacgctcatctgtatctgtccttggacccattgggccacttactccaaccctgctttccttgcggggaaaagaactatgtgctcggcactcaggaggaaagcagggttctacagagttgagacaatagaagttcaggaacagaactggcttgccagcctgtctcatgaggttctagtgcctattttcctttgaaagtacaaagagtgggcattctgtagttttcctactgaaagctagctcaaagacgtttgctaaatttatgataggagagagaggtgggaagtgactgctaagtgccagcctggcattttccaccagactcgtggacttaatctggaaaacctcgaagaggtgacatggagcctaaatggggttccacagagcaccaccaccctgagactgggggtactgagcactggccagaaccaagcactggatattgaccagggatgaacatcaggcactccaaacaaggactgtctctcctggcagaggacccaggctggctatgccacagaccttggacatgaaggctcttatgtatgagttagtgcatctatcagctgtgctctccttctagtaaactgctgcaggaaatgagtccagaatacagggaatgctgggatacagagctatacattttcctccctacacataaggctaaagcagtgtctcaattctttgcctcaccattttacatggaacctctgtggtcagagtcaacaagaggagaaaagctggattccttattttgggttcttggctcggttatgctctatttctcattctctgttgataggacagggtagccctctcaaaaacaatagaaatccctggctgggtgcggtggctcacgcctgtaatcccagcactttgggaggccgaggcgggcggatcacaaggtcaggagatcgagaccatcctggttaacacggtgaaacccaatctctactaaaaatacaaaaaattagccgggcgtggtggtgggcacctgtagtcccagctacttgggaggctgaggcaggagaatggcatgaacccgggaggcggagcttgcagtgagccaagattgcgccactgcactccagcctgggcaacaaagcaagactctgtctcaaaaaaaaaaaaaaaaaaagagaaatccctctcctgttttcagagataggattgagaagtagtttgtgcacactccgtagttaaggcagaaatcagagcctgtatatccttacgttgagatatggatggtatggcccaagtcttggtccaaataacacgaaggctaagaacggaaaggaaggaatcccgtcttggtctaggccattaaactcttctttaaaaagaaaagaatttaaattttacctatttatttattttttgagatggagtcttgctgtgtcacccaggctggagagcagtgatgcgatctgggctcactgcaacctctgcctcccaggtccaagtgattctcccgcctcagcctcctgagtagctgggattacagatgcccaccatcacacccggctaatttttgtatttttagtagagacagggtttcaccatattggccaggctggtcttgaattcctgacctcaagtgatctgcctgcctcagcctcccaaagtgctgggattacagtcgtgagccaccacacctggcctaaactcttcttagtgctttgctttacatagggccaccagtcagtttgaggataaacacctcccaaagccagcagggagtggttcttttagtttgcttgttttttgagacagtgtctagctatattgcccagcctcctgagtagctgggattataagtatgcactaccatgcctgactggttcttaacctttcttcagtcatacacttgtttgggaactgaaggacaggtgaattttctctccaaaaaaatgtacacaggctgggggtgagtggtgcacacctgtaatctcagcactttgggaggccaaggcaggcagatcacttgagctcaagagttcgagcccagcctggtcaacatggcgaaaccctatctctactaaaaatacaaaaaccaatagctgggcgtggtgatgcgaacctgtagtcccagctactggggcagaggcagtgctgaggtgggaggatcacttgagccatggaggtagaggctgcagtgagctgtgtttgcaccactaaactccagcctgggtaacagagcaagaacctgttacacacacacacgcacaca

SEQ ID NO: 347 - DNA, 105356 bp, Homo sapiens
aaaaatacaaaaattagctgggcgtggtggcgcacacctgtagtcacaactacttggcagactgaggcaggagaatcgcttgaacccgggaggcagaggttgcagtgagctgagattgcaccactgcactccagcctggggacagagtgagactccgtctcaaaaataaaaaaaaatttttaaaaaggctaaatttatctaaatttataaaatacaccccaattaaaaggacacatttcaatgaattattgttagaactcattatagaaaatatgtaaaagtactctattagaaagaatccaaaaaggataaaaatagttaaagaagaaaactatttttaatataatcaattttatatatatatatatatatatttttttttttttaaagacacgggggtctcactatgttgaccaagctggtcttgaactcctggcctcaagcaatcctcctgccttggccttccaaagtgctggaattacaggtgtgagcccctgtgcctggccatcaatgatacttttaaatacattttttactaagagacaaagaccaaggacagaaaaaaatcttagtttaagtaaatttctagataaattaagatcactttatttttcaatgagaaataggtgaataagatcagttttaaatgcttttgtggagctctttattgggcatttttacccataagaactgcatttcataaaatgtttactacttcaaataatgctttgctaaacataagcctttatcttatggatctaccataaataggtatctttcagtaatcatgctgtagctgcactattacataaatattttatactttcagtattatctataataaatttataaaacaagcactgtttcaccaccggacagagcaaaggtttcaaaaaagagttgactgtatgaacaatccatttagaggagctaaatattaactcttttttaagataactaatctctaacaaagctcatattattgatacttaatatattatttaaaacttgagaatttttgaacctaattataaaactctatctagcaaaattgtctttagtatcaactacatagtttattaatgtaaaaagagttattttagaggcttaatttacactgtcctccctaaagaaaatagcataggaagtcagaaaataactaaactgaaaaaatgaaaaacttatatacaaatatatgtatgtatgtatatgtgtgtgtgtgtgtgtgtgtgtgtgtgtgtgtatcacttagtctgtgaatacaaagaagggtaaagacttttcctgtgcatttttcttctaaaattccatagtccattaaattcacatatgtataaaataccattcactcttaacatcatggaaaagattaactatgaaaatctgtgatgctaaatcacaaatacttatgcagaatcttctatgtgagaacaaggcattaaataacagtcttatagtccattattaacatttgttattatacaaattatatggcttaaaacaattttctttaaatacaagtatctcctaaaacctacctccaactccttccagcatattctgcacttcacccctggaaagaaattacattttaaacactttagaagatccacaacataccatgcttgttttggaagaaataccagatgccaagtattttacatatattatttgttagcaacttttcttgaagtgctttatctaagaaacaaaaattattttgaacacgttaccccatatcttcaactactcctgcagaagaccttttcttcctacgtttctcaatgactgcagtcttccctgtattgacaattaaaaaaaaaaaaaaaaagcttttgaaactgaataggttattttggtaaattttaatgaaacatcttcatttggggatttttaggctttttgccaacatacagtttcaaagcagacataaaaatgcaatattctctgcaggttaggtgaaattaaatcaggattcaggaccattttataggaataatttttcaagtctccctgggttaatgtcacagtaagccacatactatatatcagatattttggaaataactgcaaaagcaagagttgccgaataagcttctgtaactccgatactgcaatataaggatcaaatgagaaacacaagtacagctggccatccgtgtcagcaggttctgtaaccacaaataccgggggagggaagaccatacctgaaaatgctttacaaactaagttgtacgatagtctcaatgggttcaaaacaaatgaactgaaggacatcactgcccaacatgagatgtactgcaccttcaataacatcttcctctgatccactcagatctttcttatcttcagtctcaaagtcataggctctcgtaaactgatcttccacagacggcttcccagatttcctggaatacttttttccggaggacaccatatttagatgcttcctgactttaaaaaacaaatttctttaaccttctgaatgcaaagacatcattttaatacactggtaaaagtttaaatatcaaaggagatatcgaacaaggattgttgaatacaattttaacagtttcctcatttatttggggggccaaaagttaagaagataatgacatttgttaaaaaataataaaataaataggccaagcacggtagctcacgcctgaaatcccagcactttggaaggttgaggcaggcagatcacctgaggtcaggagttcaagaccagcctggccaacatgatgaaaccccgtctctactgaaaaaaaaaaacaaaattaaccgggcgtggtggcacgtgcctgtagtcccagctgctcaggaggctgaggcaggagaatcgcttgaacccgggagacagaggtcacagtgagccaagatcgcagccactgcactccagcctgggtgacaagagtgaaacttcgtctcaaaaaaaaaaaacaacaacagaaatggccgggcgctgtggctcatgcctgtaatcccatcactttgggaggccgaggtgggtggatcacctgaggtcaggagtttgagaccagcctggccaacatggtgaaaccccgtctctactaaaaatacaaaattagccgggcgcggtggcgggtgcctatgatctcagttactcaggaggctgaggcagaagaatcgcttcaacccgggaggcggaggttgcagtgagctgagatggccccactgcactccagcctgggcgacagagtgagacttcgtctcaatcaatcaatcgatgagagagaatgacagtgtccaccccgactccaagcgcgcagtgctggagaggtggcccctgaggcctgggagttccaaattttggggccgcctctgccagattctggctaaatctgggcaactctagcagggcgctcagtcacgcggggaaattatagttgctggcgggacacgacatgaggatgccagaaataagctcataataatcaagacaaataataaaaacgtcccgcaatttaggtctcggaaaatgaacacaggcagaagatttcgacaacaaatacatcgaggaaccacgaaaggcgccctcggcgtggagcgggcaggagggagacgcgcggagcgaggtagggccctgcccggccccgccgcgtccctcctgtaagtggtcccagggtgtagcgatggggcccagccccagcccagcccgcccgctttccactaggccctatcctgctcaaggccctgtcctcaggttcgcggcctccgttttctcgtcagaggccccaggcgacgccaggaggtaagatttacctcactggtcaagggcagcctctggcctggacacctgcgatagacagacgcctcccctgctcacacctgaaacacaccgcaatggccgaggaccagttactggtcgtcgacaggcgtcctccacaactcctccacaagcgcgcttcacctgaggtggccccttctccgcgacgcttctgaggcaagctgggattcgcacaggagaaaagccagtcccgcctcatccggacacgtcgctgattggctggacgcagagcgcaggcgtgaactgggtggcgaggctccgcccccatggggcgattgcgcgcccaaatagctggcccagggtgctttggccgccggagcgggttgcgagtacacttgaggcctggtgccttccagtttttaagttttaaatgtttataatcgaaaattgcagctaggcgcagtggctcacacctgtaatcccagcactttgggaggccgaggcagacggatcacttgaggtcaggagttccagaccagcctgtccaacatggcgaaacccatctctactaaaaatacaaaaattagccggacgtggtggcgggcgcctgtaatcccagctacttgggaagctgaggcaggagaatcgcttgaacccgggaggcagaggttgcagtgagcaagaccatgccattgtactccagcctgggcaacagagtgagactccatgtcaagaaaaaaaaaaagaaaattgcggaataatatgtaaattatgaaacatgatgaacataccacctaatttatgaagtagggctttaccaacattcactgaatctcctcaggcaggcctttccatccgatcctcaccaggaccccacccttccccattcagggatataagaaaattatcctaaatttatgtaaatcattcacccttccttattttctaagttttattaccacatgaaaatgtgtcgttaaacaacacggcttagtttcgttcgcgtttggcattacaaaaaattgtcccatagtctatgtagtgttctgacagtccactagaatggcaaaactacaaaatatgactacacggagtgatgatgaatctatgtaacaaagggaacccattcagtgggtgggagtataattgtaaaacaattatttggtgtaactggaaatcacctatcaattgcaaaacaatttttgaagatacaatttatgaaggaaatgaaactcacctataatcccactacccagaaataatatacagtttaaaattgggggtattattgcctttcatccttttttctgtgcttatatgtattttcccccaaataattttaaaatatatttcaacctttgtacctgccttagtttgctcacagctctgcaatcctttttctatttgaaatcatacattttactttttttttttttttttttttgagacagggttttgctctcttgccaaggctgaagtgcagtggcatggcatgatcacggctcactgcagccttgatttcctgggcccaaatgatccccctgtctctgcctcctgcgtagctgggactcatgcacgtgccaccatgcctggctaattaagaaaaaaaaaaaaaaaaagtttgccgagatggggtctcactatgttgcccaggctgttctcaaactcctaggctcaaatgatcctctcacctcggccttccaaagtgctgggattacaggcatgagccaacttgcctggcctatattttacttctttaatatttggcaaaggcttcaggatcttattgacgccaatcacttttcaactgcctagttcaagtaagagattcaaaggaaccctcctgtttactgttttgctttgaatcctcttccttatgatgctcagcattccactggctcgtttaaatacaccagtgtattgggtaaggaatgacggatgacgactcccagacttgttcctgtaattccattcactacatcaaacctgttgatacaggatacagtgaaccttgtaaatttttcattactgaaaggattcaaaaaagtttgtaaagcgttagtacagtacctgccacataataaatgtgccataaatggtggcttttatgattgacaattggtcccaattggaatcctgcttttcctctcttgccagcctcattcttggcctcatactgcatcagccacattgcgttttcccaaatgtgctgtgcactcttatgcctccatacccttatagatgctgttcttattaagtagttccattcactacatcatcatattcagttgtttttcctacagtgacccttacagaagagcatctgtcatttttcttctttattcgtaataaaaatttcccaagattatctccagcaccttggcatttcactgctgtaaagagcatgtctggagatttcaccatgtgcttcagcaggtaatttatagatgatttttaacccacacaccaatatttcatgacctgtctcagcattcattcttagatgaccacattgttaatacttccccatatagatcatcacccatttattccaatcatctggattcctaacaaaacattttcccattttctttagtaaccaatggtgtagaatcttgtcattattgtttgaaaacctaaatattacatcccttgtttccttactcagtctcaaagaactcaggtaatatagtcgaaatcttagaggccaggagcagtggctcatgcctgtaatctcggcacttttggaggctgaggtaggaggatcgtttgagcccaggagtttgagaccagtctggacaaaatggtgagaccccatctctatttataataatttttaaaaactcatagaaatgtctccatagataaactactcagtaggtaataagaacagcatctttaagggtatggaggcataaaagtgcacagcacatttgggaaaatgcaacgtggctgacacaatgaggccaagaatgaggctggcaagagaggaaaatcaggattccaactggcaccaattgtgaatcataaaagccaccatttatggcgcatttattatgtggcaggtactgtactaatgctttacatttttttaaatcctttcagtaatgaaaaatttacaaggttcactgtactctctatcaacagatttgatttttccaattgctttcaagtatggcagcttgccttcaccttgagtacctaatccaggaacttggtcttccacctgcaccatctctaatctgtgaagctggaaggtgatgttttgtaagcccagcatccctcccctccttccttgggtaaaaatctccatccctctggctacagaggtgggcacagagcccagaatgagccaatcacagtaactcatctcccaccaggattttctatattgaagccagagaggaaacttcctgcctctctggagtatgtgagccaggaactgccatgtcctcaccaaggagagaaaagctgatgtgcatagagaagcacagatagacagtgctgagcaatggttcaggaagagtatcttcctcctgtacccctctttgtttttccttaagaagcttgagttagatttgtcccttgcaatccaagtttatttagtggctaaaaattaattttgtagagacttgggtggaaaagctgtctcttaacttaatagacctgaggtgaggcactaaacctagttaggccccagttccctcactgataagtggggatatggtgtggatgaaatgagattatgaacataaagcatttagcacatagattgtgtacagtaagatatagctgttattagggcaagtgagaggagaaaagcaattagactgacaagaagcccccttcacatccctttaaccaccatggctctgtactcctgtcacaaggaagcctgggatttcccttaaaacatatcacaaagaaaaacggagcatgaataaatgtggcaaagtcttgataactgttgagcagatgagaattcatctattggtctttttaaaattttttatgatcttttttaaagaaagatctgttgagattatcatccagtttcttttggtcctgctgatgtggtgaattgattttcaagtgttgggccaaatttgcattcctggagtaggccccacttgactgtgaagtgttgttcttctgggaataactgaatttggcctgttagtattttgtttgggattcttttgcagtagactgcccatggtttttgtcttgtggtatctgagccaagttttactgttggggttgtgtttcaagggatgagttggatgatactgtattttgcttttttctgctctctggaagaatttgtgtgggactggtgctgtttcttccttagatgttttgacgtaagtagtgattaccctttagtttaaatgcttaatctgttattatttgtatacttcttggtatatgtagaaataattttcaaaatgaacacttttgccaggcacagtggctcacacctgtaatcccagcaccgtggaaggtcgaagcaggagtattgcttgagcccaggagttcaagacagcctggataacagtaagaccctgtctctacaaaaatataaacaaaattagtcaggtgtggtggagcacatctgtggtcacagctgctcaggaagctgaggtgagaggactgcttgagcctgtgaggttgacgctgcagtcagctgagatcacgccactgctctccagcctggggcaacagagtgagatcgtctcaaaagaaacaaacaaacaaaaaacacttttgaagacataaggtaggttaaaaaaatcctttgtaattagaaaatgtgtcacttttttagctaagagcaatataatcatctcaccctaatgactagactaggagcctcacctctggcctggacaacagtctttaacacgaattttcatcattaccatcatcaccactgacatttagcaggcaggactatttgccaggcactgggctgcgtgtgttgcacatgtcatttcctctaattatcaccataagcctctgtggtagctaccagtattgcctcccacattttggcagagaaagctaaatcacggcaagcagtgtccaggatccaggacttgaactcccgtagtctgactgcagagtgtgctcttcacccacatgtgccacagtcctggggaggcagcatgggctggtggggacaggaaagagggacaacccgggttcccaccctacctcttcctctaactggttgtaagaccttgagcaagtcatgtcatccccgtggccttggtgtccttgccgataaaaagcaagggttcgtccagacagttgttttgaaactctgcccgaagggcctgggagctggagggaacaccttgagaatcaggcaggagaagcagccttccttcttttgtatcacagaatttttatctgtccaaaattcatgttgaaacttaactggcaatttaaaagtattatgaggtggggctttcagagggtgataagtcatgggaacagagccctcatcaattcaattagatgtctttattaaagggcttgacagaggcagtttgtgccttcttgcccttctgctctgtgaggacacggcattcaagaagccatcttaaaagcagaaagcagccctcaccagacaactaaacctgctagccccttgatcttggactctcggcctccagaactgtaagaaaatgaatttctgttctttgtaaattacccagtctgaggtattttgttacagcagcacaaaaaaactaaaacacagagtgaccttttctataggatttgaacaaatggttctgaccatctgactgctcatcaacttctgaggttcctctgttctaatgattctactgaatcacagaatcattagaatgagtctatgaatagcctatgattgtattatccatcccattatcaagctcctaattaggtatggactatattcatctaaccacagaaatcgtcattacagacaaatgttcatttctctaacttttctagaataaatctcagcttttataatgatacccagatatcctaaattttaccatatgataaattccatttagaaactattttccccccataaagcaacattcttctgtataatactaatctttccttactttccacttaattttagtaatgttcagcacagaacctgatacacagtaaaggcactcaagtgactgctgaatctgagtaacagtaaactcaatcctcaaagatttaaaaatcaaagtgtcagacaaaaatttaactttttatgagatttcagtttttgaaatacacaactcttacagcacaaacacagtatttacatttcaagttctttgtacaaaagatgtatgccattttggaagaatattgttgagatcatgatctaaaatacctgtcagagttactcatggaatctgctcttcacaaatccattgtattatgacataaaatatggctagacgccaaggtttaaccatacataaaaatactaattctcggctgggtgcactggcttatgcctgtaatctcagcactttgggaggcagaggcaggtggatcacctgaggtcaggagttcaagataagcctgaccaatatggtggaacccccgtctctactaaaaatacaaaaattagcagggtgtggtggcatgcacctgtagtcccagctactcagaaggctgagacagaactgcttgaacccgggaggcggaggttgcagtgagctgagattgcgccactgcactccagcctgggcaacagagagagactctgtctcaaaaacaacaacaacaacaacaacaaaaactaattctcagtgattggcaaatgatggcctgagggtcacatctggctggtgggcagtttttgtacagctgcaagctaaacatggtttttacatttttagagggttgtttgaaaaaaaacaaactaaacaacagcaagaagaatgtatgacaaagacacaggtggcctgcaataatttactaaccagccttttacaaagaaagtttgctggcctctgttctatcaaaaaccaactgagagagatagctactggaatataccaatgagtattaaacaagacaccactgtaatgtgccagtgccatcagcactactcatttctaaaatgaggcacttctgtttgaatatgtacatttccaaaacataattacatctggtaagtagtactaactctagccctttgaaattagacctgcacgtgaaatcatagcattcttaggggctgaagtcaataattacaaagcatttcagatgtcaatcattgagctcttcagtagttagtggtttaagaccatttacagtcttaaatattaataaaactcataatttaggtattgtcaataagaggtgatattgctgcattatttaaataacatctataaaaataggtttagacatcccaattcgttatactcagaagcaagaataactagttaacttagtaactacttaaaaatgggaaatgaaaaaaaaaaagtgcaaaactttagcaaaaggctttggaatgcaaagactggagcctcttagcaatcactcccagctggcataggcttctcctaataaagttagtctgcaatgattgctgtgggaaattaacagctgtctcttgtcagtgagcctttttataaaaaggatgacaggtccatgagcaaattctttaaaagtaaaatcagttcagagctgctcaacacacaagttttcagtgggttggttaaataattcctggtcagtgggctatattcatgccacaaaacagcatggtactggatattttccttcttcgggccaaactgctaagcatcacatcacaaagacatctctgtgaagctgagttttaaaatgctcagtaaatgctgaggtagatggttttcaaatgaagatcttctatactctgattcgattgggactagcttctttgtgtatcctccttctgggaaatatcttccgcttaagtgcaattaactaaatgatgaaagacagaaaatacattttaattctcacgttgatgaaagaatataagtgcatcaaactttctaagagccatatgaccttaatcatttccacaatcttatacattaaaaagacaacaaacaaatctccatcattcctcttccaaaacaaaaacaaatattagttttgtttagctttgtagggacagtatgcctagatatgtgcccacaaagagacccaagaggattaaaattatttcggcccatgcttcatttttctaagacctacaactacagatttttacacagctattaccaaagcatatttattttcaagatgtccatttgtcaagtctttctattgaaggaaactggctctatttagccataagacactgtctctgggttgatatgatggcttattccttcatctgtaggaggaggcagggctttgcccaaacataagacaccacggtttgaatgatgagctggaatttgggaggggaggaagaggcagcattggctgctttgtttgtgaaggtggcaggtatggcaggaggaaggagtttgactccagtagagagcagagtgttgggatttaacctgcccttcccttccctcttcctgcctctctagttccctattctctactggtatagatagactggtatagatagaggaaagactgcctctctagttccctattctctactggtatagatagaggaaagactgacactcctcttcctttccattaatggctgctcctttgagtcagggctcctttccttccccatcctaggtcagcacagcagactcaaaggtttctcactggaccctgttctaaaagcaggtacagcctttctgagatttttcataagacttttacctgccaggaacaatggtaacagacatcaagaacaagatgtacaatccctggaaagcagatgaaggttaagttgctgtcctgttcacctgcccagtctctgtttcctgaatttccttccatttacagcaagaagcccattcatttatcctgaagctctcagtacttaggtgcttgtccttcttggtataagtcaacttggtgtacgtttcatttgagtgacagctagaaaagctccactcaatagtcaccttgattggaggcagaggccaagtcacttgccacacccaagtcaggttggtaaagatgcccattcccctccttcaatcctttttcttcagagtatttgatatgtgaatagcctaatgaggactctcttatccctttctctttacctcacaaatctccctccgacttctggacactcacctcaaggaggctgcgtgtgtacatgcatgcagaggaaagcccaggtgtagaggggctgacaaggagaggaggaaggaggagagaggagggagaactcctagcgattgaaagaaagataaatgggagctactggtgtgagtgggacaacacaacggaaccgtgggatgtctgaagacactgtgctcactcaaggaagcgtgaaagagaggaagaaaattggagacccatagaaaattaacattagataaggattctagatggttttttggttataaatacttagagctacttggttttagcctgatatctacaagttaatctgttgagttccagataaaaagaatactggtaatggatttagaagagaaatgaataaaagactgttatatttgctgcctgaatattgtgaaacatatttaacatattcacatatgagctataagacaataagagaagttaaaattttgattgtaaatgtgtatcattttctaaaacattcagatgctagtataccaagaaataccatttaatacccacataaaatatataaaacttacctgctcagcaaaaaatgagaatatagtaaacataatcaatgttgctagtacacaatgggtccaaaacttcaatttgtctcgataagccctcctgtgcagagagaagaaagcaactatgtacttctgtatatggtttcactaccattagttaagcattatttatatactagttctataaaaacaatgttgggaaacacaaaaacattgtcttgcaattctaaaatgctcacacaatatacatttccaacacgagttcagattttttattatgtcatagtaaatattatacttgaattagtgaagttatccaggcaggagagaggacttcaaaagaaaattacttctggcacttaaacaaaaccactctttcattcatttttattcactcatacttatttattcactcagtttcttgataaatacttcctgcgtatatggagagatgaacaagatgaagtccctgcttttaagtgtttagaaaactgaggcgttgctgacatgctgactgatgacttgccatcacataagacacagaaatatgcattatcaaaagcaaagtcatgtgaaaaacttagagaaatgaggacagtgccacagagatggtggcatttcctgtaagccttgaaggggacaggaagcatatggatgagaaagagaaggagcagtagagtggcacggtggccagctgggccctacaggactgagtggagtgaatccatgcggcagcatggggggaactaagccaggtgaaggcgagagggtatgaactgcagctgctttgcaaaaccacaccgtggggtctggacagaacactctagtgggaaagtggatgaaacagacaggtgggggtatgtgtgacataatcagggtaaacatgttggccatttgaaggatggacaaacaaggaaggcaggcagtttagttttagtccaggcatgaaaggaagcagtgacaatgaaaagaaataagcaacagaagagacattcctgaggtagaatcaactggacctggagccaagagaatactgaggataaaaagaggcagtacagccatttcctcatctgtaatttggaaataatgaacaattggttacgaagattaaataaaaatgcttaccataggtttggaagatatgctagtaactaccaaactctggcctctgtgctgagttacagattctcattttccactgtttgggcgtctctacctcaagtcacacatccaaaacggcactcgcccacacacagctcttccccctgtatttcccacttctgttaataggatcataaccagctctgtcaactaatgtctagtgtcagtgcagtgagagacaatgcagaactaagcaggatgaggagcaagcaacctccagggcaggggaatgactgcaagagcacccacacctgattcacaccatttgtacagcacagaaatcaaggtcctctcaaattacttttaagcccacttctttcttattcaaatggacccttgagggtaaatttagtcacaaattgaatttggggagttaacacttagaaccacctaaagatctttttcctctgagttaagggaaagtgaaaacggtgagaagccattccttgccatttctgggagacaagacccatgattcagtaataacttctccttatgaaaataaaaacataaagatagcagcaatattcatcctaattgtctcatttgcccaactccaagataccgaggagttctagtgccagggtctgccaatttcccttttaaagtgtctcccagttcgtctattgctttttctttattgcctaggctgtatccttggttcacacctgactgactgtttctaggactagtgaaatgcttatatacttgtctccctgcctccagttcccaggcaaccctgccccactctaagtaacttcttcaccactccaacctccccactaatactagttatcatctcaaatcatgaagtctgatcatgacaaacatctaaaaaaaaaatctctcctgggggtccattctcaaaagaaaaaagtctaattcaaatacagcctttcacaatcttttttctcgacacaggactctcttacacctctgtgcctttgcacatgccatttcttctaccaggaatgctctttcttacatggaagtgtcattttcataattcaaaatcaagtccaaatgtcaccttcctgtaacagaatcagctggtccttcctacgtacaccagctgcactgaactcttattgccgccctcaatatactgtatcacaatttgcctggtatctgtctccctggatagactgtgagcatctcaaggcctggtaccacatgcctttcatcttagtattcctagcacctggcacagagaggcaagcaaagggtcaaaaatcttcctaaactgaaagataaaattatctttataattaaatgttggcaatggcagtagaatgaaagatgaagaaaacttataaagcagctttggaatatagtggaatgtgcagaggactgggagtcaggctggatcagccacttgccagctacttcagctggagcaagttactcaactcacattactatgttctcatctgcaacatggcaataacaatacttttaattgtagagagtaaatatcttgcccagtacagtgtttggcgtacaacaggttctcaagaaaaagggtagctactctgacggcagtgatgatgatgaagcacacttagtaggtgttgtaggccagaatctggggaatgggctgtccaggttcatacgcgggctcccccattcaggagctgagatgccttatgcaagttacttcctgttgctgtgctgaggataaaatggacctactacagagttgttagaatagttaaatgagaatgtgcatgaaaagctcttagtcaagtaccatgttacagttaagttaaaaaaaaaaaaaaggccttagtaaggtattgttacttaaacacgcaatattgctagtgattattcccacagtagatactcaataaattagctgatttaacaaatataagaatgaaaattagggccggatacggtggctcaggcctgtaatcccagtactttgggagcctgaggcgggaggatcgcttgagccaaggagtttgagaccagcctggccaacctggcaaaaccctgtctctactaaaaataacaaaaattagctgggcatggtggcatatgcctgtaattccagctactcgggaggctgaggcatgagaatcgcttgaacccaggaggtggaggttgcagtgagtagacatcatgccactgcactccagcctgggtgacagagcaagactgtctcaaaacaaaacaaaacaaaacaaactgcttaacctaatcctttactcattataaagtttcctggttggttataaaggctaaccagatagtctggttgttgaagtactgaatgaaatggctcctaatacctttccaggtttacactccactatttcagtatgaattctccaactaagctgggctagcccccaaattgccctgatcattcccacctccaagcttttgctcattgttcccttctcaccacttctgagattctgccttcaggacttagtttaattcattttccccaaagtctttcactatcagctcagcacataccgacctcatgtacctctcattttatactaaacaatcccttcacttacacattggtcaacaaacagttgaataaatgaagttccaactagactgaaagaacccagttacacattttttcaaatcccttaaaatgcaaataaatgtctttcaaatattaaacgcaataaaaattataactatacattttacaaagaaattaaagagcaaataacacgttaaagaaattttggccgagcatggtggctcacacctgtaatcccagcactttgggaggctgaggcgggcggatcacctgaggtcaggagttctagaccagcctggctaacatggtgaaactctgtttctactaaaaatacaaaaaattagctgggcttcgtggcatatgcctgtaatcccagctactcaggaggctgaggcagaagaatcattgtacccaggaggcggaggttgcagtgagctgaggttgcgccattgcactccagcttgggcaacaagaacaaaactccgtctcaaaaaaaaaaaataaaaagagaaatttcataaaaaaaacatttcatcactaacatatagatacatatgcatgtatacactcacccacacacatgcatatataaaacatgagaatttaccattcctgcagctcatgcatatgaaggaaacggtttcgatactctcttggcagttcaaattgggaaggtatggggaacatggattcatagaagtccctgagaacagccttcactgtctgagcatctttatgattgtggtcaatgttgtcattcaggcaaacaaacttcctgaaataacagagagccagggttattagttacatatggataatcctgacctaacaaaacaaggatgtggattccaaatatattttaaatggacttatgtcccaagttggtatatttgctgatatgattctctgggggaatgatattctataaaatttttctttagatattcctcacgtataaaacaagagaactagggtagatggccttttagctatgggagtaaattaatttaatgacttccttttagagtgtcctgaattaattgttcaataaatgtagttaactgactagaatattttgttggcagctagcaaagacaatcagtggccaggcatggcggctcacacctgtaatcccagcactttgggaggcagaggtgggcagatcacctgaggtcaggagtttgagaccagcttgaccaacatggcgaaacctatctctactacaaatatgaaaattagccagatgtggtggcacgtgcctgtggtcccagctcttcaggaagctgaggtaggagaatcgcttgaacctgggagggagaggctgcagtgaggaaaaaaaagaaagacaatccgtaagtacctaaaaccaagttctctgaaggccatgcatggtggctcatgcctgtaatcccagcactttgggagatcaaggtaggctgattacttgaggtcaaaaatttgagaccagcctagccaacatggtgaaaccctgtctttactaaaaatacaaaaaaattagccgggtgtggtggcatgcctgtaatcccagctactcgagaggctgaggcactagaattgctgaactcgggaggcagaggttgcagtcagcaatctttagattgcaccactgcactccagcctgggtgataaagcgagactctgtctcaaaaagattaaaaaaaaaaaatcaaaaccaagttctctgaaatgatagttatattacaaagaaaaatcatgtaaataattgagagagagagacagtgccttatagctacagattatatgaatttgataatttctgcttactatgtctctaaccaagctgtaagatgctacagttctggcaaaaaagcagattacagtggtgcttccttgcttgtttcaagttcctttcaaggcaaaggtcactaaactaagggcccattaaagtggcttgtaggtaggccaatacttttgaagtagattcgccaaaattaaaaaaaaaaaaaatcaaacaaacctgataaagccttcagatccaactaccaatttatgggaaatacaagagacatagaaacttgttaactaggattcaatcagagagggacaaagtgtaagatagctatagaatctataatcagatttattcatatacacatgcaaaaaattatacggttaaaaaaagagagatggagggaaaacccatagatttaacttcaaaccaacaaacttaaaaaccaaaaaaacacataagtctttatgaaagttaagaggagtgaaaggtgtacattgacaaagtagttggtcatattaaggaatcattattgatttttttagggtgataatggtattgtggttatatttttaagaatctttatattttggagatacatacaaaaaacgtggagctaaaatgatacaatgtttgagattcacttaatattaatcaggtagcagtggtggagtgggtgtgtttagatgaaacaaggtcaaatagaaatggaagtaaataaatataaatcacttgtcttccttctgaagaaggaagttttagttgtagcctacacttctgaagaagacaagtgaggggtatgtgaaagctcattcatctttctctaaacctggagactgctttaaattaaaggatactaaagagctatgtcaacctaatatatgagccttgagtgtatcttggattaaaaacaaacagaggcagagaacagctatgaagggcatttggaggcaactggggaaatgctgaagacaggctattagatggtattatttaaccaatgttaaagttctagaatgtgttaatggtctgtggcctgatgatgaagccatcacaagcagagctaagaaattcagagaaaaacaaagcctggagattgtctatcccagactccctgttaacgggataaacatgtccttaaagctgaagtcagtctgaagtctagttttccatgcctgacttaaaataagccttcgtcgaaataaaacaaaacaacataaacaagggttaatgataaaatctgttcaggtacacaagaggcagctgggcctggcaaactgtggaaaaagcctggcttgccatgtgtctttttactaaacccctgtccctttaagtaccatgaaaatgtctatgaatactctaacccaataactttcaaattggcacaaagacctaaaagtataggctacaactaaaaactgcaaattctcacattattactacacatgacggagagaactcatcaagaaaatgggggaagtctgtactcccatcaaaattggttcttaaaagctaaagttattttaagaaattaaacagtacacttcaagtggagggaacagcatatgcaaagagggctgtacgctaggtaattattattgtagcttatggtttgcttggcttgtgggaaacattttgtaaaaaatcaagtattttactggattactaaagacactaaataggtgttaaaggtatttttattttttttgaaaattccaatttctttctcctccaaacgagaacagggtttatagaaaaaatataatggctttaaaatgtctgtaaggttcacatctttgattatttataattaaaatcctaatttcagtgaggtaaaactaaagacctccaaatgcatttaaaagacccagaaattaaaaatactccattttagctgggtgcagcagctcatgtctgtggttccactagtcaggaggctgaggtgggaggattgcttgagcccacgaggtcgaggctacagtgagccatgtttgcattactgcattccagcttggacaacagagtgagatcctgtctcaaaaaaatatagtttatatgccagtgtctttattttccaaagaagttgatgaaacatctacttcccactaaagttaaaaactcaaaaatgcatatttttagcacattttatcaaacctgctaaagtaacagttaaggggctagtaaagaaattgttaagacttaggtaaacctgaaaatttattcatccccaaaggatggctggagtatactggattaaggttcacatttacggtagcattcctttttcctcaaaagctaatctgaactttactttgaattccatctaaacaactgttctggaagtacctttttagaaatgccataattctaaaaaggcatttctagaatgtcccagctgcctggcctcacctccccacaatgcgatctgtccctgggtctctctgaacagcttgttattaatagaacccagttcttcgaagttcaggctcatccctctgcatgggggaccctatctcaacttgcaactcctatctctcactcaaccaccagctccaacactgcctgcactgttaggccttttggtctgttccatacagaaataagctactcccttctttccagtccttttattcaggtttatttgcataattaaaaattatatataaaaatcagtacctagggttttttcttatgtcatccaactggccaaccacatgagaaacgttggtacgaatcattttaaaagcgatttcttcttctcccatgatttcaaacctaattatcaaaacatatttgaagagtttaaataattacatggatataaaaaataaaacttcaatagaaaatacattttttaaaaccgtagtggactcaacatccacaaaataacttaaacttttaatactactacagcaaacaatctcatataaattttagaacagtgcttaatagacaaaatattgtagaattataaaaaagccagacctttgtgattactcttatactaaacaaagggagtatgcgtgtactacttacctatatttgtttttgtccttatatgctttgtggattttgtcagttactggtttacagtttgttactagacttttagtgaccggtggctatgagaaaatataagtagatcagatatcacatcagagctgaaactagggcaatttagtcctaatcttagttctgatttttaactttgattctatgctctctggaggtaagaaaaacaccaactgtgactacatatacatctttttcatctttaagaacatactggcaaacaattactaccatttatataatagagtttataatgcatttttcacaaaccaaacctgaagtactttatcctattggatcatggcaaaaaccccaaataaactgctgaagtacacagacgagctgctcttctgttatcagcctgactgcgtaccagctctgtgtgaggcgtctggtgaattcccgacccacaaatagtctcatagtctcatttttttttttttttttttgagacggagtctcactctatcgcccaggctggagtgcagtggcgcgatctcagcttactgcaacttccacctctcgggttcaagtgattctcctgtctcagtttcccgagtagctgggattacaggaacccgccaccacacccaactcatttttgtatttttagtagatacagggtttcaccatgttagctaggctggtctcgaactcctgacctcaagtgatccgcccgccttggcctcccaaagtgctgggattaaaggcatgagccatcgcacccggccaatttttgtattttttagtatagaaggggtttcaccatgttggccaggctggtcttgaattcctgacctcaggtgatccgcccaccttggcctcccaaagtgttgagactataggcacgtgccaccgtgcccagccctagtctcattcttgacctgctgattcctatctgctaatcccactagagcaagttcctttaaggctgataccaggtcttactcctctatttatctcaactttattaatttggtaatgttaagtcttagcacatttagagaattggcttttaagtggcacatatccatatactaacccatgccatatgctaaactaatctacacgtgataggcaacactcatactatgtgctctgatggctgctatgctgacctctttcaccaatggctgccacttgtcacactgtgtctcctcatgagggaggaggtgtcctatctgcagtcattatttatacatggcttgaagatttgcaagatcgtaattttttaaaaataccacttcattctgattatgaaagcaaaatctactcattgtagaaaatatgaaaaactctagtgtacaaaaaggatattaaaaactacctgtgatttaacctactgtcatttctgttgtcttttggggtatgtgtgttgtatatgtacttggaggatttttatagttcaactcatactgtctatatggtagtacccattattttctccacctaattttattatataagaatttttcgctgggtgcagtggctcacgcctgtaatcccggcactttgggatgctaaggcaggcgtatcacaaggtcaggagattgagaccatcctggctaacacggtgaaaccccgtctctactaaaaatacaaaaaattagccgggcgtggtggcgggcgcctgtagtcccagctactcaggaggctgaggcaggagaatggcgtgaacccggaaggcggagcttgcagtgagccaagatagcgccactgcactccggcctgggtgaaagagcgagactccgtctcaaaaaaaaaaaaaaaaaaaagattactttgtgaaaaagagccctgaaaataaagcttaaaaaaaaaaaaaaagaatttttccatttatcagtaaaaaattaacagaaaatagcagattaatggctgtattatattcatttcatcaattctatgattttcttcacattataacctctctgaaactaaaatgtctcttataatctatactctttcaattatttcagccaaatgacattccaatgcagtcgtgtgttaatcacccactgcccctactggtaaaatggagtaagtgccagcattaaagcaattcagctttgatgaacgatgatattccatgtgatgaatatttccttgatggttaaacctcaggattgttctctctggccaatgagaatactctggggctattttctgtcacccttagtaaacaggacatccgcttatggaatataagcaacaaatccaaattacgcatctatggggtgaacagtaagattccaaagcaagctatgaatgattcggattacctgtgctactgttttgcaacaaagacatataaaaccatagagcctgctgctagttctgaagtgctatacagaaatgctgtaagtaacacttgataaggatgtactttctgttgtacataaaagtaacccattccacttaccaggttgggatcatagtaggattcctgagttggtggaatattatttagctgcgtgatatcagcaggaagcatttttgagcaatttattagcatgtgttccagacctgtcaaatcctaacaaagaaaaagatgataaatctgttatgcgcattgtaagtaatgactgtggttttaaaaataaaaattaagtgaaagcttccaaaaatggtttaaatgctatcttcaaagagagtctgactatatgattcttaagataaaggcactctaagaagagcagaatgagacaatgccaacaaaaatatttcatcttcatctcaaagaacattctggcctctgagatacccatttacacaaggtggtccagggctcaggagaaatcatgccctgcagctagattcatctgggcacctccattagtgagtttcctactcctgggactagaggatgccatgaaggaggggctagctgagatctccagctagccacacctgaagtcctagaatgaatataccacaagaatctcatatgcaggtatggtctggctcttttccagacaatacaagatcaatccctactgaaaacctgcaaaaagtaatttcataaaatacaaaccccaaatttggttataattctagcactaaaacagactagctatgaatacccacagtaaatattaagaattatttttacttgcaataaattaaaatacgtaggggaaaaagagacatggtcagaattaaaattttcttttcttttttttttttttttgagacagagtctcactctgttgcccaggctggagtgcagtggcgcaatcttggctcactgcaacctccacctcccagggtgaagcgtttctcctgtctcagcctcccaagtagctggaatgacaggcgcatgccaccacatccggctaattttttgtatttttagtagagacggggtttcaccgtgttgcccaggttggtctcgaactcctgagctcagctgcctcagcatcccaaagtgctgggattacaggtgtgagccactgcgcctgaccagaattaaattctcatttaaaacatcaaaaagtttagaataagacaatacaacacctgcaaacttaacggcagttcgtgaattctggtagccagtgttcggatttctctgtcagacaagacaccagattgatctgtatcaacttcatcaaagacttgagatatattcagtggctgcactgcactcatgagataataaaaataagagaaggcaaactgcatatcctcagaatggcgcactttgtgaaatgacgtcttgtcaaattcttcagggaacctgtccaaatataacatattacaaactctggatattcaaagtatgtaccgtatctaacatttgcagagatggacttttttctttctcacttagataatacctttaacatattagtcatcaaatattagagctataaatttagcatggtaaatatgcacatttcaagtagccttagttctgaacacaagcaaacaactcaaacacgagcaagacttacatatcttgcagttcttgcataacaatccggtcaatcatgtgaggcatgtgagcagggactttccgcgatgtgaatccaaacttgctatttagaattttatttacatatctgagggaatctgcaaatgtatcttttagttgcctcccagtatttttgctatcagtgaagtatgccaattgtgtcttcaatgactcttcttcctgaaaagagaattctacatgtaactcagcattatgtttagtgcacaagtgtactttgttacaagacattttatataatgtggtaataactagtcacgaactcttcattaggagcaaatgaaatacatgttaacgggtcactttaaggatctaaactggacttagcaggactcaactggatttcagtgcaagtatcaccaatgttggtttgagaacaacagctgtacgatggagatctacataacaacagtcacatatggagggtattcttcaaggactggtcactgactgtgagatgtcaaagctaattcaatgcaacatttagaaaatttatgtacatatacatttgatagtactttcaatatcaagctatttctgcaggtgatatcaaatgtgcaagtccttgagttttaagcgcaaggactagaaacaaatttggtttcatcttataatagttttaatattataaaatcaaaaccagtcagtggcagaactaaataggcaaagaaaattggcaaagcattcaaacactttacagaaatatttttgcttctcaaactgataaaaataaaaatgtaaggagactgatattaactggtgttggttagactgcagtgaaacaagcactgttgtatactgtttgtggaaatatgaagtggtgcaacatttcagaaagacatatttaaagtttatacctgctaagctagtaattctacctgcagaactaaaactcactgaaatgtaagatatatgtacaagagaattcactgcaacactatttgtaatcacaaaacattggaaataactaacctgcagccattaaaaagaataatggcactggcatgggtataaataaataaataaataatggcatttgcccacatcctactacatcaaaaggcaactgcagggaaatatatgtaaatttacactatacatatatttctctatatataactatacatacatataggtatgtttgcatagctatagaaaaatactggaagaatacccatcaaactattaacagcaattatctccgggaaggagactgaagaaggaagaactttcctttatttactgtatatttttgaattgtttgcaatttttactactagcctataatgcttttgtaaatttaaaaaaaaaaaaaaaaaaaaaggaaagaggccagaggccaggcacagtggctcacgcctgtaatcccagcactttgggaggccgaggcgggcggatcaccttaagtcaggagttcgagaccagcctggctaacatggtgaaaccccgtctccactaaaaatacaaaaaattggccaggcatgctggcacatgcctgtaatcccagccactcaggaggctgagacaggagaatctcttgaacctgggaggcaaagactgcagtgagccgagatcacgccattgcactccagcttgggaaaaagagcgaaactccatctcaaaaaaaaaaaaaaaagaaaggaaaggaaagaaaatgggggaaactgaggaaataaacatagtcaagaacactgcagtccttcactagacaatctgtaaatgcctcatgtgcaaggcacaagatacttcctaaaatgctgaggacatagttcctccttcactctcttttctcccagcctaacacccactcgtggctgtgtgccttcactattcagcccagactgtatgatttttttttttggtctgtcaactcccaccccttcgaaggtcagtccacagggcacttccttctgtatgccttccctagtacttctaggcagagctaaggagtcctccctctgaacttcttgcccatatctcaacacagacacatctctttgctacagttttctccccacaaatttgtcttctctactggtccctgagtttccacatgagcagtggctatgttcccgtcatcttgcattccccagtggttagcaccgtgagagcactgaggagaggtacagatgacaccacagcacagtgaagccatggtacagggcaacgagcagtccaactttgaggcttggctcacactgatttgctgttataatgttggggaagcgaatgaacttaattgaacttcagggtttttcatcagtaaagctggaaaaataccatatctgaaatgtcaagacaagacaacatgccacttcccactctccttcctccaagtacgcccctggctaaatcccttactcattcacacttgggctgtttcctaaactacaaaatggggacagcaataataaataccttcatatgacattttttattattagggttattgggtaaattaaatgaaaccatgtaagaaaagcatttagttccatggccggcacagggaagtgctgaataaatggtagctataatgatattatcatgagattatttactcttcctgagcatgagaaagaatgaggctggatgttacttacgtcgagaagatcttggaaatacttttttttctcccatggcaaaaagcccaagtaactatctgtgtaatgctgcagctttcttccaagtaacacttcagtaacgcctatgtgattttcagcattttcctccattctactgttctctttttctttccctgtgattttcttttcttttgtcatctggctttccagtggaacaatcagagatgggggcttttcttttgtcacatttccgcctatggttttttgggtgtgagtttccactctaaatcttgctgtggtctccaagtccaggggtggattctgaccctggtcatgaccattcacttttacactcactgcaggaaaagtcaacctctgcaatctttcagacactcctaagctgtttggcaagatgcttttatgaacctgtttttcctgtggagccaccaaactgtcatttgtttcatctgttattatagcttgattttttattttagcatgctgtgagttcatcagaaatgatctcagcaaggctgacttggacaaattgtatcctttcaaagtgatgtctccatgttccagttgcaaatccaaggtattgagactcaactgggcgtcttttggaaggagtgaaatatttaccaggggaattttcacctcttcctgggctctccttgttgagttaacatcatgtctcttaaacttcgggaagcgtttttctttgggaatatcctcaaaaaggatttccgcctctggaagaagtgttatgggactaactaaattttcgtaacccttctgggctgtagaattcagttttggtccctcccttgtgtccacctccactgttatctgcattttgaactcttcatcgtttgtattttgaaacgtgagattaaaatgtattgtggtggcattcattccactgtgcattatgaggtggatggttttccacttgttggcaatagaagcatgtcgaattattggattgtcactataggcaccttcaactcctcttttggctacttctgcaaagctgaaataaggcaggcattcaccttttggaataatatagtgagtctggtttgggagaaggatcactttatacaattcatgaaaatgatctagaggaaaaaacagaaacatgattttttttttaactgggcatttttcctctgttttcctttaattctttgagtctgagttttcactttcttttaaaaaaaataatagggaatgcatcatgaatttgcatgtcgtccttgtgcaggggccatgctaatgcctaaactgttctaattttagtatatgtgctgctgaagtaggcactgagttttcactttctaagagtgactttaatttcaaaataatcagatatcctaatacaacagttactggtatagggcttatttcactatctgaggcagtcacaataattaccatgaaatagtgatcctgactcactatagagatatggcatggttcttaacaataaattacaataatcaatttccatctttttatccatttgaaaaaaactttctgccaaaacaaactccattaatacgctatcaacaaaatccagtgtttgaaccatctttatttaatgaattattgatatccttttttgtttccaaattaaaacttcaccacatattttcagctaaggtaaatctgcttggtccaaacaaaacaaaacaaaacaaaacaccagactgcaacaataacaggaaaagatcctcttcagtgatttatgttgttctcttactttcataactagtttgaatgcaaggctggtaaagggatacacagagaatcattattttaaataacaaaagccattcaaaactctctctacctgtcaaggatgttttatgctcccattcttatttgtttggcagtaaacataccttgcccacagtcgccagcatcaaacccacaggacaagacattgcatgcttggtcacagaacttatcagcgagccaggaattcgcacatccctgattacagtaagagacactgtttattcctccaccaaactgccagggctgtccaactccaatactcccagtacctccacctcctgcaatatagcgactccctccactgtttcctgtagatcggaggaagaagagggattcttgctgtaattacaattttgaaagacagttctggactgggtgtggtggctgacgcctgtaatctcaacactttgggaggcagaggaggctggatcacctgaggtcaggagtttgagaccagcctggccaacatggtaaaaccccatctctgctaaaaacacaaaaattagctgggcgtggtggtgggcgcctgtaatcccaactacttgggaggctgaggcaggagaattgcttgaacccgggaggcggaggttgcactgagccaagattacaccactgcactccagcctgggcaacaagagtgaaactccgtctcaaaaaacaaaaaacgaaaaagacagttccttatttcatattgatgttttcaaggttgatgtgtaagttttagtcagaaaaggttcacctcattctttagtagaagatctcatataccttaagaagaaaataaacgtaaaagggagtcacttgacagaagcgtgatgaacaggccctggcattttgtagctgtgcaacctacaagtacagggcttacatttgctcaaggggcacgtgctgacagaaatggaggagcacgaaaacaagaagagattattccaaagactgtgactatcagaactgccaaaaacatgtccaaacgtgggtaacatgtttgataccccttgttatcaaatgctaatgttccagtagagactgacttctctggtctacacagatctactttgcacatctgtattctctctcctcagctaaagcgcatctgacatatctgactgaaatacaacttgaagctttgttttctccaatattcaaacatttccaaatccatttcttcatatggaaatggggatgataacatttgtgtacatacttactctctctctctctcaggtaacaaacacaattcaagtgaatataatgaataatgctctataaatttaatgctttataaattgaaaggtagtaagtaaatgtaacaaattgctattatcaacaagtcaaaatataactatgtgagggagagggaagagctgctgaggagagaaaatacttatttcttttgcaactctttagtaattctgtgacctatcacaatctgctgctgaaagctaccagcagtgagctcctataagaaccagttagagtgattcttgctcttggatttatataagtgtattccagattttcatattttaaataagaagacattttcaagtgtattttctcttgttcaatgccctcaacaatgaataaactgggccacatgagggcactaattaccacctccaaagagtccattgattactgatttgtttgttttgagagaggctgtcactctgccgcccaggttagagtacaatggtgcaatcacagctcacagcagcctctaactcctaggctcaaatgatcctcttgccttagcctcccaagtagctaggactacaggtttgcaccaccacacttggctaattttttttgatagagatggggtcttactatgttgcccaagctggtcttgaactcctggcctcaagcactcctcccagctcagctttgcaaagcactggattataagcatgagccaccatgcccagcattactgattctttattaatacataaagaatgtttggttaagtctatagcacatgttcaataatgattaagaagaaaatattccataaaaatgaacgaattacagtttaacacatccttaccagagcaatccccaccatcccaatcgcaggctgaattattacaagccttgtcacaatagccatccttaatccaggaacctgggcagccctcggcacagtttggcacaggccatgtcaaataaacctacgataaaaccaaagagaaaataaaatgacttctggcttctgatacattttattcttgagttaagattccctttataaaaagaaattaagtctctagaaagattaaaattttcaaagggctcagcgttcacactcacaagtgctttaagtttgcctgtacctacagtcattgtttagatcctgctgcgttgaccgttcttactgagcgtatttactttttttccattactcaaggaaagcagacaaggattcaactcatggattagtctctcataacatgctttgataatctactatgaaataaagtagcaccatgccagacttgactgcaagtaccaaagcatgtcaaagctggtgggaagtatgcacagtcactgcttttctgtaactatcagtagctcattagtgtatttgtgcataatcttgtctcaaggctgagagacaatatcctctctcttcaagcttaaggccctgtgataaattaactggcatagcattctgagctgtgcattcacctgctctcagaattagtgatggggtacatggtttttcaaatttaaaatcattgaaaaaaaatacactcctctttaaaaatctctgtgcctttgcatattctaattggaatgtcttttttaacctaaactaattcttacttgttcttctcagtacatgtcaattcagatgggctttcttccctatcctatctgatttaagcctcctttgctcacactcctcagcaccaaggcacacctgtcagcaggaaaagcaccacacagtcattgatcttgtttgtccccttgttaagccacaagctcaactttgagccctacagtctgatacagaggagacaactcaataggggaacaggagaatgggcctggttgggtagcataaacaattacagacaaagtagttttgtgttattagcacttacagttgcagagttttataacttctaagtttacggtgataagtctctaacttatcactgaacccttctaacaacgctacaagggtatttgtactttcctcactatgccagaaaacacagaggtagagccactgcccaaggtcatcctgaagagttggcccctaagtctgtactcttaaccacttctccatcccacctctcacaaagttagagtgcaacaggctaccttaaatgaaattacatctatagctttaagcactaacttgagttaactttctattttggccattttgctgatattctaaccatgattgtctgtttcacagtgattttgctttttctgctatcgtagtagaaaattgagatggttgggaaaaagtgtgggtcctgggtgtctaagaatgcaggaaagcaaatttctaactgtagtgttcttacttcttaattgctgatttctgagcttagcactcaaaaatgattatttgatctcatatatctatatatatttttttatttttcaagatccggttctcactctgtcacccaagctggggtgcagtggcacaatcacagctcactgcagcctcaacattcaggctaaagcaatcttcccatcttggccagtgaccccctactccccccacggccccccaacacccaagcagctgggactacatgagtattccaccgggcccagataattattttactttttgtaaagacaggggtctcactatgcttcccaagctggtctcaaacccctaggtggtcaagtgatccacccacctccgcctcccaaagtactgggattacaggtgtgagccaccatgtctggcctgatatttgactacagtagtatgtgcactcattttctgatttgctaagtgacttccacgctagacaacccccctcctcttaggcactcaccttctggcctttggagtgactgtaaaaatcatctggccagacatccttcccaaacatgacatcatcatttaggtaaataaacttctgggacagcccttcgatgcgatgaatgtgactttcaatagcaggtgaactaaaggtaggcaagtggctcaaatttcgaaaaacatccttttaacaacaacaaacaaaaaaagagagtgaatgagagctgtttgggtttggtttagtttttgaaaggaaggaagggaaggcaatgaagagctagagaaaggaagaaatggaggtagaagggtaaagggaatgaaattatggaaatccctgtaccacactaaaagagcagaattagaaatcacagtcttgtaatttttagaaagtcctgtacctggtgtgttactattgtcactcgaggattgtcaaggttcagccaggatggaatctgcccgttggtgacaatgaaaatattccgaacccatggtgcatgcctctcgatagatcgcaatgagtacctcagttcttcgttatcttcaaaacgactggcagagatgtcttcatcctgcttagactgagaaaaacacttggcatatgaagatgtgaaataccccttaagtcatacctcctcctctttgtcctttccttctgcccgtctgctctcaaggtgctctggcagacttttaaagatggagtcctaattttaaacattacaaaaaatgcaaaagattcagtatatatatttttaaacccaaaattcaaagagacagcatttctataacacactttatgaagaaggttcttggatctgattctaggtgacttcagttaataccaaaccaatggcagtgactgaaaaattagaaaaattccaatcaactcacctctctgtaagtccccttccctcttctaatatagtaacttacacatttttaacatcttaacctttgatttgggctgtaaaagcttctgtgcatcccttacctggctgatggcgctcagatcccataataaatatgcaggacttatggtcagttcttttccatcaatggtcatgttcttcttagtttgcttattcaattcttgaaaatccttggggttattcagttttagaagcgctacactggcctctgaatacaactgcaactatcaaataacaagaggattacacatgaaaagactgaatctcaaggatgaagcacctttaaattcccactctgctctttaatctttccttttttttttttttttgagacacagtctcgctctgtcgccaggctggagcgcagtggcacgatctctgctcacctcaacctccgcctcccgggttcaagcgattctcctgcctcagcctcctgagtagctgggactacaggactgcatcatcacgcccggcaaacttttgtacttttagtagagacagggtttcaccatgttggccacgctggtctccaactcctgacctcaggtgatccacctgccttggcctcccaaagtgctgggattacaggcgtgagccactgcaactggcctgatctttaatcttgaaatggtaagacaatatcaaaacacaacaaaaagacctacacagaccagatgcatttcccaaatgaatgttaaaaaaataggcgtctaaaaacaagaaggaatggtaaaggcagtggcaaactggacacctcagagccatctgagagctgcaaccactcaatggcaccaagtgctgccagatctcctgagaggcaagaatccccaactgttgtatgaaatctccccaatttttcaatgttggctcaaatgatttttgacttctttgcaagtacacctgctggccaacagttctgtgacttttcttctagaatattaccaatctgcttatattgggcaaaaaatctgcaatgtaattaaccttgctggaattggtgacaagtacatctgctagtggggtgtctgaacagcttttgtgccacgtgcctgggaggagcaccttcggcaggactgcctgaagtgcttccatgggaaaactaccttttggggcaaagcttttggggcaatcataaatctaagcgtgaacatcacaaacatcaagttccacaaacaggctttgccacccctacgaaagtccacaccactctttatctgttttctgttctgactctgtatcacacaacttcctatgaagaggctttcatcactcaggaaaaggggagaggcctgaaaaccacaaatgtaggacagtaaaatccttctgctgaactagtgcttctaaaagagcttacggtcttctttctcaatctataaaacaaagcaaacacaaattttattatgagcttattctgagctcttctatttgctgcatgactattcttagctcattttctaagcagtttcctgagcgtatgtagtccagaacaccagaggtgagagttagaaatttcatttatatcttttccccttatgatgtaggccattaactcttctcacagattaggtgcaggtgcatgtgtgagcacctgcagatgcatgtaactgtcttcctgactcaccactttcacctcttttacttagtgagtgcctggcacatatttagtactcactaagttggttctcactgagtcaccaacttgcctcagcatatgtgccgggtgctgggaggcaggccacacagggggattagtagtctgcctgggtccctgtctaccctctggcctttcctgtccctttcctccctctcacagcacccccaaagcatttctgagggctccctggagagaaaaagtcactattctagaacaatttatttacttatttttatttctattttttgagacggagtctgactctgtcgtgcaggctggagtgcagtgatgtgatctcggctcactgcaacctccatctcccgggttcaagtgattctcctgcctcagactcccgagtagctgggattacaggcaagcaccaccatgcccagctaatattttttgtatttttagtagaggcaggatttcatcacattggccaggctggtctcctgacatacaatctgcccgcctcggcctcccaaagtgctgggattacaggcgtaagccaccaggcctgacctccatctcccatttcttgaggggaatcagtgtctggttcaatcacagcttcgttatcaatttctagatcactttcctcacttgatagttcgtctgtgcttatgttttcctccaccttcttactacctgtttttaattccttgatattttcttctgatttataatagctttctgagtagcacatggtacttcaccccccatgctctccacctgctccctcagaaagcacatttccttggtatgcagaatgctcggatcctgcttatacattttcacgaagtcccgaagctcgttcactttgcgaaggtccagggtcggaaggcagtgggcgaagctgaggggctgcaggccagtttcaggcccaggcactggcttggcgtaacctcgaagaaggggtgtgtctagtttaatttcataacttgtgttggctctttgtttgataagaaggtatatcactaaaactattctttttagtgcctagggttggtttctaattatatatgcataaaagagcaagaagaggtttgtctatagtaactatacaataattcggaaagagatgaagattaatgaggttaaggtaatatttatatgtatgagaaagattttctgccactgtaaaaagggtggggaagtaccctctgacagccactaggtggcaccccaatcctggacatcatcattacttttgtcagaagagagaaggtagtgtgggaagagcagctgtagtttgtgcctaaggctggagtttgtggcttgggcaattgtgggcaactgcctccatatatggcatcttattttaaattttaaatttacataaattataagtttctgcaaaagggaacaacttctatacccactccctacagacccacagtgaacaacacgtagcatgactaagaaataaagctttgttgtttttagccattgagattccagaatgtttgttctagcagcatcatctagaacaacatgactgatacacctggtacttgtaggagtatgaggcaagggaagacagacagagggagaactaaatggtggctgaggccagggcctgggtaggctacaacgactgagcaactggtggatcaatttgagtcaaggaaagacaatatagatgatggtcaggagaagcagtgttgtagaacccaagaaaaaaatgttaattcagaaaaatatgttaattctggtatatttctaaagacaacaagcatcaaaattaagggacaagaaacaaaattaagtggaatgtgtaattagtaggtcaatggagaccaatttcaatggcatgacagatatggaaaccagatttcaagtgcttgatacttcacaaacttctagatataatatgaacatatgtaagtatatattggaagcaaatctaacattttacattttgtacagtgtatcacataggacagggatgataaaacaatcccaggagtattaaattcagtataattcagtataactgaccaagtcacaagatataagaattgaaaaagcagtgtaaataatcttcacttttaaattctataaatgattatcaaggcaagattagagcatattaatataaaatacatagagccactttaagatattgcttattataagtgagaatattcaacagttcgttctactgttctcagcattgtagcctatatttaaaaattggctttaaaaacaatagtagccaacaaatacaggtaagtttgaatgcatgtttttaagtcaagcaaaaataatgagtgcaaaagagaaggtatccttttgaggcagacaaaatagtattttaagataagccttagttaaaaatcatgatatcaaactggtcatttttcaatgccaaaaagaaaggctgcgtcaagttgtctaaacaatcacatatctgcaaatactcccgaaggacagagacctgggatgctgctaaacatcctacaatacataggacagtcccccaaggatagcggcaacaggtctaaactgtgaatggtgcaaaggtggagaaaatttggtctagaagaacatgcaaatccaaaataacaaggctttcctattagaagttattttcccaacaactttaaagtgcttacaaattcagaaggtgtaatctactttcattttggattcatttgatttaaaatcattaaaaatctgttaggaaaaaaaccccacgtctgctaagaccaactgaaaaccaaattagtgcctttaagtgattcaacaattcaaagctattagatcttttttttctttttttttttttgagacggagtctcactctgtcgccaggctggagtgcagtagcaccatctcggcttgctgcaacctctgcctgctgggttcaagtgattctcgtgccttagcctcccgagtagctgggattacaggcacacgccaccacatccagctaatttttgtatttttagtagagatggagtttcatttcaccatgttggccaggatggtctcaatctcctgacctcatgatctgcccgcctcggcctctcaaagtgctgggattacaggcgtgagccactatgcccggccgctactagatcttaatacgtcctggtggttttctaaaacttaatcagtttcagagttggttgtttcatctttattttagaaataaaacaaaaaaagaaaaaggtaccgtgctttaaaagaacaagtgcacatagtggtttcagagaattatctaaaagaaagggcattagtagaaaattatgacaatttactgtgaccttaggccctgaccagagctttgaggggggcagagtccatgcaggacaatatgctgttcccatcctgcctgcacaaaccacctgttcagtcttcaagaacccagtgcagcctctttctctttgaaaacttcccccatgtctctgacccacacagacttttcctgtttccaactgccaactctatacacacacgctgcttccaaaatgtgactataaatgcttgagggcagggtctacatctcctccacgttttgcacactcactcaacaactactataattgaaggaaacttagcatgagaattcacttgacagctttgggaagatttcccacttgctctaaaatatgtttaaaaaagaagtgaacaaaagcaaaaatcaaaaaataaatgcaaaaacccaccatgaatgaaaatgttctatggatacaaaatgatttagagggatctgaaaataaggactgatgatctgatttatcaaaagctgaattctgtgtccgtcatacacaaaaattatacagataaattagagagtaattaatcagattattaaaggacccacctcaaggtatttcaaattagaaagtctcttacagaaaagactgatttataagactacagtcaaaagattttatgaattcaaatccattatcttacaaatgaaactattttcaagtcctacactcctgcctcagttaataaaacaaaaacaaaaaacttcaggttttgttctaaacaggatgacaaaggcctagttgtgtatatacaacaatgtgcaaagacacatttctgtgcctagagtgactcctgtgaataatcatactgctgaaaatgtttccctatatatcccaagatattgcctcatatggctcattccttaagcagccccctaagtgccaagtaatcactaagggtaaaaaggtgaatagggcagtacctgtcctgagatacccgtggcctagtgagaatctgtagggcagagctgagctgagccctaggtggctccagggccacaggccatggcaaaggcctcctgggggaacctgcgagggcaaagtggttcaacagttcaagtcttgaagtccaatgtctaacagccctctcctctgacatgcgacgtacacccctaatgcaacacatccgaaactgagctctgggtctccttccaaaagacacttgcttctgccactgaagctctgagtgtggttaattccatcacttctatcttcaccagaaaggtccacctcccctttcattctcctcttcctcctcctgaatagcttgtaagtcaccaagtgatgttgagtgtttctctcagatgcttctggaaccatttccatcgttggcatcccactgccaagcaacttttgcatgggaacgtcttactgggctatggcagcagcagctgaactggttttcctaccacacctttccctagtatgttccttagaagcagatcagactgtgtccttccacggcctacaggaaaaaatctagtattcttaacagagacgtttctcaacctggcctcaacctgtctttacaatctcatcctcaccaaaatccctgcctgtgctagaaaccattgccttggttccctgaaaacaccatttatgttcaggcctccagccctcttgctcaggctgttccctctacatagaatggtctcttctgctcccttctctgctgggagaatggctgctctgtttagggcccagctaaaatgcttctattatgcaaagcctgccttgaccccaagtacacctaaagcccagatgttctcatggcactctgtataaactcttatttggagctcatcatacacacaaaaggtgttttgtttggttgggaacgcagtgataggaaacttcattctcagagtactcataatgtaatcaggaagcaaagcctaaggaaagcaagtcactcgaggcctggactcaaatgctgacactgcgtctgttcttcctctttctcattttctctctagtctctaaaaatcttaagtcctagtccctgaagttgatcacaggtgttggaattatgaaaacaaccttcaaagaacattatgtgtgattagcttgatgctctgagaggtgttggcctccacaaagacaactctgaaaatccaaataaatctctgactgggagactgaactgtggaaaggagtctcaccacacctggagcctgctggttttccttgttcaattcaaattgctaccccactccacctcgacctgcttataccacacatgccacccaaaaatagtttgctgaattgtcaaccatgactcgggactggcattctctggcagcacacacccatccaccagtagacgcatgagagcagtccgcactggtgggcagctgcagcaggccaagtgatgtgggatattcaaacagagtggagtatggagaagtggaatgaaccttctttcttttcagcatttattttattgaaattatataaatagaatcaagaatgccattctgtctacataagcaagttgaactggtggtcaaaagtacagatatacatgtgtctataattctagaactaataaccaggaagccaagaagtcaaataaacattggctgaaatgaaagttaatctatggttttatctgtccaaatcagtactaaaaataactcagaggaaggagagatgtattatctattctaaaataactgcatttaagaacaaattcaactctaatatagccaggcattacagtatttcaaagtacaataaagaaagtcatgaagggcaaggagcagtggctcacgcctgtaatcccagcactttgggaggccaaggtgaggggatcacctgaggtcaggagttggagaccagcctggtcaacacggcgaaaccccctctctacttaaaatacaaaaattagccaggcatggtggcgcatgcctgtaatcccagctatttggaggctgaggcaggagaatcatttgaacccgggaggcagaggttgcagtgtgcccagatcgcaccactgcactccagcctgggtgacagagcaagactctctccaaaaaaaaaaagctatgaagaaaaatatgaaaaaagtaaaaaattcataagtggttattcacattaccattgtattacaaggataatacaatgtatcataaaacagtaaaacacttggtctggggtagggagaaacaagttaaaaggaatttggttggggggtgcatataaaaacatggttaagacaggaactaagtaaaaactgctctctagtcacctctaatcacagctcccccaccactactccatcttcatcctttcaccctcaaaattgttaaatgacatacaacaggaggaagtaagaatcaggtaagctaaacccagtggcagaactcaaagaacatttctttataaaatcaggaaaactagagcctcacaaattctgagacaaggactttatgctctctactctaagagatgggacattcacgatttacaacctgaaacacctctgacagaatagcaggcatcttgacgtaaggtcaaatagagagaacacccacatggactatgtcctaagtcaatcagataaaggatctgaaaacaatacatgttaaggaaaaggcacgtcccaggccagcctccagagtccaccttaacaagtggcatcaatggtcaagcctgaagagctaataagtataaattttaaatacatttgtccctcaattagttactaatgaatggttctcattagcagatgttccatgtatctgaagcacactacctttatgagtgaaagctttgggtaaacaacaggctgtgtgcattgatgacatttatgacttcccctcatctcctcctcccatgcttccattgttcacaccctaagttccatccgggcctttgtctgttttgtccactgctgcatccccagcagctgtaatgtcacctaagacattgtaggagctcgtctacggccataccaccctgaacgcacccgatcttgtctgatctcggaagctaagcagggttgggcctggttactacttggatgggagacattgtaggagctcatctgttaaacaaatgagtccttctctatccaggaaacaagcaaaccaaataagactcttagatttttgcccaaattaaaagtaaggagtgaggctcttctggcagaacagaatccctctttgcttcttatgtttatcagctaaactttgggggaaaaaaatggaccacaagaaaagaatcacacattaaatgagaatgtgccaggctaattgctctattttctatgttcttaccagtttgactttagaggaaagattttctggcaattttgtttttagttgatttgtttccttgaatgttggtggaaatccactcaggaaagccaaatcttgcattagcactaatccagggacttctttatctgttgtctaaaataaggggaaaaacataactcattttccacatcatgaggctggtgaaaacctacagctgagaaaactggtaaagatctattgcatcacaacacaagcttcaaaatatgatttttaggattacttgaatcaacagtcattaatattagtaagctacccttagataaaaaataaacattaaaaagattctcaaagaaaaacagctttattattcatatttttattctagtctattgtaaaaatgcaattaaatttaaaataacataccaagtagcccctccatactgtctgtctgctatttcctttaagcagtccagagtgggcatcttcaactacaaccaagaatacaataaacaagcacatttttaatgaatactcaactatggtgtctggcagaacactgtgaaaacattctgagagctattaaagcagcataatatatggtccaaaaaaaggaagctgaaggagacaaaattagcccattcaacaaaaggggaacaatgtaaatcagtgtacgttgaaatgttaaatttcacaataccaaaggtgattgacataaagggaattcttcatgggagcagtcaaatttaagctagaatgcgaagacagaaatgataggatgatagaaatcacagatgtatatgcaaagacagggggaaaaagaaagaattgtttgactagagtaaaatatttgggagtggtgagtactaggaaacaagggtaaccaaaggggcccttgaacaccaggcagtggcatgtatgttaacagcagggggctactatggatcttgtggttccttaagaggcacagttttctcataatgaatccccagttcattgggtgctgctgaatggagcatcataagtcacagtagggattgggggtgacacagcccaactgggagagagttagtgatggggacaagtgagatcaacaaactcactgctgacattcagggattgtggaaaacaaaagagaggtcagaaagctccaattctgatcttcaagataaacaaagaaggcaggttctccaaattatagcctgatgagatgagatgtcaatcctgggcatgagtctcaagtgtactatagttacagggcacagtagctcatgcctgtaatcccagcactttgggaggctgaggcaggagtatcacttgagcccagaagttctatatcagcctgggcaacatggcaaaaccctgtctctacaaaaaacaaacaaacaaacaaaaaacacaaaaactagccgagtgtggtggtgtgcacctatagtcccagctactcaggaggctgagatgggaggatcatctgagccccggagttggggctgtggtgagccatgatcatgccactgcactctagcctgggtgacagagtgaggcctggtctcaaaaactgaaaaaaaacaatatagttggtgagcactgagaaaagaaagccttcataatacactgtttatctttaaaggaagcactggctgttaagagtatgaattcattacaactttatcagataaacttttctctctctctttccattgatatgatgaattctacctaacagacctggtatatgtatttgtaatctcagcaaagtagctaagggcatctcatgtcatcttcatggatataacaaagacatacaggctcgatgctcaggtgggctagaacttaaccaattctaccaaagaggtgtaggtaacaaagccgcaatcaacctagagggaggtttaggagattagtcataggtccggtcttgctgaaccctctatcaatgttttggaagttacagaaggcatgcttgtgaaatgtgtagattcataggaagatggcagagaagctattgtcctggataagagactatggatttcccaaatttgtgactatttggagcaatgagtcaaatctggcaaaataaaatctcctatgaagtaaaacctttatatatggtaccaaaaccaactacacaagcatacactaaaataggtatttgagcattagaatatataagttttttttttaaaaagataagttttactcaacagtgagttcagtatgagtcaacaatgtgctgtggccacactgaatttccatcacatttttgtgcttttaaacagaagtaaagtacgtcgaataaaaaaggtgatgatgttctctaacaccgagtcattaggaaaccctgttgggttgaccttcaaaatgtccagaatccaaccacttcttatcttcactgcacctccctggtctaagcaaccttccctcttgtctgaattatcacaacttttgcccctcctcagtctatttccaccaaagaagccagattgactgcctggaatgtaagtcagatcacattacatttctactcaaaaccctctggtgattcctcatcctactccaagttaaagccaggtccttgttatggttactagggcctacactatttggtcccctgcttacttcttcaggttcatctactgcctgcctctgtcttgttcactccattccagccacactagcctcctggcttttcttcaaacatgccagatacactcctgcctcagggcctttgcaatggctattctacttacccagatcagtctttccccagatattcgcattgctggctacctcaccttcttcacatttccactcaaaagtcaccttctgagtgagcaatgtccctaccatccaaattagaattgcaaccccctgccctggccgacacttcctctgctgctgcccctgcttggtttttttctaaagcattatcttctataaactatgtaatctacttatttatcgtgtttaccgtctgactctctgactccctccaccaagatgtaaacacaaggtaagggtagagatttttgcccatctgttccctgctgtatcttcagtacagggaacagtacctggcacacagcaggcacttaataagcactcattaaacagacagtcctgctctccctgccaagacagaaccacactaaaatagaatgttcacttcccattgacacattttaaaagtaatctgagaagagcaaactgggacactgacaagtccctgagagacagccaaagaaaggaaaataaaatgtcccaagggagagggattacgtgagttctgtgtgaccataggaggcacagctttaacctacgtgagaaagttataaggaagcagtttgtggttccttttaaaagtcagtttagtctagaggtaaaatgaattgccactggaggaaatttgtttgctataaatcaaaaagtataagcttgactggaaaaactactttgctgagtagacccagctccaggctgcagttcgaatatgtgagtgctgaggtacaaatcagttcaggatctatagagtgaaggggcagacatttatacttggaaaggttaacatttcctttcatactaaaaataacttttttttttttttcagacagggtctcactcttgcccaggctggagatcagtggtgcaatctcagctcactgcagcctcaacctcccaggctcaagcgatcctaccatctcagcctcccaagtagctgggattacaggtgcatgccatcatgccagactaatttttgtttttttttttgtagagacagggttttgccatgttaccaagtctggttttgaactcctgagctcaagcaatctgcccaccttggcctcccaaagtgctgggattataggcgtgagccaccacacccaacctcaaactaaaaataacttgttaagtatcagggagcgagcactgttagacactgatcaggatataaactggtgagtggtaagttttctgttcaataaaaaaattccatgagaaaaaccataaactcctgtgcaatcaaaacctaaagtcatgagttagattataagtattacagaaatacagaaaagtaaaaataaaatcattgtgaatatattagtccaggagcttcatgaaggagagaggacttgaagtggggctggacgaagcaggggatgtactgagagggaaggggaaggggacaggcagtgggacacaaggcctagcaccacatgtgtgaagacactgacagctgcaatgtgatgcagggagggcagggatgtggggatcaactgacaaaatcaaggcaattagagctgaatcccaaacaccaggaagagaagtttgtatccatgtgaaaagcaaacatgaactgctatattattcttttcataaaggcagtgaacccataaaatcagggttttcagatttatgtgagacctgtgtgccagacagactgagatggactttacatagacagagcaggagtccgattattggagtctgtgtgagggaattcagtctggtgtggaggaaataagtaaggtaagaacctaagaatcatgtggaaaaaaaaaaaaagcaagtcataggatgaagttaattattagttatagatgtaaaaagtaaggagtcaaagatggttccaaagatttaagctgggaggtatgacactgatagaatgggagctagagaactagacttggtgttggaaagggaacacggcagctttcattttacacataaaaaccacggaccttccaaatagagacaatccatgcagaggaggaatgagacagacaagaggctagagcagaagacgcaggttatgggctcagcagtacactggtcaagtgggagaatgggatctctaaggatgtgggtgcagttttatgccaggaattaccattttaattccattatctgcccaaatcatctgttgtcttataaataacagaaatctgtttttcacagttctggtggccaaagtctgagatcagagtgccagcacgcttgggttttggtgagggtactcttctaggttgcagatggcatcttctcataacgtcacatggtggagagcagagggagctctctggagtctcttttgctattatttattattttgaggcaaggcctcgttctactgtccaggctggagtactgctcagccttgaattcctgggctcaagtgatcctcctgccttagcctcccaagtagctaggactacaggcacataccaccatgtccagctgtgtgtttttttggttgctgttgttgttttttggtagagacaggttcccactatgttgcccaggctggtcttgaactccttaggctcaagcaatccttcttagtctcccaaaattgctaggattacaggcatgagccactatgcccagcctgggatctcttttataagggtactaatcccatcaaaggctccacctcccaataccatcatgctgggtgttatgatttcaacatacaaattttggaggaaacacattcagttcatatatttcagaatgtaaagaatcaatactccaggtatgttctgcccaaactgcagaacgctacctagtagaggagttatatagtagaaaaattgcctctagaataattcagagccaagagaacaaggtaattgtgatatcagattgaaagtcctcatcacagcacagaaaggtatgtgtattacacagagtaaaatatatgcagcaatccctttttgaggttaaggccaaaatacaatagcagctgttttgcttctctttgtgcatttttagaaaagtttatcagacatttaagaatgaatcatttctattccactcagaattttgttattcaaacatccaatgataacatgattttaaaatatccataaaaagatcttaccatccttagtactgtcaaaaacaacaactgagacattggtagaagggttttttggttttgcaacattgaaaatgtcactggcagaatgaaaagaaggataaagagatggcaggtccttcagggtgatgttggctggcagggctgggtccaggacaagcattggcaccttaatgcagtgtgttagcaaacactctaactgcttctcactggaaagaaacaccaacatgcttacaattacattcttgaaatttaatcagcaatgagaagcttgtcatactactaaatttttcagatttttttatagcccataaaaaatgataatattttaacaaatgaagacttttatctcatggatacaaaaattaagttagcaagtatgatataaaattgttaaacccaactccaaagatagagctttcaaactcccattaataagatccccaccaatatttactaattccaaaatgcacatgaaattaagcacttcattactatcattttttaaagattattcataattccaataaagcccattattggacagattaggaaggaggcagattctggttaatagagtgtcatgttaccagatacaagttaccaattccagttagaaaacaactaaatacattggatgtgacactacactgatgtaaacaaaagcaactgtgacatggttctaaaataaatttatatgagatatttctatctgattataagaaatatctacaataaacatattacctgaataaacaaatggatgggcaaaggacacggctagaaaattcacaaagtaggacctataaccagttaaacagtataaaaaattgttcaacttccttaataaagacatgtaaaagaaaacaatgagctatcacctttactaaattagcacccctcaaaaaatgatgactcaatattagcacaagtgcagtaaatctccttctcttaaatactgctggtgtcactccaaacgacaccaaatcttttgggaaagcaagttggtaatatatacatgtatgcttgtctaatacacatatgtatacatatatacttattcagaaccataaaaacatacataagcttcgtcctcagtaatcttacttttaggaatctagtccagtccaagtagggaagagaaacaaaacaggaaaaacaaacccacacacagaaaatgccacagacctaaatataagtatcatgaaatattgacaatagtgaaatacagaaatgcccaacatttagtaaattacagtagtcactttatggaatattatacaactattaaaactgaaagatatgaagcatgaagataatgcatcaacatgatacatacatataattacataaagtttaaaaaggatacaaaactgcccacagattataaactacaactattcaaatatgcatgaaaagggaataaaaataacagttgttaaataagatttataaaattttgtgagtttttgcttttcactttcctctcaatctttcttcatgttgcaccattgcttttatttaaataatttaaaaaccatttaaaaaacagtattaatgttaatataatttataaataaagctatataattaacataaaagatagcttagaaggcacttctgaggccggatgcggtgactcacgcctgtaatccagtactttgggaggccgaggcgggcggatcacctgaggtcgggagtttgagaccagcctgatcaacatggagaaaccccgtctctactaaaaatacaaaattagtcaggcgtggtggtgcatgcctataatcctagctactcgggaggctgaggcaggagaattgcttgaacctgggaggcggaggttgcggtgagccgagatcgcgccactgcactccagcctggacaacaagagcaaaactccgtctcaaaaaaaaaaaaaaaaaggcacttctggatcttgaaattctcaggatcttctctatcaataagtgtttttaaaagtctgatggttaagtggggaggtgacaattaacagagattgcttgtcagtgagacagtcttgttttaaggacctatcagagtcaggaatgactcaagtcgagataggtgtatttggttcttgttgttgggctaaatctccttcccaggttcttaaacataaaatatacagcttcacagcttttaaagataaggatgtatatattgaacctataagtaaatgatggacataaattttataaatgaaaatactgggtagaagatacagtgtaagtggaccaagataacaatgcaccaagagggaactaaagagaaggaaatcttgggactctaaccctccccagtgcagtgaagctttggttagcaaaataaccagaattctcagtcaactatgcactcagcactgcaaaatttcctgtctaatagatgtacctaatttggggtcaaaaactatatggataataaacacaaaatcctgtgtacccaataaaaacaaatgataatctgaaatttcacttcaatccttcactttttactcttgagaggaaatcaaaatgcttacctcttcttagtaggttccgttgtgtttttcccaaggatttctctaataaaaagcaaatacagtttattacatacatatgggctactatacctcccactgtaaccaagacggtttgcttagagcataaactttcatattttattagtaaaacatggtaccaggctgtcagccattttcatgcactgggaaagtcatataacctctaacaaagagaaaatgaatttgctccaatataaggtggccaaagacctgcactggggtgcactcttgacattcacaaagaagtcaacaagtaggtactaagaaatactcctaacgaatcaaaggggaattacatcagccaggttcctacctcttatggctatccagaagtccgctgtaactttcccagataaagtaaataaaatgaccaatctcatatattaaataaaaagtaccaaagtttctaattccatagtctgtaatttattcctaaaaggcataaagggagtatactttttactgccgttttcaaatggaaacaagtctgtgggcctattatatttttcaagggaagaatctgtcttactgtggagatatttttcataataaacacttatttcaagaagataccacacctggggctcaaaatgagtgagtaggcagccagcgggttgggggagggggtcctctgtctttaggtcccttgaagagcaagccgttactagagcaccatattcataaaatcatcatctaacaaagtgaggccagtatctggcaaaagtggctgagttctccttgggcaccaagaaacacaggccagatggatgactgccaagatctcgtaatggcatgaactgaggggcaagtttgtttggatggcactgtgaaaatcaacttacccttctctaatgcatgcttacttgtacccacaggactatgtgttttgttttgttctcttttctttttcttttttgagacagggtctcactctgtcacccaagttggagggcagtgatacaatcacggctcactgcagcctcaacctcctgagctcaaatgattctcccgccttagcctcccaattagctgggattgcaggcgtgcaccatcacgcccaacaaactttttattttttgtagagatgaagtctcactatgttgcccaggctggtcttgaactcctggcctcaagtgatcctcccacctccacctcccaaagttctgggattacaggtgtgagccaccatgcctggcctgttttgttttttaaaaatcagttttaccagatccttttgtagttcattagcatgatgactgggttttcatgctcatatgtgagatgtgccaccctcagaccttattacatcgccacattacccatctgatgtgaaaaaaaaaatcagttttacctcattgctttctgctcctcctccatctgttctctgacctgctgtagttccttcagtagttcaagatctgtgccattcacccaggtgtaaacaacgtcaatcggcatgggcagacaaagcctagggcaaaccaacaaatcctccagcttaaatgcatttttccaatatatttggtaataagaatatcacagggtttaaacccagagattatgaaaaaaatctctgaagaagtaatccaaccatgacatattatcacagaactgcatgttttcaaactgtagctggggggctaatatttgtcaagtacctcctctgtgagttgtattatgctagacacttaggtaatttgcatcacctgatgcacacagccactctgtaagaaggctaatattagatttaaagattgttcgtgggtgaagtagagtagtcttggaagttcagtttacattaaactgcctgttctcataatttagcaaagaagggagctgggatgcaaatgccgtcaaacatagaaaataaattagaagtttaaagaacaaaattacaggctctgcacagtggctcacgcctataaccacagcactttgggaggccaaggtgggaggatcacttgagcccaggagtttgagaccagcctgggcaacatagtgagaacctgtctctacaaaaaatttttaaaattagctgggtatggtggtgtgcatctgtagtcccagctactcaaaaggctgaggtgggactacagtgagctatgatcgtaccactgcactccagcctgggagacagatcaaggccttgtctctaaaaaaaaaaaaaaaagaacaaattacaaaaaaagttatcaaaacccacaatgaagacctaaccctacttaatgctgtagccttcttgtgccttgctcccccgcaagcctgcaccctccccagcctcacctctgcttttccttttttttttcacagcacttactacttttgtaacatattaaataattaacttgtaacctattccgttaattatgtgtggccctctcctagaatgtaagctccaagaaagcagaaaactttcatgctttgttctctaaagtatctgtgcaatgagaagagtgcctggcacacaggtgaccaataagtatatgctgacatatgagacactagtacagaagaccttcctgaacttgcaccatttcttcctgatcatcttgtcctcataataaagagtcaggcaggcttttaattcttgagtatgttgtttaagcctcaccttagtgattttacccagattttatccctgccaaaagcactcttcccttttctctcactaccaaaaacctacccatctttcaggggcctgcccagatgcatgccactttgacttatgacacaggagttcatgtgtacatctgggtactgatactactttagatcagcagtgtccaatcttttggcttccctgggccacagtgggagaagaattgtcttgggccacacataaaatacactaacactaaagatagttgatgagccaaaaaaaaaaaaataataaaccacgcaaaaaaaaaaaaaatctcatcatgttttaaggaagtttacaaatttgtgttgggccgcattcaaagccgtccttggccacatacggcccacaggttgggcaaattttctttagatagtgctatttcaagtttagtactttccaagaaactgtatgggttttgcagttttatttttaggccaaggaccaaagcataccctccttttgtcctcctcacagcccaggcacagcctagactttcagttgctaccatattatctcgtgggaaaataaatgctatttggtagctaaatcttttgaattatggaaagaaaaaaattaacagaaatgaaacaacctttagcttacaagaagtaggggagataactggatgagtttctccattcactgaataattcttattgagcgcttaatatgtgctaggtactgttctaggtgctagggtttcagcagtaaataaaacaaagcccaaatctgtgccttcacggagcttacattccagaagggagaagacaggaagtaaatcaaataaataaagtcagatgatgttaaatgttgtggagaaagtaaagcagcaaatggggatagaaagagtgtctatggggaggcggggcggtcagttttaaatagggagatcagagatggcctcagtaagaaggtgacatttcagcaaagatatgaaggaagtgaggaagccagccaggtgggtaactgagagaagaatgtgccagagaaagggaacaccaaaggcaaatgccctgaggcaggcgcctatcttgcttgttcaaggacccagaggcgagttccctgagcagaggggagagaggaaatggaagagaatagttgagatgaaggtcaaagagataacagagttccagagcttcatctggaaaataaggaatcaccttattctctggcatatgtgatagctgagtacttaccaaatgtcttgtcaagtttcaccactgcctgcagaataaggtctaaagtctttcataatctgcaccttatgttctggatgatccaattgtatacccttgtccaaagatgaaacgaacttgcaggactttgtacctttgaatatgcttttccttctgcctagaacattctttctttcatgcttcctttaaccacctcctccttcctcaattccctcccttccctcacctctcacaaagagaatctatagcttcatatgcagcttccacactactttgaactgtaaggaatcctgattgtactgtgctgtgctattttccatgcagccctatcttccactagatggagtatctctagggcagaaatgttatcatgcattctgtgccctgcttcattaattatttcctctctttcctacaccttcgggctctctctccctactgtaatgatttgcaaaggtttccctatctagggtttttctgaatttatcaataaataaattctaatgtttgtagaatttccttttctcacaagctctcaggtaatgctgatgttgctggtccagaaattgcactttgggaaccactgatttatatgtaggttacacacttcgctttttttccccactaaaatgccaattctatataaggccaatgagttcattttgttcaccactatatacctagggcctagaatagttcctcctacatgggtggggtttaatacatatttattgcctaactattagttcattcctttatcatatatatcagtctttctcatttaaaaaaaaatccatctgcctcacactgcccacatgtaaattatccaaggtcatctcattcccaacctcccaggtgatttatgctcagtctaaaaataaattttaaaaaactgcttcagtgatgtgtttttaaaagaaaaggttaaaggagaggagaattacatcttaagctttcctgtaactaaatatttcctgctactaaatatttttaatatatcatttatattatattatttagctgattaaaacataatatactgcatgtattacatgatcaatttaactttggcaaaactgacaaatggaaggagactgtgtgatctgcacgaggtcaatgagtcagttgttttcctattagacatggtcacactctgaatctttcattctaaccactagaccactatcttggttcacagatgagaaggaatgcattatcttggagctgaaaactaagactaagtcactcataactcagaaccaaagcagcaatgacactgacataactttcattttaatcactgtttagtttaagtgaatattaaagccacttaacagtcccttggttctacattctataaagtaggtgagaaaacagagaacttaaatagtattttgtcttacttatttatttatttatttatttacttatttagagatagagtcttgctctgtcgcccaggctggagtgcagtggtgccatctcagctcactgcaacctatgcctcccaggttcaaccaattctccctgcctcagcctcccaagtagctgggattataggcaaccaccaccgccctggctaatttttgtatttttggtagagacggggtttcactatgttggccaggctggtcttgaactcctgacctcatgtgatgtgcccaccttggcctcccaaaatgctaggattacaggcgtgagccaccgtgcctggccttcaatagtattttagaaccaaagagttggaagagattgtagtcttaatctaatacaatagctcttaatctaatatccacattttacagatgacaaaattgagcctcggattgacttaatgcctcacaattagtagcagtgaatagtttatatattcacttttactgacatatggaatgggatttttttcattcagagcaaacaaccttaaaaagatttatactggccaggtatggtggctcacacctgtaatcttaacactttgggaggctgaggtaagaggatcgcttgaagtcaggagttcgagaccagcctgggcaatacagcaagaccccatctctattaaaataaataaattttaaaaataaaaaatctgtacagaaactagcaaaataatgaaaatatatcaatgttatggtatcttaaaatatattagaccatgtgaaatgttatatatgatccatttatttgtcatcatcaaaatgaggaaattttgaatatatgcctacataaaaatcaaactatattttaatgcaaccttctaaacttctttagaaagagaacaagagtgtttgattaaaactgctgacctcaaaatctgcattttctaataagctagttttctttctaaaagtttaaagcagctgggcatggtgactcatccctttaatctcagcactttgggaggtcaagatgggaggattgcttgagtccaggagtttgagaccagcctgggcaacacagtaagacctcatctctaaaaataaataattaattaatttttaaaatcaatttaaaaatttttaaaaacgtttgaagcttcttcggggcagggatctatgcatctgtgcaccatctgcacgtggcacagcataaggcacaaatcaataaatatctgattttaaaatgttaatcaatttagaactttccttagggaaattaacttgttaaagtgaaaattatatttcattaaaaatcctttaatgcagtagttttcacagtgggggcaccagaccagcaactttggtattaccaggaagtttggtagaagtgcaaattctcagaacccctctgaaacctatacgcagaaactctgggctgggaagtaactgttattttcttaagccctccactgcaagctaaagtttcagaactgctatattaaggaatggtcctcaaacttttactgtttggtcccttaaaattaaaaaattagtatggaccccaaagtgctttagtttataaggttataattatccacatttgccatatttgaaaataaaactgaaacattttaaaaatacttaattcattttaaaatgagaataggccgagagcggtgattcatgcctgtaacctcagcactttggaaggccgaggcgggtggatcacctgaggtcaggagtttgagaccagcctggacaacatgacgaaattccgtctctactaaaaatacaaaaattagctgtgcgtggtggtgcatgcctgtaatcccagctacttgggaggctgaggcaggagaatcgcttgaatccaggaggcagaggttgcagtgagccgaaatcgtgccactgcgctccagcctgggcaagagtgcaactctgtctccaaaaaaaaataaaaataaaaataaaataaaataaaataaacaccttttataatgaaattactacattttctaaaataaaccaaaaaaatagtgagaagacagaaacaaaaaccagaaaggacttgtgtgattcattttatctgcaaaaagggaaggagggtgttgaaaaaaattgtttccattctgaggtctgtcttgtgaagaggaaaaaaaaaatccccaaagacaagaaatggtgaagactgcgttccagaatggcggcactaagaagcttggccttccaagggaaagacccacactaatgaggtatgaggctatttgctcctccctcataggtaagcagcaagagtgaccaatggagtggggttcagccccagtggtttactggggagtggtcccatttcacaggacgctgtcaacagaattccggccagggctcagaaaccgctgtgtagtagccacctggtttcctcatcctacagggggatgaaattccctttacctcacagacctggggagacagaaaatgcaatcatgcaatttaaggtacccaataaactacaaggtgggattactctctgtgaatcagatttttcacccacaaaatgtggtgaacacacttttcttcagatggacatattttctttccttattttaaaaaaatatcttacggaatacttcatgaattggtgtgtcacccttgcacaggggccacactaatcttctctgtatcgttccagtttttttttccttttttttagtatatgtgctgctaaagtgaacacatcagatgggcatactcctgagtaaattaaaccatatctataactcagaaagaccccttaaactgtcatatttacaggatggctatttcatgacttacgatttaggtccaaataatagatttctccaaaatagatcttaccgattctgaaaggactttccagcaatattgtctctataggaatcaaacaaaacatggtattgatctcggctccattccagaaccacctagaacaaagaaaaagaaacgttttcttcgcatcaaagactaagagtatataactttcatttcattttaatttcattagaattgctagagaaatgggtaaagaaatcaaaattcatgtattcacttactgcctaccacatacatcgtgttagatccaggtgaataagctacagttcctgaaaaggacaaactaaaagacttagtgtctcaccatgcttggaatggggtagcggaatcaaagaggtttaaaaggatgtggtatttgaaatgggtcttgaagaatgagttcaccaggtagggaaaaaaggacagggccagccagttggaagagcatgcttgtaggctgagaagcagcaagggcaaattgtttcagggcaactgtgtggctggctttgtccagaagacaggtagataactgttgagaaatgggtctaggaaagaaagctgggccctaagcgtgacgtgccttctgtgccttggaagcactgaaggattttaaggcagttacagaatccgtctaaagtttaggaaagactcttctcagagcatttacagacacaagcagaaacagaagggacaggccgggcacggtggctcacgcctgtaatcctagcactttgggaggctgaggagggtggattccctgagctcaggagttcgagaccagcctgggcaacacggtgaaaccccgtctctactaaaatacaaaaaattagctgggcatggcggcatgcgcctgcagtcccagctactcgggaagtgagacaggagaattgcttgaacctgggaggcataggttgcagtgagccaagatcgcgccactgcactccagcctgggcaacagagcgagacttcatctcaaaaaaccaaaaaaccaagaaacataagggactgacaagatatgggaggataaggaccttattacctgtgaggtttcagctaacgaccttgttaaacatttcaggagaaaatggaaagctttagatagaagttccctcatgtttgcaccctaaatctataaacctacccacacatacatcccattttctttttcattcctcttaccacagaggaagtgtccccccaccttgcagacatccaatctctatttgctctggatctcatcaacttgtgtgttctcaagaccttgcctctcttttcctttcagtaggattattcccattggcacgcaaacatgttcccgtaccttgggaacaccttcccttcactccatatccattccagtgagtccctctaccccacattttctgtccctttcaaggtcatctcctgctttcccactcacccttcagctcactccagtatcacttatgttttcaccactttagtggccttaccaaggcccccacattgtcaaactcaacggcattttcctcatctcttactcaagtattcatagcagttgcccagttcctctttgtggaaatgttttcttggttttccctcctgtcgccctggtggctccttttccatctcctttgccagctcattcccttctatctaatctttctgtgtgtcctttccttctactctacatgccctccttcctgaccaggcttcctccagcatcctattccactgcccctaagaagtggccctgctacattcagatgggctgtggggcccaggcatttagaattcattccaactgcagaaaggaaagggaaagacatgccccacctttaaggagacatcatggaagctgcacctaccacttctgttttcattatccagaacttacacaaatctattatattataaaaagttaaaatgtatcaaaacttatacaaacacagactgtacatggtaccgtttgcaattgagagaggtaaacaaacataaaaatgcagcaataaatcataaccgaataaaatcaactgtagtatatactgtactaaaataattttgtacccatctcctgttactattgcagcgagctcacatgttgcgagtatctgtagtgacactaattatctccacgtgagcagtttgtctctctagtaaactgcatgttgcggtaaaaagtgatctctcatgtttcttacgtatttttcatatttagtgcaataccgtaaactgcgaagaacatcatgggactcttagaaagtgccactagtgccgatggaagtgctcccaagaagcagaggaaagtcatgtcattacaagaaaaagttgaatggtttgacacgtaccatagattgaggtctgcagtggtggttgctggccatttcaagacaaaagaatttagctaagaatcattgttttttaaaaaaaaaggcaatgaaaaattatgaagctgtcactcccagctagaaaactgcattttttgctaaatgcctctttatcttgtattgaaaatgcgctttaacgtgggtccagaattgctataagaaacacatacctacagactaacataatgcaagaaaaagcaaagttgttagataacaacttaaagcaaaaggacaataagggtctaaagcaggagaatgtaatgccagcaaagactggtttgatcattttaaaaagagatttggcttaaaaatgtcaagataacaggagatgcacctgcagaccaaaaggcagaagatcagttcccaaagaaaatcatcgatgagaaaggatatctgcctgaacatgtttttaatacagatgaaatttaatcatgggaaaaatgtgacaaagaacatttattagtaaggaagagaagcaagcatcaggatttaaagcaggaagggaagggacaggctgactctactgttttgtgcaaatgctgttgggctttccttacctgtaatgctgctaacccccaaggcttgatggaaaaaaattaacaccaacagtcagtgttttggttgtacaacaagaaaacctgaacaagagttcttttactggactggttccttggatgcattgtctctgaagtcaggaagtaccttgccagtaagtacttctattaaagttcttttgattggacaatgcccatggccacccagaaccccatgagttcaacactgaaggcactgaagtggtctacctgccgcaaaacacagcatctctaatcagcctctagatttggggtgggggtgggagggaagaggaggggcataaagatctttaatgctcattacacatggtactctatggaaagaattgccaacgttgtagaagagaaccccaatagagagaacttttggttttggttttgttctgacttgtttccatacacttgtacgtgtacttgagtttgttggacactggtccaaaccccaaacattccctgacagggcttataaggttcttattttgctcttgggagattaatgagaagcagaatgggatcctaaaatgctaaagcatgcaatcatagtccctctcctgggacctctgccagctagctacatgttcaaaaattatctttggccaggtgtggtggctcacacctgtagtcctagcactttgggaggatgaattgggaggatcgcctgagcccaggagctcaagaccagcctgagcaacacagtgagacctcgtctctattttttccctattataaaaaattttttaattaaaaaaaaattatggtcttctcttgcgaacaattttaaatcaatggatagagaacatcaaaactaatttggatggccatcctggagatcttttgggtccgcaaacttgtcttagaacaaaattagggctaggtgcaatggctcatgcctgtaatcccagcactttgggaggtcgtggagggaggatcacttgaggtcaggagttcaagatcagcctagccaacatggtgaaaccccatcactactaaaaatacaaaaaaaaaaaaaaaaaaaaaaaatcagccaggcgtggtggcagttgcccataatcccagctactagggaggctaaggcaggagaatcgcttgaacctgggaggcagaagttgcagtgagctgagatcgcgccactgcactctaacctgggtgacagagtgagactccatctcaaaataaaaagaaaacaaaaaacaaatagaagacagcagccctataattaaaaatctgagtgggaggcatactttaattggtaccttgaagcttctaagcacactcaggatcctaaaattgcctctctacaagacacgatctcaaaattaattaagataaacagttaagaaaaaacaagggccaggtggctgacgcctgtaaagccagcactttcggaggctgaggtgggagaatcacttgaggccaggagttcaagaccagcctaggtaacatagtgagacctcatctctacaaaaaataaaaaattggccaggcatggtggcacacacctgtagacccagctactcagaggctgagtctggagtattgtttgagcccaagaggtggaggctgcagtgagccatgattgcatcactgcactccagcctaggtgacagaacgagaccctgtctcaaaaaaaaaaaaaaaaaaaaaaaaaaaaggccaggcatagttgctcatacctttaatcctagcactttgggaggcagaggtgggtggatcacttgagcccaggagttcgagaccagcataggcaacacggcaaaaccctgtctctacaactccaaaaaattagccgggtgtggtgggatgtgcctgtagtctcagctacctgggaggctgaagcggcagaatcgcttgagcctaggaggtggaagttgcagtgagcatttactgtgccactgcactctagcctgggtgacagaaagagaccctgtctcaaaaaaaaaaaaaaaaaaaaaaaaaaaactggaaaaaaatttaaaaaagagcaaggccttaaggacccaaactccttcctctctggaacagatgagacttccccttccttctttcttctctattctcctctctttctctggcccgccaaaatctgtccctttaaagttaaaggaggctgtatgaaggaaaaaaataaaaataaaacaatttggttaaactagcctgagtgtggtggctcatgtctgtaattccagcactttgcaaggccaagaagggaggatcgattgaagtcgggcattcgagaccagctggggcaacatagtaagaccttgtctcttcaaaaaaaagaaaaaattttttttaattagccaggcatggtggcgcacacctggagtccagctactcaggaggccaaggctggaggatggcttgaagtcaggagttcatggccagcctgggcaacaaactgagatcctgtctcagaacaaccaaacaaacaaaaacaaatcaattcgccgggcatggtgcatgcctgtagtcccagctacttgagagggtaaggtgggaggatcactttagcccaagagttggaggctgaagtgagccatgattgtaccagtacactcaagcctggatgacagagcaagaccctgtctcttaaaaaaaaaaaaaaaaaagaaaagaaaagaaaaaaagaaaaaggaaagaagaaagaaagaaatgaaaattaaacttattgacaattcctctagaccccaaatttcttttgttctttggagcaaggctgaacttcgtgccattgccagggaacttccagaggttactggggaccctcaccaatttgctgattaattggacatagtaacttagggttatcagccaggtttttctgacccacagtaggtggttcacattcttgtcagtgaaggtcaggcacaacactggatggtcaaggctcactgccatgatcctgagggggatttagacaaaaacacccctaaagactatggatagagtcaaaggcatagaaggaaaaaaaaacactccacaagtctgttctcgaggctcttcctaaagccttagactggaaaaacctccaggcctgtgcccaagaaagaacctaatgtacaactattacagtaggctccaggctgtatttaaagaaaatgttgaatctactcaagtagccttttattccatgttagtgaacagcctttctcaagaactctcccagctggtcaaaagggcccgaacagaatgggaaactgtgcctacctctgatctagttaatttggcaaatcagcttgccagcacccttgaggacaatactaaaaagaaaaccactaaaatccttaatctccagttacggcagatggagactcccggacataacaccatgaggagacctcctgggctatgccacttctgtaagaagccaggactcgaaaagagtgctgaaaaagatggaatctctcatcaactttaatgaatctccagggaattaggctgagtttaaaaaaaaaagtctcaaaagtccagaaagtagactcagaaagtgataccccaaagactggcactttaacatgccaagaggccttagaagctgcctcagaatcaaggtccctctaaccttgtcttccctccaacaagggaaaaagaaaagataaatgtaccatgttcctagattacaaaaagtcttcttagtttctgaaaacaaaatttgttttgcatggaggcactaaaagaaagactaagatatattaaagatattttaagctttatcttttctactaaacctcctcctcctatgatattaaccaggaagtaaaatctgctgattgccagcagcatttctaatcacattcgattaaagacacccattttcctgatgcaaagtggcttaatgcaataaagcacaactttaaaaaattaggagttcaatggttattaacacaggaatgatttcttctcttcacataaattaaaggaaatgattcaaaccgaagatggatgaccactatttagtcaaacactaattaaactcagacatttttctagaccatggctaccctctttggattctctaccgcaatagacacacaacataacagattttttaaggaagacaaaatggaaatcagggctctgtcctcaaggagctgacattcctgttaaggattaaacatttatttgcatgaaatgatgtaggactactgtgtagcttttaaatgagtacagattaaaatataataaacactgttagacaaaaggaataatcatgacatatttttccacggagagagagctgagatttttatggaaataaaggagtagagaaaaaagaaagatttgtttgccagttggggagtagggaagaaaattgtattagaagtcagaattaagaatactgtctaggcatggtggctcgtgcctgtaatcccagtactttgggaggccgaggtgggaggatcgcttgagcctggaagttcaagaccagtctgggcaatatagtaagaccttgtctctatttaaaaaaaaaaaatttttaaagttagccaagcctggtagcactcactggcaggagaattgcttgagcccaggagccggaggttgcggtgaaccaagatcagcatcactgcactacagcctgggtgacagagtgagactgtctcaaaaaaacaaaacaaaaaaagtattgctttgtgctttgacaatgcactctactatataaaagtcatatctaaaagaaaacaaaaagaacccttagcaatcacacttggctaaaaggaaaagagagaaagagaaaaaaaaaaagaaccaacgaactaccaaaaatactttcaaaaagtattcaaaccgactttctgaatatatctatgttgtttgttttattgctcagagttttcagaatcaccgaattctacaggaagaactttgaatccagtgccctactctgcagccaatgtttgagttcttgttataatgtcctggcaaatagttattctacctatgagggtagacctgcactgtccaatatggtatgtggccacaagtcattatttaaaacgtaaactaagtaatataagaaattcactaccttaatcacctagccacatttcaagcactcagtagccacatgcagttagtggtcaccataatgggccaaatagaaatacagattttggtcacggcactaagtttgtttagtgctgcagctattcaaaccttaaagactgtcacaaaaatacacaaggtggcaagtcagaacaactggacctaagctccagttttgtgattttagacaagtcaacttaaccctaaatttcaactgtaaaatttaaataatactatcttatcccctaaggggttgttagaaaattcaagtgagctgataaaatattctgacaactacaaagtactataggatgtataaggtattaaaattatgatacaacactgaacttattacaacccacaaggggctcacagactactggggagacaaatatgatgcaaataattaaaatatatcatgtgaaaaaaaaattaccaacatatgaacaaaaaatggtttaacttggtatatacttttagtataattagtaaaccagaagccaaactagtcaaattaagattttcaaattttatttttgcaaaattgtcataaaaaagtttactgaaatgaagttttgcacaatatctgtttgtgaaacttaatgtatttacctccactaacaagtgaattttatttcacactgttacctaaaaatatttttaaaatacaccaagaagaggacttttaaaaaatgaatttgaaatgctaaaaagtcataaaaggtgaaaagaatgtttttgtttttgttttgagacagggtcttgctttgtcacccaggctggagtgcagtggcgtcatcaaggttcactgcagccttgatgtactgagcctagggctcaggcaatcctcccatctcagcctcctgcgtagctgcgactacaggtgcacatcactacgtctggctaatttttggatttttttgtcaagatggggtttcaccacattgcccaggttagtctcaaactcctgggctcatgcgatctgcctgcttctgcctcccaaaatgctgggattcaggcctgagccaggtcaagaatgttatttttttaaaaaatagctgctaggccatttaaaaaaattgctcctttcttgaggagcaattggcagtgtgtaccaaagaaacaaacaaataaatgttcatgccttttgatctggttaattccactacaagaaacatatgccgaggaaattatcatagatccacccaaaggcttctgtacgataatcaccattattaccgataaaaacgaaatatctaatgtttagatcattaaacatgatttaaaaattaaacaggaaattgagtaattatggtacattcatataaatatgataaagctattaaaaaatcacattttcaaacaatcgtttaaaacatagtaacttaattttctcagtcaataaatattatgtggcatcattctagattctgaggacatagcaatgaccaaaacaaagtttcttcctttgtggagcattacaaagtagtcaagggataaagtgtttgataaaacattatataaaaaaagcaacaatcaaaactattagtctggagctagacatcagcaaaatggtggaacaggctgctacaatttttctttccccatgtaaacacagacaaacaagccaaaactgccaaaataacaacaagaaacaaaaacacaaatattgtatgattccattatataaaatatctagaacaggcaaatccatagaaacagaaagtagattagaggcaaccaggagctaaaggaagagatgactgaggaatttaatggttacaaagttcctgtttggggcgatgaaaaagtttgggaaatagtcagtggtgatgattgcacaactttgtatatgtaactaatgccactgagttatataattaaaaatagctaaaatggcaaattttatgttatatatgtttaaccacaataatttaaaagaaaagtaaatcactacaataccttcccccctaaaaaattaaggagcattatgaacaactctgtctccacagactttataatttggatgaaatggaccaactccttgaaacacatgatccaaaaactcaaaaaacgagagaggtcatctgaatagggctatatctataaaaaaatttgaatcaataattaataaccttccaaaatagaaagccccagacccagatggcttcactggtgaattttaccaaacacttaaggaaaaaaaaaatgataccacttctctacaatctctttcagaaaatggaagcagagagaacatttcctaattcattctatgaggccaaaactaccctaataccaaaacaaggcaaagacattacaagaaaggaaacttataaaccactatctctcatgaacacagatgcgaaaaccctcagtaaaatattatcaaatcaaatccaacaatatataaaaagaattatttaccacaaccaactgggattcatcccaggtatacaagcctggtttaacaaccaaaaatcaattcataaaatccttcacatcaacaagctaaagaagaaaaattgtatgacgataccaatagatgcagaaaaagcatttgacaatccaacattaatttatgataaaaatgttcagcaaactaggaatacaggagaacttcctcagtttgatagagcatccacaaaaacagtttcacctaatatcatacttagtgatgagaaactacatgctttcctcctaaaaccaggaacaagacaagtgtggactcctcctcccatcaccattcttattcaaaattgtacctgaagtcctagctgatgcagtaagacaaaaaaaggaaataaaaggtaaacagattgagaaggatgaaataaaactatcttggtttgaatagaagaaaaaaaaaactgtctttgttcaccgatgacatgactgtctatgtagaaaatcccaaagaatcaacaacaacaacaaaatctgaaacaaataagcaaatatagtaagactgcaggatacaaagttaacatacaaggccagcacagtggctcacacctgtaatcccagcacttctggaggcccagactggtggatcacctgaggacaagagttcgagaccagcctggccaacacggtgaaactccacctctaccaaaaatacaaaaattagccaggtgtggcggcgcacacttgtagtcccagctactcagtggactgaggcacaatagcaccactgtactccagcctgtgcaacggtaagactctctcaaaaaacaaacaaataaaaacaaagttaacatacaaaagtcaaaagtcaagtgctctcctatataacaacaatgaacaattggaatttgaaactaaaatacacaatacaatttaggttagcaccccctgctaaaaaagaaaaataagaaatgcgtaggcataactctaacaaaatatgtatgaatatgtatgaaatctttgtgaagaaaactacagaaagccaatggaaacaatcaaagaagatccaaatgaaattccatgttcacagacaggaaggctcaatattgttaagatgtcagttcttcccaacttcatctacagattcaatgcaaactcaactaaaatttcagcaagttattttggggatatagacaaactgactctaaagttacatggctgggcatggtggcttatgcctgtaatcccatcactttaggaggccaaggtgggaggactgctcgagcccaggagttcaagaccagcccgggcaattaaaaaaaaaaaaaaaaaaaagctgggcatagcggcatgcacctgtggacccagctactcaggaagctgaggtgagaggatcacttgaactcaggaggtggaggctatagtgagtcgtgttcacgccactgcactccagcctggatgacagagcaagactccgtctccaaaaaaaaagaaagaaaatctaggtgaccttggatttgatggtaactttttggatacaacaccaaaagtaacaatccataggtgagaaaaagactgatcagttgtactaattaaaaacttctggccaggtgtggtggctcatgcctgtaatcccagcactttgggaggctgaggcgagtggatcacctgaggtcgggagttcgagaccagcctggccaacatggagaaaccccatctttctactaaaaatacaaaattagctgggcgtggtggtgcatgcctgtaatcccagctacttgggaggccaaggcaggagaattgcctgaacccgggaggcggaggctacggtaagccaagattgcatcattgcacttcagcctgggcaacaaaagcgaaactcggtctcaaaaaaacttctgctctgctctgggagacactgttaaaagaataaaaagataactattgactgagaaaaaatatttgtaagacacatatctgataaggaactggtatccaaaatatacaaagaactcttaaaattcaacaataaggaaacaaacaacccaattaaaaactgggtaaaaaaatctgaagatacccaaccaaagaaaacatacagatggtaaacaagtatataaaatgatgctcaacatcacatgtcattagggaataacaaattaaaacagcaataagataccactgcacacctaatggaatggctaaaatccaaaacactgacaacaccaagccgggaaagatgtgaagcaacaggaattctcattgattgctggtgggaattcaaatggtgcagccactttggaagacagtttgtcagtgtctcacacagctaaacataggcttatcacagtcatgctcctaagtatttacctgagttgaaaaattgtgtccatataaaaacctgcacataaacgtatatagcagctttattcataattgccccaaactggaagcaatcaagatgtctttcaaaaggtgaatggcaccagacaatggaatattattcagtgctacaaagaaaagagccatcaagtcatgaagagacatagaggaaacttaaatgaatattactaaaggaaagaagcaaactgaaaaggttacatattatgtgattccaagaaatgacattctggaaaaggcccaactacagacacagcaaaaagatcagtggttgccagtggggaggaaggagaagatgggaatgaataggtgaagcacagagcaagaacaactgcagggcagtgaaactattctgtacaatactgtagtggtagacacaggacattatgcgtttgtcaaaacccacagaactgtataaaacaaagaatgaatcctagtgtaatctatgtacattagttaataaaaaatctatcaatattgatttgccaactataacaaatgtaccacactgacccaaggtgtttttaggggaaacaggccaggtatggtgattcacacctgtaatcccactgctttgggaggccaatgcaggagaatcccttcagaccaggagttcaatatagtgagacccagtctctacaaaaaaaggtgtagtgtgtgcctgtacacccagctacttgggaggctgagggaaggaagatctcttcaggccacgagttcaaggctgcagtgagctgactgtacaactacactccagcctgggcaacagagcaagacccggtctctaaaaataataataagtaaataaaacaagcctattaaaaatgtatggagaactatttaggggagagggagtatacaggaatttcctgtaccttccatataatttttctgtaaacctaaactgctctaaaatataaagtctactccaatttcatatatatatatatatatatatatatacacacacatacacacacacacacacacacacacacacacacacacatatatataaactaaatccacattctttcttttaaggtcaaatttagcaactgctcaccatgggtgacctttccatatttagacagtagaaaaaaatatttctgtgctcagcttacttccaggtgccaggcttccaggggccgaaaatacagtggtgaataagacagaaaggcccctgctcccacagagcctacattttaaaggagagaggtaagaaatcatatatatcaacatacaatttcagactgacactaaaagtattatttaaaaaaaaaaaaggaaaaataggggaatgtgataaagaaggacttggggaaagaggctgctttgggacaggtggtggggaaggcccaagtgaagtgttacagctgagacctatgttgacaagaaagcctgtcaccagatgatctggggggagtgctctcctgctcatggaacagccagtacaaagctcctaaggcaagaaaagttgaatgccttcaaagaacaaaaagacggtgactgcagcagttctgagcctacacctcagaagggtttgcgagtatctagaggatctctcagcctctacctttgccttgagaagaacacaaccaggttcgctggctggtccctggaggatgagagacccgtggagcagagccaaccaagtccaaccccaatcagttaaccaatgacctgcacatccagagagcaagtaattgccactgtaaatcaaggactggaaatctttctccgtaaaagacgaaatagtaacatcttagactttgcaggccatatagtttctgtctcagctatttaattctgccactgtaatgtgaaaatagccacggacagcatgtaaataaatggacatggctgtgttccaatgaaactcaaattacagaaactgacatttaaatttcacataattttttctttttttttttttcttttttactctatctctgtggattagtctgttctcgcattgctataaagaactacctaagactgagtaatttataaataaaagaggtttaactgactcacagttctgcaggatgtacaggaagcgtttctgggagacctcagaaaacttacaatcatggcagaaggcgaaggtgaaattggcacatcctcttacgtggccggagaaggaggaagagagcaaaggaggagggtgctacacacttttttttttttttttttgagatggagtctcactgtgtcacccaggctggagtgcagtggtgagatctcagctcactgcaacctctgcctcccgggttcaagtgattctcttgcctcagcttcccaaggagctgggattacaggtgcctgccaccacacccaactaatttttgtatttttagtagagatggggtttcaccatgttggccaggctggcctcgaactcccgacctcaggtgatctaactgcctcggcctcccaaagtgctgggattacaggctgagccgctgcgtccggccggtgctacacacttttaaacaaccagatctcaggcagggcgtggtggctcacacctgtaatcccagcactttgggaggccgaggtgggcagatcacttgaggccaggagttcgagaccagcctggccaacatgatgaaaccccatctctactaaaaaaaatgctgggcgtggtggcatgtgcctgtaattctagctacttgggaggctgaggcagaagaactatttgaacccagaaggcagagagaggttgcagtgatctgacattacaccattgccctctggcctgggcgacagagtgagaccctgtctcaaaacaaaattaaattaaaataaacaaccagatctgagaactcactcactaacacgagaagagcaagggggaagtcccccactatgatccaatcacttcccaccatgcctcttctccaacacggaggatgacaattcaacatgagatttggtcagggacacaaatccaaaccatatcaccttgccaaagcaaggcctcaaaaaattagcaaaaacctcaaagttgggctgggcacagtggctcatacatgtaatcccagcactttcggaagctgaggtgggaggactgcttgagtccacgagttcaagaccagcttgggcaacatggtgagaacccccccatctctacaaaaaaatgtaaaaatcagctgggcttggtggcacacacctgtggtctcagctactaaggaggctgaggcaggaggatcttgagaccaggaggctgaggctgcagtgagctgtgttcatgccactgaactccaacctgggtgacagagtaagaccctgtctcaaaaataaaacaaaaagtcagagttgttcctctccatgaaaatatttatttatttttgattgtagagatggggtcttactatgttgctcaggcaggagcacagtagcacaatcttggcttactgcagtgtcaacctcccagacttaagcaatcctcccacctcagcctctgagtagctgggactacaaacatgtgccaccatgcccagctaagtgttttttgtgtgtgttttttttttttttggtttcttttttggtagagatggggtttcactatgttgcccaggctggtcttgaactcctggactcaagtgatcctcccgcctcagcctcccaaattgctgggattacaggcatgagccaccacacccagccccatggaaatcttagtaaaaggcaaaagatttatgcaatccgaagggaaactagagtatgaatttcatataattttcatgttgttgtgaaacattaatttttaaaaaccacttgaaaacgtaaaagccattattaaattacagcccacacaaaaaacaggtggagtttgctgctccattttaagccagcaaatttggggatagtttgttacaagacatttttgtagaaatagttacatgatacacactggtaacctgatacaggctcttcagagaagtgggtagggtgctacatttagggacatatataaaacattgaaaggagtccagattttctattatgtgcaatgaacatgatataatctgattcacatttttaaaaatgtactctggttgcagtctggagaatggattataatggagcaagagtgttaagagatgacagtggcttatatttgtatttgcgtgatagagatacaatatatttcttttttctaacgtatgtttcttgttaaatactaggaacagcagttctcaaactttttggtctcaggacccccttaacctctaaaaattattgaggactggctgggtatggtagctaacacctgtaaactcagcactttgggaggccaaggcaggaggatcacttgagctcaagagttcaggccgggcatggtggctcacgcctgtaatcccagcactttgggaggttgagacgggcagatcacaaggtcaggagtttgagaccagcctggccaatatggtgaaaccccgtctctactaaaaacacaaaaattagccaggtgtggtggcatgcacctgtagtcccagctacttgggaggctgaggcagaagaatcgcttgaacccgggaggcggaggttgcagtgagccgagatcgcaccactgcactccagtctgggcaacagagcgagactccatctcaaaaaaaaaaaaagagttcaagaccagctgggcaacatgatgaaacaccatctctacaaaaactacaaaaattagccaggtatggtggcatgagcctgtagtcccagctaccggtgaggctcgggcaggagaatcacttgaacacaggaggcagaggctgcagtgagctgacattgagccattgcactccagcctgggcaacgagactaaaaccctgtcttgaaaaaaaaaaattattgagaactccaaacagctttgaaaaatgtatgtggattatgtttattcatatctactgtattaaaattaaaactgaggaaaaatttaggtgctcatttaggctggacgcagtggctcacgtctgttaattcccgcactttggaagccgaggcaggcagatcacttgaggtcagaggttcgagaccagcctggccaacatggtgaaaccctgtctctactgaaaatacaaaaattagccgggtgtggtggcaggtgcctgtaatcccagctactcgtgaggctgagccaggagaattgcttgaacctgggaggcggaggttctagtgagccgggaccatgtcactgcactccagcctgggcaacagagcaagactccatctcataaataaataaatactcatttaaaaataaataaagccattacagattaacatatttctcataaataataactatattttcaaaaataaaaaaagtgagaaacggtactttgtaatttttaaaaatctctttaatgtctatttaatagaagacaatatctgttctacatcagtctgttgcaatgtcacatgtcctgtaggcctcgagaaaactccactgtgctctcatgagagaatgtgagtaaaaggcaaataatgtcctaatattattacgaaactaggtttgaacttaaggataactgaaaaatatcttggggtcccaggagtccccaaactatactttgaaaactgctggcagcatcatagcttacttatttttattttttattgagacagggtctcatttcattgaccaggctggaatgcagtggcatgatctcaggctcactgcaacttttgcctcccaggctcaagcagtcctcccacctcagcctcccaagtagttgtgactacaggggcatgccactatgctggctaattttggattttgtagagatggggtttcaccatgttgcctaggctggtctcccaccttggcctcccaaagtgctgggattacaggcatgagccaccatgcccggcccataacagctcactgttaaatgctagactgtaagtgattttgaagaattctgatgtaccttctatattataaagaaataaagagacttgtccaaagccaaacaataaggcagcaataaacaatgttagctgggcatggtggtgtacacccatagtcccagctactcagggggctgatgtcagagcattgcttatgcccaggaatttgaggctgcagtctgctatgatcatgtctgtgaatagccattgcactccagcctggacaacatagcaagaccctgttccaaaaaaaaaaaaaaagcctctctctaaaaacaaagacactttactttcaggtctttgtacaattataaaaatcaatattcagtgctcactgattctgctcccaaataggcaaagcaatcctgaaagactgcaaaaagaactaagcttgaggcatcacactacctgacttcaaaatataccacagagctatagaaactaaaacggcatggtgctggtataaaacagtcacaaagatcaatggaagagaatagagaattcagaaataaatccacagatttacagccaactaatttctgacaaaagtgccaagaacatacgatggggaaaggacagtctctttaatacatggtgctgggaaaaaggatttccatatgcagaagaatgaaactggacccctacctctcaccacatacaaaactcaatcaaaatggattaaagacttaaatctaagacctgaaacttgaaactactagaagaaaataactggggaaattcaggaaaatcatctgggcagagacttacggagtaagacctaaagagaatacacagccaaagataaatggacaaatgggattacatcaatctaaaaagcttctgcacagcaaaggaaacaatcaacaaaatgaagagactacctacagaatgagaaaaattatttgtaaactattcatttgacaagggtttaataatcagaatatataaggaactcaaacaactcaatggcataaaaaaacccaaataatctgattttaatattggcaaaatatcagaatagacatttctcaaaagaagacacatgtaagtggccataggtatatttaaaaatgctcaacattacaagttatcagggaaatgtaattaaaaccacagtgagacatctcaccttagtcaaagtggctattatcaaaaagacagaaaataagaaatgctagcaaggacttggcaaaaaggcaatgcttgtactctgttagtgggaatgtaaattagtatagccactatggaaaacactttgaagattcctcaaaaaactaaaaatagaacgactatatgatctagcaatcccactactgggtataaacccaaaagaaaggaaatccgtataatgaagagctatctacactcccatgtttatttcagcactattcacaatggccaagatttggaggcaagctaagtgtccatcaatggatgaatggataaagaaaatggtttatacacacaatgggatattattcagccataaataagaataaaatcctgtaatttgcagcgcatggatggaaccagaggacatgatgtgaagtaaaataagccaggcacagaaaaacaaattgcattcacatttctcactcatatgtgggagctaaaaaactgatctcatggaggtagagaatagaatggtggttgccagaggatggaaagggtagtgggggcagtggggatgaagagtgattggctaataggtacaaaaatagttagatagtcctggtgttcgacagcacaagagggcaactgtaattaacaataatttattgtatatttcaaaatagctaaaagtgaagatctagaatgttcccaacacaaagaaatgatacatggttgagatgatggatatccccattacccagattttatcattccacttttttttttttttttttttttgagacagggtctcactctgtcacccagggtggagcagtggcacaatcatggctcaatgtagcctcaatctcctgggctccagtgatcctcctacctcagcctccagagtagctgggactacaggcacgtgctaccacacctagctaagttttgtatttttttgtagagatggggttttgtcatgttgcccaggctggtcttgaacacctgagttcaagcaacccacccacctaagcctctcaaagtgctgggattcaggtgtgagccattgcacccagcctgatcattacagattgtatgcatgtataaaaatatcacatgtactccataaatgtgcataactattatatagccataataattaaaaattaaagtaattaattttttaaatagctagccaaggtgacacatgcctacaatcccagctatggggaggctgaggtgggaggatcacttgagcccaggagttcaagaccagtctggggaacatagcgagatcctgtctcaaaaaataaaaatatcaaaaaagcttgtggattctgaagcattatacttgatgtgggattttcaccccgtctcctgttgcccgttttcccccacctgcaattcatcttccacattacctccagagcaactgttctaagcacagattttatttcatcactctcttccttaaaatcctttgatggtccccattttcttcaggatgaattcacattccttagtaccacccagcaggcaagtcctaaactggcccctgcctgcctcttcggcttcattcccctgtcactccaaagatgctgcagccctttagaactacttttgttcttagaagttaataatgtctcatatccatacctttacaccaatggcatcttttccttaagaaacaaaacaaacaaaaacactccccttcctttactcagccatctccttccagaccaagctcaggtatcacaccatctgagaaagtgtgcttggcactgcattcatcacaacacatttcaagtttgcctacttgcctgtccacctccctgcctggactatgagttcctccagagcagaaagcaacttaaatatatttgtgtcttttttttttttttttttggagacagagtcttactctgttgcccaggctggagtccagtagcacgatctcggctcaccacaacctccatctcccagattcaagtgattctcctgcctcagcctcccaagtagctgggattacgggcacctgacaccacacccgactaatttttgtatttttagtagagatgaggtttcaccatgttgccaggctggtctcaaactcctgacttcaggtgatccacccacctcagactcccaaagtgttgggattataggcctgagccaccgtgcccagccctttgtgtctttagtcaacagtagacaacctggctaatatagtttgcctgtgtccccacccaaatctcattttgaattgtagctcccataatccccatgtgtcatgggagggacctgatgggaggtaaccgaatcatgggagtaggcttttcccatgctgttcctgtgatagtgagtaagtctcacaagatctgatggttttataaagggcagttcctctgcacatgctctcttgcctgctgccatgtaagatgtgcctttgctcctctttcccctttcaccatgattgtaaggcatccccagccatgtggaactgcaagtacattaaaactctttttccttttttttttttgagacagagtctcgctcttgtcgcccaggctggagtgcaatgacacgatcttggcttactgcaacctccacctcccaggttcaagcaattctcctgcctcagcctcccaagtatctgggattacaggtgcccgccaccacacttggcaaatttttgtatttttggtagagacagggtttcaccatgttcgccaggctcgtcttgaactcctgacctgaggtgatccacctgccccggcctcccaaagtgctgggattacaggcatgagccaccatgtctggcctaaacctctttttctttataaactacccagtctcgcgtatgtcttcacagcagtatgaaaatggactaatacactggcccaaagtgaacacctccataagcctgtcacatgaacaacttctgaaaatttgctttagaagctttatctaattgggaattaatgagagacagaaatgaagtgagaaaatgaagggggggaaaaaggtttatcaaaggaaaaagaaaaactagaatcctaaaaaaatgaagcaattttgagaagtaatcttaaagtgggcaatatggtttttagtctgatcatagaatgagtttcactccctgaatgagtgtgacctgacctggtctttctgaaagatcactttttcctgtgtaatttagtatgcatacgaatcacacataggctgactaatcaactgctgaagattctgcatctgtatcgcaagatgagaacaatctaaagaacagcagaaattttaaaaagatatatcatgaatatatataatctattatagttacacctgttatattttagaaggaactataggaagcctacatatattagtatacagtacaagctatattaaataaaggacttgctccctctgatttcatagcaatcataacacagcacaccaaggtcaagaaatcactgtgagttctcctgttctgtatttaaggaaagattaagaggcataagctcacagggtggtctcctgtcctttcttcatgagcactctggccacatggaaaacaatcctgagatgggacagttggcacttaattagctgaacgcctaggaccagcctctacgcaagatgtcttacatacattaggcacctcacttaaactactcttcctaagttcagtcacaatcagcaacaaaaataaattttgatgcttataagtattcattcaacaaatattcacttaagaactacaagtagggtctgcgagagcaaatgaacttgtctatctcgcttacttttgtatcccaagatgttggtggagtgcctagcacataatggaacataaggactggaggattttgcctcttaagcctcttgaatctgtccatttctcttcctatgtccttccactgacctagtcccaggccagtcctgtagactaactgccctgcagccattcttgccccttctaattccggatttctcaacttcagcactatcgacattttgggctggatgattctttgttgtaggggctgtcctgtgcactataggatgtttggcaggatccctggcttctacccactaaatgccagtagcatcaaccccatgccatgccccagctgtatcaaccaaaaatgtttctagacatttggcaaaatcacacctagctaagaaccactgtcctagagctgacttgacctcctctgtcctcagcctcagcaattcttaccctctacggttgaactcaaacagcatcaagcaagaaagcatctcccagctgggcacagtggctcacacctgtaatcccagcactttgggaggccgaggtgggtggatcacctgaggtcaggagttcaagaccagcctggccaaccagtgaaaccccatctctattaaaaatttaaaaagttgctgggcgtggcagtgcaagcctgtaatcccagctactcaggaggccgaggcaggagaatcacttgaacccaggaggtggaggttgcagtgagccaagatagtggccactgcactccagactgggcggcagagtgagactccgtctcaaaaaaaaaaaaaaaaaaaaaagcaagcatctcctgatcccctgccaccagaccaaactgattctcactgctggtctcttccacaacgatgctctatttctttacagcatttctcacaatagtaatgaagtggcagttaatgtctgactgcaccaccagaatataagctccttgtcagcaggagccaagtctgctttgttcactgctggatccccaggggcctggtacagtgctcaaaaattaagtagtcactgaatgaatgaggcaggcactctgccagggcacagggatttgaagataaggaagattccatctttgtgaccaggatgctgagcacagaaatagcaaataagtttcatctcccaggcaagctcaattaactggtaaccaaattgagaagctgtgcatgtaaaaataagtttcttctgaggcagcaaaatacaagataccacattccaaagtgaagtgttgggccaagatgcaaagtttcttaaggaacagttgcagactcatccaaatcatggtagaaaggtccaggaggtggcgatcagaggaggttttcagaggtagctggcattctgtgacgcctgctccacctcattcaagggggagcagtggaagtctgtttcccacttccttacgcccaagaaaagggctcaacaaaattaccaagagaactcactatgggtccatgaagttgggtgggtaccatgtctgtgtaacacctgaaaaatataaagtgctggctggctaattgctctgaggacaagagagaagttgtcactccgctggaatcagcccaccctcccctagtctgagcaaaggacgtgggccacatacaacaaagaaccagcagaaggtcaccctgggcctactcactgggcaaaagaggctgaaatgagaagctcccattattatcagattcttaggatctatggaaggaataagcaaccaaacggaatgaagaggcatttggtctcatcaggggaaaagcaggtgaccactcctgagcacggcggtggctgtggtctctgaaggatgccccttgaaaacactcaagaaagaataagctctggccgggcgcggtggctcacgcctgtaatcccagcactttgggaggccgaggcgggcggatcacgaggtcaggagatcaagaccatcctggctaacacggtgaaaccccgtctctactaaaaatacaaaaaattagccgggtgaggtggcgggagcctgtagtcccagctactcgggaggctgaggcaggagaatggcgtgaaccccggggggcggagcctgcagtgagccgagatcgcgccactgcactccaacctgggcgacagcgagactccgtctcaaaaaaaagaaagaaagaaagaaagaataagctctaacacctgcacaacatcccagagagctcctgcactcattcaggaagaagtttcctgtcctcatttccttcctttctttcatgtgctccaacacaggagggatcagaaacaggttacagagcagaaagagaatcatcaagtgatgaaaagtgagaagatgcccactgtggccaccctcccttcctccactgcaggctttctccctgcagcaggcctgtactgggagaaggaacttaggctttaagttctgttatgctttaggactgaagactctaattgctgaattcacattctgttctgtagtgtgaagtgaccacagaaatatcaggcccacctgaattttcatccaggggcaggggtgcaagacaatacaaagagccagtggaagataaagaataaagggattggctacacatcccacaaggtgtgcttattcaacatgacaattacagccagctgcctacccagcatcacttatctattcttcttccataaaggaacctacccctacataacaaatatttgggagaccagtcccgagattcagaggtaggtcagattggtctaaaagtaacccctttctcctttcaagagatttgcttaagaatggctctataagcataactgggaccaatgccaggaaaggactgctgaggtcctgggtcaagttcttcctccatcttctgacagtcctctcaaaagttggaggaacaccaaactgttagagaaattattctgaaactatatctgggcttaggaacggaaaagtgccatgatgaacaaggccgagtcttaggaaggcagggtgccaggtatgcggtgtaggcagctggtaggaagtgtggatctagagcttgttggagaggcagcaggcatggttaaggccaggcgcagtggcttatgtctgtaatcccagcactttgggaggccaagacaggcaaattgcttgaggtcaggagtttgagaccagcctggctaacatggtgtaaccccgtctctactaaaaatacaaaaattagccaggtgttgtggtgggtgcctgtaatcccagctactcgggaggctgacacaagagaatcgcttgaacccaggaggtgcaggttgcagtgagctgagattgcgccactgcactccagcctgggagacagaacgagactccgtctcaaaaaaaaaaaaaaaaaaaaagtcaggttaagtttttctctcacaatgtgataacattcattaacaaaatgaacaatatttagatctcaagagaaagaccaaatgcaattatcaaatcaccatataagttaaaggtatatatttgatcatcactgaaagatttataacggcacacttgagctgtgtttaacaaagctccatattaatatatccatgcaagaaaacaagtttcccagatagattaattaaccagatattaaaaatagaaacaatctactttacaacttctagagcaaggtaaagggctaacagctatcacagacacaatgtcaccagtaaagccagggagaggaaatgggttttgactgaagccagtgtcttcaagacatctgttgttccggcccttctttgggtaacagccttgtgattatcttctgaagctctcctctcagttcacgtggttcagttgagactgacagccccacccactcccctatttctggagacgatcccagtggttaacaagggtataacaagggcactcattcctctggctaggcaggcagccctgggtctagttggcactaatgagaaagaaaagctatctttctgctgcagttactgaactggtagaacagaaggtggggttgccagcagcaatccttgttctcatatgaggagagcttgctgagaagtaaactaaagaggggaaggcagaggtgagaaacagggacaaaaagagattcctgatgacatcatttgagcacctcgatccactcctgccagaaatttcaccatatatatatatatatatatatatatattttcttttttttttttttttttttggttaacctttttgttttgttttgtttgagacagagcctcactctgtcgcccaagctggagtgcagtggcacaatcttggctcactgcaacatctgcctccagggttcaagcgattctcctgcctcagcctaccaagtagctgggactacaggcatgcaccaccacgcccagttaatttttgtattttttgtagagacagggtttcaccatgttggccaggctgctttcgaactcgccttggcctcccaaagtgctgggattacacacatgagccaccacacctggcctcatcctatatttttcaattatcccagttaacaaactggttaataataaactagttaataagctaggtctgagttgggagtctgtcacttgcaacctagtgctgttaactaattctagctgcaatgttaaaccactagtaattcaaaaagaaaaagcgatcacaaacttctctgacattaccaactttatgctaaaattactcccaccacttcctaaaataatctttccttgtctctcttctgtttaaactcctacttgtccatgaagcctccctaaagctcatgcctccttgaaaaggtgtcagaactgcctcgaggatgtttcaacccacaacattcttctgtcttctgactttctaagcaattgttgtgtactaactcaggcattcaattgcttattcccctgtgttgttattcagtcctcatacatacatcttggcctcatctcaactaaacaatagccaaaggcatgagctataattatttgtatctctgacagcattttccactgtatattctgacgacagcatcttccactgtacagtctaacaacaggtctcagatttttagagaaagttaccagagcaggaatgactctcagagcatgaaaatgttcaagttatatcagatcaatcacatttgagaaataaaagggaactataaacgctacatcagagcaaaaaatttacctttacttgaaataaatttgaaaggatgtcagttaagatcaacccaattaatcaatccattcattcatgcatccatcaagtatttattcagcatctactgggtaccaatcactttctagtggctaagaatacagcagagaataagacaaggtccctactttgatagttagctggactatgtacctctcacaaaccccccaaaacaaagagaccctttaaaaaggctctgtgtggccattggcatctctagtataaaatccattacaagtcatgcttctcatgtgaagtatccaataaatgtatattcacaaaacattaaagctaaaatgaggctcttagaaatatagtctcatagtttgtaaacattttttaaacaatgaaacctttcccagaaaacaagtccacacgaaatagataagaggggctactcccaacccacaaggcagctgggagtaactcagtttgggaaccactgaggatcacaatttgtgctgcacctaggagcaggccagacggtccccactctcaggccaggcctctttctaactcatctgtttgttgcctttggccaagaacacactcaaatatatctgtttaatgagtgaactaatcaaatacaaaaatgataactaatttcttgaaataaggccagtataagacactggtcaccactgaggctgaacataacttgagctagacccagttttcaattctccttttcacagaaaataactcattgattcaaaatggcaacagaaaagcaggaaagcaaaagggagcagagaggtcacggaaaaattaccattcattacgagtagattctatgtgaacctattttgcttccttatgcaagttaattcttggatatttgtttccatacttagtgcacaaaggaagtgatacgttatacatacaccatacccccacacacagatacacatacacatatacacactgatctacaaccctctattagtaatcctgaaatccaaaatgctctgaatactggaggggctttcaactttttgtttctaatttttaatttttttaattttatttttctgatttttaattttttttttttttcaaaacagaccagccctacctagagatctttttgtaccttatttggcaactaaacttgacctgccctgtacttatttggtggcaaaatgactaaactgacttgaggctaggtatagtctgtattttcctgagtgtgaagaattgtggacttgtatataaatggttcgattaaataatgatggccctgaaataataaattttaactcaaaaacacgttttaaaatctatacagtagcaactaacagagaacaaattatttaaaaaccagaagtttctaagctaaaaaggatcttaagagcagtcaatctagtaacaccatttgtggagctaactaatttacaatagactgattacctgctacctacagtccaaggcaatgcatttttgtgaccactagtccccattctgaaggctctccctgtgggagttgttttttttttttttttttttttttttttgagaccaggtctaccaggctggagtgcatggcacaatcacaggcactgcacctcaaactcctgggctcaagcaacactcctgccacagcctcctgcctcctgagcagctgggactacaggcatgtgccaccacacctagctaactttttttatttatgtatttatttttgagacaaggtttcactctgtcacccaggcttaagtgcagtggtgcaatcacggctcatgcagcctcaaccaccagggctcaagtgatcctcccaccccagtctcccaagcaactgggactactctactttttttgcagagatagggtttcgccatgttgcccaggctggtctcaaactcctgagctcaagcaattctcctgcctcggcctgccaaagtgctgggattacaggtgtgagccaccacgcccagcctttatttttatttttttttgtagagacagggtctcctttgtttcccaggcttgtccaactcctgacttcaagcaatcctccagccttagtctcccaaagtcctgggattacaggcatgagccacctcacccagcttgttttgtttgatacttccttccctcaattctacttctcgaagtttggatgaatatagaaaaggcttatcaaaatacagcatcaaatacctgttatattgagaggaggagacgataacaaatttacagttaacaatgatcttctgagggccaggcacagtggctcgcacctataatcccagcattttgggaggccaaggcaggcggatcacctaaggtccagagtttgagaccagcctggccaacatggtgaaaccctgtctctactaaaaatacaaaaacttagtctagcgtgatggcgggtgcctataatcccagctactccggagggtggggcagggaaaattacttgaacctggaaggtggaggttgcagtgagctgagatcaccccactgcactccagcgtgggcaagagtgagactctatctcaaaacaaaacaaaaaaaacaatgatcttcttagtccaaaaggacttacaattagtgagcttacaatccattacaattagtgagattattaacaagttggtaatattaactatatgatcaaagtattctgattcaaggatatatttcaaaataaggtttaaggacataaaagagttgataatataatagcagcagtagccatgaccatttaatgagggtctgttatgtagtaggaactgtgtgaggtgctttacatacccatcttatttaatcctcatcaaccctgcaaggaaggtaatctggcctccatttcaaagataaggaagctcagagaggttaaatatccttcccaagatcagacaaggaacagcctgggctgtttgagaaaccataaaaaggggtgctcaagagcacagcttaggctggtcgtggtggctcacgcctgtaatcccatgggagaccaaagcaagcgaatcatgaggtcaggagttcgagaccagtctggccaacatagtgaaaccccatctctactaaaaatacaaaaaattagccaggtgtggtggcacgcacctgtaatcccagctacttgggaggctgagacatgagaatcacgtgaacccaggaggcgagacatgagaatcacgtgaacccaggaggcagaggttgcagtgagccgagattgcgccattgcactccagcttgggtgacagtgtgagactccatctcaaaaaacaaacaaaaaaaaaagcacagctctgagccagcctggcttggtttgaagcccagctctgccacaaattagctggattctaatgcaaatgcatccatttcatcacctataaaatggttataataatagcacctatcccacaggggtgatgttgtgaggattaaatcagttaacatatgtaaagcaattaagagagtgcctgatacctgttaagaccaatataagtattagctattattatgatcattatcaactggagtcagcaatcaaggccaaatctgcctaatcatgcagctcctcttttccattatgccttacaagttaaccacaggccagctgccttcacctctcatgacacctgttggcactgtctgcctctcatttctcttgtctgttccaaaccttatgatctgtggccatttcaggactgcaacaaaatgtctctcttttggtaaacagccaagcatggaatgaaagcaaaaagaaaaggatataaaatgaaaaattcgggccaggtgcggtggcttacacctgtaatcccaacactttgggaggccaaggcaggcagatcacttgaggtcagaagtttgagaccagcctggccaacatagtgaaactccatctctactaaaaatacaaaaattagctgtgcatggtggtacgcgcctgtagtcccagctactcaggaggctgaggtaggagaatttcttgaacctgagaggtagaggttgcaatgagccgagatggagccactgcattccagcctgggcaacagagcaagactctgtctcaaaaaaataaaataaaatgaagaattctaacacctgatgcctttaagtcatcttcacactgcatgggacttaataaacagttaactcaaaattaatcaaggccaaaaaaatcacacaaaagcaataaggcacctaactacacacagatacattaagttgcaacacatgaaacaaagacgagcaagtactataatattaagtacatatttcacacttacaaatctggagctttctcacccttatggtaagacattttttcccagcctctagaaccaagaactactaaaaaagtacatgctcagaattcatgccatataatttagccattaaacaaacacttgcactgcattctctggcagtacctggcactgtgcttgggccagggttacagtatttacagacagcaccttctcttacggagcttacaatccagcatgggtaaagacttcaagcaaatgtatactgtggcatttctaaaaactactctgttaaattttaaaaccttttgtaacctcctaccaaaaaaaaaaaaaaaaaagaaaaagaaaaaaactaaaactaaggaacagatttcaaaccacttaaaaatacagctttcctccccgttgctaaaagtggctttcttgggccaggtgcggtagctcatgcctgtaaccccagcactttagaaagccaagaagggaggatcacttgagcccaggacttccagaccaacctgggcaacatagggagacctccgtctctatttttaaaaaacggtgggcgagggagcaatatctaaaatcacatacatgcctttttccagttctgacttgctcatagtctctgcacacgtttatgataaagaatactgtatttggccgggagcggtggctcacgcctgtaatcccagcactcggggacgccgagacagggcgatcgcctgagctcaggagttcgagaccagcctgggcaacatggcaaaaccccgtctctaataatgaaaaaatacatactgtatcggggcatcgcggggcacggcgagggcagtgcagggtcgaggcgcccggtccaggctgcggcgccgctactcacctctccgaactggaaggcggagacgatggtgacaacgacgcccaagaagcacacgtagagcccatacctgtgggacaggcaggtataggtctgtctctgcaggagcttgaacagcatcaccccttcaccgccacgccacgccccgaggagcctgagccgccgccgccgccgccgccgcctcagcgagccgccattcaggggccccggtcgggccgccgcgcgcaggtcacagcctccgggcgccgctcattgcagctccggcgacggacgcccgctcggctccgcgccgcggccgccgcttccgggagccgggagcccacgccctcggcgcggcggaggcggacctgcggccggcgaggcggccggcgccgcccgggtctggccgggcgagaggcggctgcggcggcggcggggtctccagcgccacctggaggacggaggggcatagggaaggtgcgcgccctccccacctgcgcttgcgcagcgggccctgagggctgggctgggaggggcggagctgagctgggatccacttacccggttgggcaggcgaccaagagaaaactgccccctgcgtcgagactgtgccatagacggtactataatgccatgaatatttttgtgcataaaaccttctctgcacttagcattctctgcagagtgctaaaaggagatgctgtatgtggctcctttcctccaacccccaactatattgtttgaaagaggaaacctttgggttaaatctgccaaaaccgaatttcgttcattcatttagtcgttaaatatgtaatttgtgcctgttaggtggcatagtgcttggtgtcaggtattcaaaaatgaactagacctggctactgttctcagagagtctagtgggggagataaacatgtaaaccactaaatacaagagttgttatgatagaaatcatgcgatgaactggaggggaaccagctcaggggtggccaggtaatccgactttgacagcaggtttttcccacgagatcctttccttggtgcctctgatttacgaaagggagatctttttcttaatcccaatgcaccctagtcaataagatttttttcctagtcaccctgggaaacaatacacttatctaatgttgccatcattcaaagcatttttaaaaatatcttgggaaccagcttcaggaaatactcaaattcgcaccctcagtttgatggtcaggtggaattaacagacttgcaaaaggggttagcttcactccaatccaaggcaagattttttacactttgcagtcacttcttttaatccttcttttaaaaaagatgattgatatatgctatatgtacatggcaaaagattattgcagttgtacaagacacatatagttctgaggtcttttcaagcatgataacagatctgaggacttaatcagaaggggtaaaaaagcatggtaacagatataaaaacatctgccactcaacaggactctcaggataatggccaacatttatgtagcatctgccatgtgcccagctcatctaatcctcacaataatcttataatggagataccattattatccccattctacagatcaagaaactgtgatgaaaaaaagtaactatctaacatcacacaaatagtaaatgacagaattgagatttgaaccaggtacttaggctgtagaacagggccaagattaggggaaggtactgtgaaatgagtcatgcaagtttggagtgagattctgtctttgtttatagttttgatatcggggctgggtgtggtggctcatgcatgtaatcccaatactttgggaggtcaatgtgggaggatagcttgagcccaggagtctgggagcccagaagtttgagaccagcctgggtaacagaccctgttcctattaaaataaaaaaaaaatttaaaacgtaaaataaaacataaagtttgggtgttttgcttttcatggatattcttcagtaatgttttttgttttttttgttttttgggttttttttttttttttgagacagagtcttgctctgttgcccaggctgggttgcagtggcgtgatctcagctcactgcaacatccgcctcctggcttcaagcaattctcctgactcagcctcctgagtagctgggattacaggcacatgccaccacccccggctaatttttgcatttttagtagagatggggtttcagcatcttggtcaggctggtcttgaactcctgacctcaagtgattcacctgccttgacctcccaaagtgctaggattacaagcatgagccactgcgcccaaccattaattttgattttttaaaaatattgcattaggctgggcacggtggctcacgcctataatcccagcactttgggaggctgaggcgagtggatcacctgaggtcaggagtctgagaccagcctgaccaacatggagaaaccccatctctactaaaaatacaaaattagcagggcatggtggcacatgcctgtaatcccagctactcaggaagctgaggcaggagaatcacttgaacccgggaggcagaggttgcggtcagccgagatcgtgccattgcactccagcctgggcaacaagagtgaaactccatctaataaaaaaaaaaaaaaaaatatatatatatagcattaaaatattattcctcttgattagtgagttttttggagttccctcggattttccacccaagacaagtgcttcactgtcctcactttagtcctagccttgcctagaacctgtccttcttaaaaagtatgctttgttgtagtatgaattacccttaaatttttcctttatctttaggctccaactagacagcctcaagggaggtcaggagcattgtctaagtcctttcttctagagaacttgctcttgttcactcccttttccccctcctcaggcagtatggttgaacttaaataaaataaatgtgggtgcaatatgatatacctgtagtagctaccttatacagttaggagggttatgtaaaataacacatgaaaatgctcaagtgcctgcgacatttttagtgttggaaaaatttaagaaaattaacatttagccttgttctgaaagcaatgaggttttcagcaggagaattaactgattaaatatgcacttcaagaacattagtagtatgtaaatgcataagttgtggaaattatttttttaaattttttgtagagacagggtctcactatgttgcccaggctggtgttgaacttctgggctcaagcaatcctcccactttggcctcccaacatgctgggagccacctcacctggcctggaaatgattttaaactctccacatctgaacagtggaaaaaatatgcagtagcatcccatttatctggaaatattttatctggcaacctaaaagagccagaaaagccaaaagatcaaaaaggattcccaggaacccagtgaaacccctgagttttgcttttagaagaaccccacagtccctctcaaaatctgataaatataattccgagaaactgtcatctgggttctcagtctatagcagataaataaataaataaagaggtccctttcctgcctttctcccaaacatgaagtaactagagaaaaaaatgatgtagaaaatattttttaaaaaagtcaaatgaattccaaaaatgtaatcatcttcacatcaatgatgtagatatctgtaagagcagagagatagagtgaaggcaacagtacctccaagtacagtcagtaggctaatatggcatatagtggtgagctcaatctatgagaaaagtttaagtaatggttagtgtttattcagcatttgtgaatgaatgctttgtgctgggcattttattggacattgagtctatctcgtaatgacttaggtaccccaatacttgggtaccaagaaagacatggtccctgcttttgtgggatttacactctggaggggcatatatatattggattagtattgtgaggggcactaacctagcctgggaggtcagggatggcttcctggaggaggtgatactaaagattgagctggaggactcaagatgtggggtgggaagggaactatgttccaggcaaggctggccacatggaaggcctaatctaaggcaagaagggctggagatgcaatgaaatggaactagagagtctggcaggatcttaaaggccatagcaagaatgaaagaccttatcctaaagacaatgaagaattttaataaagtctaacaaatgacacaatcagataatgaatttcaagagttatcataactgtggcgtggaaaatgtattggagggggcctgaggagttgaaatgagaccagtgatagtagagttgccagataaaatacccagttaaatgtgaatttcagataagcagccacatacatttagcataagcaaatcccatgcaatacttaaaaagctttatttacttgaaattcacatataactgtgtgtcctgtattttttattttattttatttttttgagatggagtttcgctcttactgcccaggccagattgcaatgacgtgatcttggctcactgtaacctctgccttttgggttcaagtgattctcatgcctcagcctcctgagtagctcgtattacaggtgcccaccaccacactcagctaattttttgtatttttagtagagacagggtttcaccatgttggccaggctggtcttgaactcctgacctcaggtgatccacccgcctcagcctcctaaagtgttgggattacagacgtgagccaccgtgcccagctgtgtcctgtatttttatttgctgcagatgttctgagccactcttgaccaggcatgggaattcctgtcccttggcccaagccagtgcctagaaagtgtatctgagtcagggatgaagtattagcctatatatccccttgtccatagatgtaaaacaacattctgcagttaatttcattaatattaaagctgatcctcatctgcctgtatcttgcatgatcttctcaattggttcaaaactcaggagacaatgagaatgtttttatgtattggaccctaaaacatttaccatctttgagtctccctttgcttagccagggtgaaaactgaacatccaaagaaaacaatcttgctcaatcagggacctcttgtcccaggcctacacatattttgtgtatagaaatagtgtgcttcaaaagcctcactgtgaggtcataagaaaattaaagagctttcagtagctgattaaagttaaaatacctcctgttaagtgtatatttaattaagtccttcctttattaatgataagaagataaaatgttcatgttgtaaatgctttccttttaagctctaggcttgaaaatcttgcttgttcccaggaaacacattttgattttattccctcccttagtgtatattcatagacatgtaagttgtaagtcatcctattcctttctttagtctaagaaagccagacagccataaaaaagaatgaaattatgtcctttgcagcaacatgaatggagctgggtgctattatcctaagtgaactaactcagaaacagaaaatcaaatgctgcatgttctcatttataagtgggagctaaacaacgggtacacatgggcataaaaatggcaatattaataattaaaaccagggactccaaaaaaggtgacagttggggggtgatgagatttgaaaaattacctgtcaggtacagtgttcactatttgggtaatgggtacactagaagctcaatctttactagtattcagtatacccatttaacaaacatgcatgtgtatcccttcaatctggaataaaattaaatacattttaaaaagaaagtgaggatggcttttaatttttgcaaactagtgcaaacaaaattattaagtaatttaactgtttctgatagaatttccttttcttttttttttttttctttttttttttgagatggagtctcactctgatgcccaggcaggagtgctttggcatggtctctgctcattgcaacctccgcctccttggttcaagtgactctcctgcctcagcttcccaagtgtctgggattacaagcacctgccaccatgcctggctaatttttgtatttttagtagaaatggggtttcaccatgttggccaggctggtctcaaacttctggcttcaggtaatccgcctgcctcggcctcccaaagtgctgggattacaggcatgagccaccgcagccagcctctgacagaatttcaagagccaaatctatggccataccaccctgaaggcgcccaatttcatctgatctccttaaagctaagcaggtttgggcctggttagtacttggatggaagaatttcaagagccaaaacataacatggctcactgttaacttttttgtgagttcaaacacatcacatatatataaaatacctaattttcacataaatgtaaccatactttgtcctttttttttttttttttttttttttgagatgaagcctcgccctgttacccaggctggagtgcaatggcacaatcttggctcactgcaacctctacctcccacgttcaagcaattctcctgcctcagcctcccaagtagctgagattacaggaatgtgccaccacgcccagttaatttagtatttttagtagaaatggggttttaccatgttagccaggctggtctcaaactctcgacctcagatgatccgcccaccttggcctcccaaaatcctaggattacaggcataagccaccgcaccaggcccaaccatactttattctgtttatgtgatatttacttgtgggtttttttgtacatttcatccactggaatataagcaacataaaggcaagagacttacccatcttatccagaaatgtatccctaatcttagcattgtgtcttgccaatagaaactaattgataaaaatttattacatgaattaatatattttgcactgataaaagtaccaaccattggctgaggtggctcacacctgtaatgcctgcactttggtaggccaaggagggtggatcacttgagcccaggagttcgaaaccagcctggccaacatggcgaaaccacatttctactaaaaatacaaaaattagccaggtgtgatggtgtatgcttgtaatctcagctatgtgggagactgaagcaggagaattgcttgagcctgggaggcagagattgcagcgagccgagattgcgccactgcactccagcctgggcgacagagagggactctgtttcaaaaaaaaaaaagttccaatcacagagttgtataaagttttgatgaattgaattacagtgtgttattaaaggatatagagaataaccctatgttttgaggtagagctcatttggaaaactttctagcttgggatcatttttatatagtggaatatactaatgtcaacttggttttaaaacctctgttatttctatcattattgactctggttgtttgtttgcttcattttgtctactacttctttgtatcttttctccctttgcctaaataaccttttctttttttagagacagggtctctctgtcaccctggctggagtgcagtgataccatcttggcttactgcagcctcgacctcctgggctcaagcgatcctcccactgcagcccctggagtagctgggattacaggtgtgcaccaatatgcctggctaatttttgtattttttgtagagatgggttttcgccatgttgtccaggctggtcttgaactcctgagctcaggcaatccacccatctcggcctcccagagtgctgggattacaggcatgagccattgtgcccagcctaaataatcttttcaaaaaccagcttctgccaggcacggtggctcacaatggaatctggaaaagaaggctggcccagtagtcccagaaccttgggacaccaaggcaggaggattgcttgaggtcatgagttcaagaccagcctgggaaatatatcgagatgccctgtctctactaaaaatacaaaaaatgtgctgggcatggtggtgtgcgcctgtagtcccagctactcaggaggctgaggcggaagaatcacctgaacctgggaggcagaggttgcagtgagctgagattgcaccactgcattccagcctgggcaacagagtgagactccgtctccaaaaaaaaaaaaaaaaaagacaaaaaaaaaaaaaaaacacaccaaacagacaaaaaaaaaacccagcttcctgtttgggtcattctctctaatgttctgtggttttctattcattgatttgtgtctctgtcttggtaattttccccccttattctgtttgctctgttgctctgttgctcttgaactcatttttcaaatttaatatttagctcaattttttcaattttatggttttttaataaatgttttccaaagcataaatgtccctctaattactaattttattgcatcccatcaatattggcacagaatgcaggtgcacaattgggagttggggcactgcagtgggtgtcaggcctgggcacacaatgtacccatcaggaggaccaaggcaaggaggtcaccaggcctaggccagggtggcaaggttctgagatactgtgatctctggatacgcatggctgctgcagagcacagctgatgtcctcccatactggtaccctaacccaccatgtggcaggaagaagaaaacacaaaaaccaaacaatgaaatctagaaaagaagagtggcccagtggctcatgccagtagtcccagaaccttggaacaccaaggcaggaggattgcttgaggtcatgagttcaagaccagcctgggaaacatattgagatccccatctctacaaaaactttttaaagaaagaaattagccaggcattgtggcccgtgcctgtagtaccagctactcagtactcaggaggctgaggcaggagagtttcctgagcccaagagtttgaggctgcagtgagctgtgattgtaccactgctctccagcctgggtgacagagcaagatcctgtggaaaaaaaaaacaaacaaacaaacaataacaacaacaaaacaaacaaacaaaaaacccaggaacaatgcctcatgcctgtaatcccagcacactttgggaggccaaggtgggaggatcacttgagcccaggagtttgagatcagcctgggcagcatagtgagaccctgtctctaaaaaaataaataaataaaaaataaatgggcacaccatggggtagccctgctccacaaagagcagtaaaaaaattttatgccaaataaataaatatttttaaaaggacggaggaagggaggggagcaaatatggaaagagttggggcggggggtgatgccaccttcttcctgcaacattccttcatcgccctctactggcaaagcttcacatcacactcactgcaaaagaaacgcttcaaaagaagtccaattcattaatacacagcaagttctgaaggagtgaatttggaactgagaggcaacaattgattattggcatatccttgaagccagggttctaggtgtggttgaagttctcctaatcaggtgaattcacagaagatttcaacctggaagtaagctacatggagagagagaggcagtgcaaagggcgcctgttttggctggagtgagtgagtcaaggcaggtgtggtgcagttggaagcagcttcctgcctctgtagaaagcatcctgatcctgctctttctgatcccggcagcgtcagtagctcccttgacagcttagttcagtggagtattaggacctgatcttacaaattcaacctagtagtctctatctagaatactgtcataggtaaaggctctttgttcagacctcctgagggcttatgggtaggccaacttaatccctttctgtttaaatcagtgaatagattccttaatctacaaataattaccctgaccaaaataaggtaagagaacatagcttgtataatagtaaaactccttggaattcattgactcttccttcgttgcctagcacattgtccatttttgtaaagtttcaggtttgctcaaaaagaaaatattctcaccaatggctttggctcatgcctgtaatcccagtgctttgggaggccaaggttggagggtcgcttgagcccaggagtttaagactggcctgggcacatcgtgagacccatctctatgaaaagaaaaaaaattagccgcgtgcagtggctcacgcctgtaatcccagcactttgggaggccaaggcgggtggatcacctgagatcaggagttcaagacggaccag
